United States Patent 6,812,339 (POLYMORPHISMS IN KNOWN GENES ASSOCIATED WITH HUMAN DISEASE, METHODS OF DETECTION AND USES THEREOF) - sequence listing, part 102

SEQ ID NO: 145507 - DNA, 601 bp, Human
taaaatattacaatatgacatttgcttcagcatcctaagtagccatcttacaggaagtttgtaatattcctatattgtttttaaagaggggaattaatctggagtttgagtaatttccacctggactaggtggaacattctactataaaaaagagaaaactccataacttaaaaaaatcctttgggtaatattatagaatatatttcaataaattataacattgtcacttataatggtactcattcattcactcactcattcatttatattccactaacatctttgccaactgtgaatagmacagtgcattagactataatattctttgctatgcaaaatgtccataatattccattggttccaatagcatcttgtagcattttaattattatccattaatatttgaacattttattagtttttaggtcataaggaggatcatgatagattcaccaagatttcggtttaaaaataattcaagattcagattaaataaagtattatttatgaggttcttaaagtgcttataaaaggattatcataaagatttctctttatatttggcttctgatctctccattgctttgttgataaagaagt

SEQ ID NO: 145508 - DNA, 601 bp, Human
agactacaatttgaaagaaaagtgttgaaaattaattgcctccaaattttttacagtccagtttttaggggcatatttgtccacagccatactcttgaagctcatggcttcaatctgggcacttagaggtagagttattctgggtatcctgtagacatttggctctgtatattgagatttttatagcaaactagacctccctctctgggttcccaaattcttctactgagagaaccttgtgcatcaggctgagtccacaccttttcgtttcctcagattttgtatgctagggtctggctgrtgctttcaaaatcactttgagtgtctaggatccaatccagacacataactctgtgcagaaaaattgtcaataaagttagaagcaaaggagtatcttccaataagttatcaagaagagaagagacagtgatttgtcttgagtagtatagaaatttaacctcctggaagccaaagggctgaacatgacagttctctcaccattctgttcaatttgatgactgagtaaggaaatggaagagccataagctttgaatatttcaaataagtctatgaaaaccagaatgagtggttttaattaatc

SEQ ID NO: 145509 - DNA, 601 bp, Human
tacactttttaaaccatcctccatattcagctctggcttttactgttgctttcagagttatctgctgcctccagttcctgaggtctgccagtatgctatggataaccagcatgtttcttgttggctcttcattttgccagcctatatgtttcatattttactatttttctatttgtacaaagtcagttcctctcaaatatcctctttccactttctaaatgtgataaacatttcttgcctcttcttgtccctgtcatatagtctttgtctttatggattgacatgtttttgttgttattgmaattttaatggatatctgaaataaaaaataaatcctgcatgtttaacctaggagagaaaatttcaagaatgtatgaaaattgaagaggagatattcactgataagaatttgaaactgtctatctgctcatgagagagaaatcatgttaaaacaaaaacccaggggcatttaaaagaaaagtaattgcaatgaggtgaattccatagtagttgctgtttcactgttctgttcccaactagaaagagtatctggttctggacacttgccagactacaatttgaaagaaaagtgttgaaaatt

SEQ ID NO: 145510 - DNA, 601 bp, Human
taattagatgtggaaatgattatactacatactgtttcccctacctgtaggccactgaaatcatatcttcatccccacagttccaaaattctacataaagtgctttggtattgggtactcagtagctctctcagtccagaatctcaaagtctctagctctaagaaatttcttgtgttattttgtggaaatgttcttcttttctatttttttctctttttttctgaaatgcctattagttgactgttgaacattttggattgatgttctaatgttcttatctctttgtgagccagtgtctcrttggctcaattttgctacaaagtaaatctcaattttctatcacggaggacagagaacaacagcaggactggggaaagcatctgggaagcccatagatctttatacactttttaaaccatcctccatattcagctctggcttttactgttgctttcagagttatctgctgcctccagttcctgaggtctgccagtatgctatggataaccagcatgtttcttgttggctcttcattttgccagcctatatgtttcatattttactatttttctatttgtacaaagtcagttcctctcaaat

SEQ ID NO: 145511 - DNA, 601 bp, Human
tttagaaaataaaatattatttattccagaaactaaacaaaaacagcaaccatttattacttatctattgctaggtgttgggctaaatgtttacatatacgtatatattcatatatttacacataatatagtttataatatataataaatgtcacatatttatatatatattgaatttttacaatgatcttatgagatggctactataacctcaaataacataaagaaacagaggcccagagaggctaaagtaacttgtccgagcatacagctggtgagcaacagagctcaggtaggtttkcaagtccctgtggctccagcagttctcattacactaataactttactgcctctgtgatatatgcaatttaagatttgcttagggttcatcatataagaagagttactactatttttaaatcaacacataattttctaactgttccatgttgagaaattttaaaaaagcagaaaacaacacaaaatgatattgtaccaatatacacagcctacattttttctactttcaatcagcagcttatgaacaccaacatatgccctttgagcttgtagcagcataattccagaaagacaatccttc

SEQ ID NO: 145512 - DNA, 601 bp, Human
ttgatagtatttttttcagctaactcaccatgtcaatgactttcagatgaccatatgaaaagacaatagcattgggtggatttgctactggtaggaggaatgcaaatgaagtacacagagtagaaggtatcagaatataaagagggttcacatgaatggcttcggcctgttgtaagagataaaaaagagtctaagtaaaattttgagggtagacacgaaacataaaaaaaaaaaaagtattacaataagccttcccagaagcatgttggaacctaatgatataaaattatataaattattrcagttataacttgaatatttttaagaaaatatctcatcctcttgttgttgatacagttacagatgcccacttaaacattacagtccagttcatttagaaaataaaatattatttattccagaaactaaacaaaaacagcaaccatttattacttatctattgctaggtgttgggctaaatgtttacatatacgtatatattcatatatttacacataatatagtttataatatataataaatgtcacatatttatatatatattgaatttttacaatgatcttatgagatggctactata

SEQ ID NO: 145513 - DNA, 601 bp, Human
tggatcctagtgttgacttgtaggtttatgctgtcgtgtggagcatgttcagtgctcttttccttcgtccaaagcattaatgatgcattcaacatctctctgtttgtgaccgtaagttttaatggcatgttcacttctgataatcactcttaaaaacaattttgtgattagtcatgcacactgcattcataaacagaattcaggccctgcttttcctggtggttgattggtgtataaaagggaagataattcaagacatggcacacaccaagatgtgtattggatttgatagtatttttttcagctaactcaccatgtcaatgactttcagatgaccatatgaaaagacaatagcattgggtggatttgctactggtaggaggaatgcaaatgaagtacacagagtagaaggtatcagaatataaagagggttcacatgaatggcttcggcctgttgtaagagataaaaaagagtctaagtaaaattttgagggtagacacgaaacataaaaaaaaaaaaagtattacaataagccttcccagaagcatgttggaacctaatgatataaaattatataaattattacagttataacttgaa

SEQ ID NO: 145514 - DNA, 601 bp, Human
tctgtgtgaaagaaagggagctgggacttatcttggaactgtatttgcataggaagctcactaaatttactttggctatattatcatttgggttggtttggaaattggtgatgaagatttggaaactactagaatattctcaagccagttcttataaagtactgaatattctgccagtacttttgtatttggcaaaaatgtgcatgctttatcagtgaaattcttacttattgtttgcttgtgttttcacgttaggtcctggtattgaaatcacaacaagaaagatacttcttcatcagtsaggcactgactcagtgtctcattcagaggaaatgttggtgcataaatgtttgtgatagaaaatcacagtgttgttttgattgctgatttctttaaccctattttttccttttgcctggatcagtttggatcctagtgttgacttgtaggtttatgctgtcgtgtggagcatgttcagtgctcttttccttcgtccaaagcattaatgatgcattcaacatctctctgtttgtgaccgtaagttttaatggcatgttcacttctgataatcactcttaaaaacaattttgtgattagtcat

SEQ ID NO: 145515 - DNA, 601 bp, Human
tgtagaggcagttctagaatgtttatgttgcaggagcttaggaacagcagtctgtgtgaaagaaagggagctgggacttatcttggaactgtatttgcataggaagctcactaaatttactttggctatattatcatttgggttggtttggaaattggtgatgaagatttggaaactactagaatattctcaagccagttcttataaagtactgaatattctgccagtacttttgtatttggcaaaaatgtgcatgctttatcagtgaaattcttacttattgtttgcttgtgttttcacrttaggtcctggtattgaaatcacaacaagaaagatacttcttcatcagtcaggcactgactcagtgtctcattcagaggaaatgttggtgcataaatgtttgtgatagaaaatcacagtgttgttttgattgctgatttctttaaccctattttttccttttgcctggatcagtttggatcctagtgttgacttgtaggtttatgctgtcgtgtggagcatgttcagtgctcttttccttcgtccaaagcattaatgatgcattcaacatctctctgtttgtgaccgtaagttttaatgg

SEQ ID NO: 145516 - DNA, 601 bp, Human
gactacctaggcataaagtctatctccaagaattatatatagtgaggaaacaaaaaactaaagaaaataagcaagttaaaacaagtgctgaggagttaaaggaaataaagattaaggttgattaataaaaatggcttaagtatcactaaatcttgaaaaaacaaaccaggtgagtatggcagggaaagataatgctcaataacattatcagccccaatccatataaaccagatatggctgtagagacgtagtttaatgttttattttttcctattccttagtttctcacttattcaggacyatatatgttgaacttcacttagcaaaactgcacatactctttatataaaattaactgaatcacactacatgaaaggcaacagatctaactacaaaataagacctagtaatcttgtttataaccttctcattctcccttcataatactaccagctaatgaatggcatcagaactatttatgtaaaagtacatatcatgtatttatgtattacaatgaaatctcaatttccacaaaatgaatttttagaaactgtggtaaaacaaaagatttactgatgatctgcctcctccatgaagccaa

SEQ ID NO: 145517 - DNA, 601 bp, Human
gagcacagcaagaacagaagttgaataagcaagaaagacagtaaaagataaaacccagccctttgcatcttaaaagcatgcctaattttggcattcatttgggtttcagaaaagttctgtcaaaggttctagtgtctcttggtatgctgtttcaggaatacaaaattcactaatataataagccataatttcagcatgttgtccagtgcattacaaaaaaatttaagaaaaccaagattattttaatcacacaaatgaatccccacagtaacctcaatcttgaatcagtctctaaagtaaycaagtcaattcactataactattaagtctaccactgaaactaaaaaccgatttttttaatattggaaaataagcagtaacatgtaacacctatcatatcactaatacaatttcatccagaattaggattctagatggaattggttaacaaaagagaaattcttaaaaataattccatcttaaccaaaaaagcagtttctaataacccaaaaatacattataattacaaataataattctaagttagctaagagttggtaattctactactaatgcttttttattctgttcactctgctgt

SEQ ID NO: 145518 - DNA, 601 bp, Human
gactttatttccagactttataatctgatattactcatagatacaatttttacattaaaagataactttttaaaaaaatagtatattttaaataaaatccctacaactgtccacaacagagagatggccaaagagtgactggcagaacttggtgaaagagacactgttcaaaaggcccagtcacatcttttcctcaagagctgtgctttctaatatccagagcacagcaagaacagaagttgaataagcaagaaagacagtaaaagataaaacccagccctttgcatcttaaaagcatgcytaattttggcattcatttgggtttcagaaaagttctgtcaaaggttctagtgtctcttggtatgctgtttcaggaatacaaaattcactaatataataagccataatttcagcatgttgtccagtgcattacaaaaaaatttaagaaaaccaagattattttaatcacacaaatgaatccccacagtaacctcaatcttgaatcagtctctaaagtaaccaagtcaattcactataactattaagtctaccactgaaactaaaaaccgatttttttaatattggaaaataagcagtaaca

SEQ ID NO: 145519 - DNA, 601 bp, Human
atacacatggtaggaattgctcagcagcaaaacaaatagaacccggctcctctgtactttggccaacgcttaagtagctccaattctatatgttatgaggaatcctgaatgtcctaatcaaacctgctctctaatcaagactttatttccagactttataatctgatattactcatagatacaatttttacattaaaagataactttttaaaaaaatagtatattttaaataaaatccctacaactgtccacaacagagagatggccaaagagtgactggcagaacttggtgaaagagacmctgttcaaaaggcccagtcacatcttttcctcaagagctgtgctttctaatatccagagcacagcaagaacagaagttgaataagcaagaaagacagtaaaagataaaacccagccctttgcatcttaaaagcatgcctaattttggcattcatttgggtttcagaaaagttctgtcaaaggttctagtgtctcttggtatgctgtttcaggaatacaaaattcactaatataataagccataatttcagcatgttgtccagtgcattacaaaaaaatttaagaaaaccaagattatttt

SEQ ID NO: 145520 - DNA, 601 bp, Human
ctgagactgaagtgaagtaactgggtaaataattatcttgtttttattactctttcttaaatgtgttacagctcacatttatttcattaattaatattagaagtgtttttgtctttatttagaagtttggtgatatatgctacagaaacttagctcttgtttatatcaattaccctatggtaaaactggtttcattatgtgttgtttcacctaaagtcacagtttccaagaatccatcaacgatgctaggtgacctataagaattatatttatagttaacaatgtatatcctattactgtsactatgaatgtataaacttttgtttctagaacctttagagtaagagtgaactctattaggaaagctatgacttctagacagaataaattataacaaagttcaacccttatctgctcttttaaaatctgtttttctactcaaaactagaatgggctaccattatacttccattaatattatttatttaaaaaatctatagaatatggacaaaagtgaaatacatgagattactacaagcatgcatttccttaggcaagttttgctcttaccagtttttataaagactttttaaaaatctta

SEQ ID NO: 145521 - DNA, 601 bp, Human
ttacactatatttatgaatatggttaagcatgccaaatgtctcctaattactaaatacttaatacagcaggtcctcaaataacatccttttgttcaacatcattttgttcaatgtcctttcatcataacttttttttttgtttttaagagaccaggtcttcctatgttgcccaggctggagtgcaatgccctcatcatggcttactgcatccttgaattcctgggctcaagtgaacctcctgcctcagcctctggagtaactgggactacagacatgggccaccactaccagctacttttycttgtagagattaggtctatgttgcccacgctggtggcaaactactggcctcaagtgatcttcctgcctcagcctcccaaagcgctgcgattaaaggtgtgaaccaccacgtccagcccattattaactttgatgagaaaagaaaatcattttcaagctggggtcactgtctgtgtggagtttgcaggtactccccatgtctattgggttctctgggtacttggatttcctcccacatcccaaaaatgtgcatgttaggttcactggtctgtctacattatcccaggatgagcaagtgtg

SEQ ID NO: 145522 - DNA, 601 bp, Human
tcctctacagtgcattaactcctatgagaaaataatgttttctaattagttttactctcctatatgctattatatcagtataactctcgaatacttctgagactactaacatagatgcaataaataagatttattttgtattacactatatttatgaatatggttaagcatgccaaatgtctcctaattactaaatacttaatacagcaggtcctcaaataacatccttttgttcaacatcattttgttcaatgtcctttcatcataacttttttttttgtttttaagagaccaggtcttsctatgttgcccaggctggagtgcaatgccctcatcatggcttactgcatccttgaattcctgggctcaagtgaacctcctgcctcagcctctggagtaactgggactacagacatgggccaccactaccagctactttttcttgtagagattaggtctatgttgcccacgctggtggcaaactactggcctcaagtgatcttcctgcctcagcctcccaaagcgctgcgattaaaggtgtgaaccaccacgtccagcccattattaactttgatgagaaaagaaaatcattttcaagctg

SEQ ID NO: 145523 - DNA, 601 bp, Human
gagggtgttatgtgcttagtaagtcctcaagacttgactacgtttcactaataaaaatcatttcagtttctagctagtttatgcatcagtttatgtattagtaaaggagttgattgataagacatatatatctcatacatatgtcagatatatctcatatattatcttttatatatatatctttcatttgatcacattttcttgaggggcttttctgtatttacctcttcaacattacagtcaattatttggtctctttaaaaaaagggttacaattcctctacagtgcattaactcctawgagaaaataatgttttctaattagttttactctcctatatgctattatatcagtataactctcgaatacttctgagactactaacatagatgcaataaataagatttattttgtattacactatatttatgaatatggttaagcatgccaaatgtctcctaattactaaatacttaatacagcaggtcctcaaataacatccttttgttcaacatcattttgttcaatgtcctttcatcataacttttttttttgtttttaagagaccaggtcttcctatgttgcccaggctggagtgca

SEQ ID NO: 145524 - DNA, 601 bp, Human
gttctgagcacatttaaggaaggctaggctaagctataatgtttggtgggttaggtgtgttaaatgcatttttgactacaacattttcaacttacgacaggtttatcaggacataatccatcataagtagaagagcatctgtacctgataagctgcttgtttctgacatcaattctctaggctatttaaggtttttcatattcaagtcccacaatgatatacctatctctcctctctattattcaaatcttttatacatttatatatgtgtgtgtgtgtgtgtgtgtgtgtgtgtgtgatrtatatatatatatgctggtttgcagcatatatctttttgtgcataatttttgtcttcttcagctatacagtgaataactgaggggtaaaacctggattttccttactgctccctcatattccaagatactgggagggtgttatgtgcttagtaagtcctcaagacttgactacgtttcactaataaaaatcatttcagtttctagctagtttatgcatcagtttatgtattagtaaaggagttgattgataagacatatatatctcatacatatgtcagatatatctcatatattatctt

SEQ ID NO: 145525 - DNA, 601 bp, Human
cttcaaacttaccatccactatctgcccaagcaaatgtcattctcaattctagccaaccagtctcctcaatgcctcctaaaattctatacacattttctatcccaaacttttgtttacacatttcctgatataaacactccccaactaatgatggttccacttacaatttttcagctttacaatggtgcgaaagcaatatgcattcagtagaaaccatactttgagtacccatgcaaccatttagttttgtactttcagtacagtattcaacaaattatgtaaaatattcaacactttatyataaaatgggctttgtgttacatcaggttgcccaactgtaggttattgtaaatgttctgagcacatttaaggaaggctaggctaagctataatgtttggtgggttaggtgtgttaaatgcatttttgactacaacattttcaacttacgacaggtttatcaggacataatccatcataagtagaagagcatctgtacctgataagctgcttgtttctgacatcaattctctaggctatttaaggtttttcatattcaagtcccacaatgatatacctatctctcctctctattattcaaa

SEQ ID NO: 145526 - DNA, 601 bp, Human
gataaagccttagaaaaaaacactaagcacatgcatattaaaatagccagaaaatattgaagagtaatgagagacttactcttatcaaactgtatcatcattatgaagctacactaattaaaatccagtgtactggccaagaaataaacaaatgaaagaaatagaagaaacttcaaaaataagtctaagacttagggctgtctaatcttttggcttccctgggccacattcaaagaagaattgttttgggccacacataaaatacattaaccctaacaatagctgatgaacttttaaaaarttgcaaaaaaaaatatcatgttttaagactgtttatgaatttgttttgggctgtattcaaaaccgtcctgggccacatgcagcccatgggccacgggttggaaaagcttggtctacgtactccttgtaatttagtaaattataaaagcagcatttcagacaggcgcggtggctcacgcctgtaatcccagcactctgggaggctaaggtgggcagataacgaggtcaagagatcaagaccatcctggccaacaaggtgaaaccccatctctactaaaaatacaaaagttagctgggcgtg

SEQ ID NO: 145527 - DNA, 601 bp, Human
cagacttttaagttatatcaacctgaaagaatttataagtagaagacctgcattacaagaaacattttaaaagaaggaaagaaaaaaatacttctccttctcactgcaagaaaatgataccagagaaatacctagatttagacagatgaattaagggtaccagaaatgataaccaagtgaataaatataaggtttttttcccttactatttaaatgtctctaaaagataactgaatctttacagcaaaagctataaaaatgcatcatggaatttataacatttgtagaagtaaaatacatrgcaacaatacagcataatagtcggtagggctacgtcactgggtgatagggatttttctgctccattataatcttatggggccttatcacatatgtggtccatcactgactgaaacaccattatgtgatacattacattatgtaatacctgggtattattttgcacttcaaaaaaaatgttaaagaaatgggtaatgtatatataagaaaagtataaaagtgcagaagaaaacaagacaaataataaataaaaattcttgctttccaatgggaagcctcaatatgtcaatcttccaaaatt

SEQ ID NO: 145528 - DNA, 601 bp, Human
atttcaaaatgtagctagagcaaagactggacatatatttaaaaaacacgcaaatcaaacttctagaaatgaaaactacaatgtctgaaatgaaaaatacagtggacggtttttatggcagattagatattgtagacaaaatatttgtgaatttaaaggcatagcaacaactgctatccgaaagaaacacagaaaaggaaaaagcaaggaggaggaggaagacgaggaggacagggaggaaaaaatgctatacagcagtgaggtatgggacaacttcaagcagtctaatatatctgaaacrcagggccagggaaagagaagtagatacttgaaaaaatcatgtctgaagtttccaaacttgatgtaaacttagttaaaacccagcaagataaagaataagaaaactgcacaaaggcacatcataatcagatcccttcaaactagtaataaagcgaaaaatcagaaaagcagtcagagaaaaaaagatacattatgtacagaaaattaaagaaaaaaacaacagcagatttcctgtcagaaataatgcaaaccagaagatactggagcagtatctttaaagaacagaaagaaaaacctatca

SEQ ID NO: 145529 - DNA, 601 bp, Human
caatgggaattaaaaaaaactatctgtatcttcagaaatatttacttaagtattattgtaaagagcacacaaaagagcaggttgctattaaaacagatcaattagcaattatacaaatgacttcatggaaaaaaaatagcttcttaccatcaaaaattcaagacttattaaaagagtcaaggtaaattttacaaaatctggcattcaatcaaaagttgccaaaaatgcaggaaaaaaaaaaaaacaggaaaagacccatagtgaaaataggaataaaacagaaactgactcagatgatagsagacaggacattagaacagttgttatatctgtagtccatatattttaaaatgtagctagcagacaggacattagaacaattgttatatctgtagtccatatatttcaaaatgtagctagagcaaagactggacatatatttaaaaaacacgcaaatcaaacttctagaaatgaaaactacaatgtctgaaatgaaaaatacagtggacggtttttatggcagattagatattgtagacaaaatatttgtgaatttaaaggcatagcaacaactgctatccgaaagaaacacagaaaagga

SEQ ID NO: 145530 - DNA, 601 bp, Human
tacctaatacaaaatattattaataggagaaactgaagagtagggaaggagacagagtatatggcaaccctttgcactttctgcacaattttcctgtaaatgtaaaactgctctaaaaaataagatttcattttttaaaaaaatgcatgccagctacctatattgagcaagcagtccttcaaatataaatataaacaaacaaccaagaataataagacagctgaggaaaaccagcagcaaagagtagagtgactacaatgaatacacagtgcaagtgtctgaccaaaaaaaaaaaaaaaaattcaatgggaattaaaaaaaactatctgtatcttcagaaatatttacttaagtattattgtaaagagcacacaaaagagcaggttgctattaaaacagatcaattagcaattatacaaatgacttcatggaaaaaaaatagcttcttaccatcaaaaattcaagacttattaaaagagtcaaggtaaattttacaaaatctggcattcaatcaaaagttgccaaaaatgcaggaaaaaaaaaaaaacaggaaaagacccatagtgaaaataggaataaaacagaaactgactcagatgat

SEQ ID NO: 145531 - DNA, 601 bp, Human
ggtgtgaatgtggtgcaacagaaacagggagccagtctataaaggctacatactgtatgattccaactatatgacatgctggaaaaggcaacactatagaaaatgtaaaaaaaaaaaaaaaaaaaaaaatcagtgagtgataggatttcagcagggaggggcgggaggaataactgcagtgcagggtatctgtagggcagttaaactattctggtatgacactgtaacggtggacatgatgttatgtacttgtgaaaccaaaacccaatgatctgtacaatacaaagacttaaatctaacrtcaactatgaactttagttaataataatgtatcaatactggatcatcaattgtaacaaatttacctaatacaaaatattattaataggagaaactgaagagtagggaaggagacagagtatatggcaaccctttgcactttctgcacaattttcctgtaaatgtaaaactgctctaaaaaataagatttcattttttaaaaaaatgcatgccagctacctatattgagcaagcagtccttcaaatataaatataaacaaacaaccaagaataataagacagctgaggaaaaccagcagca

SEQ ID NO: 145532 - DNA, 601 bp, Human
ggaaaggaaaaagactcagaatagtcaacacaatgctgaagagtaagagtaacatcagaggactgacactacctgtcttcaagacttactataaagctgcagtaatcaggcagtgtggccttgttgagagcaaacacaaatagacaaaatagactggtggcccagaagtagacccatacaaatgcagtcaaatgatctttgacaaaggagcaaaggcaatccaataaagaactgataataatcttctcaacaagtggtaaaaagctagacatccacgtgccaaaaaaaaaaaaaaaaaaaatcaaatccaggcactgaccttatgacttacacagaaattaactcaaaacggatgagagatctaaatgtcaattgcaaaactgtaagagttctagaagagaacataaaacaaaacctgggtgacctgggggtcggtgatgactttttagatacaataccaaaaacatgatcaatccatgaaagaaaaagctgatgaactggatggacttcattaaaattaaaaacttctttctgtgaaagacactgataaaagaaagaaaaggcaagccacagactcagataaaaatacatgtgaaacaca

SEQ ID NO: 145533 - DNA, 601 bp, Human
aacaaaaaatttctggaaaccaataagcctttatatcaagcaaggttgtagcatacaaggttaatatgcaaagtcaactgctttcctgtgtaccaggaatgaccaattaacacctgaaattaaaaacacagcaccacctatattagtaccaaaaaaaatctctgtataaatctaataaataagatctatatgactacaaaattttgatgaaagaaatcaaagatgacctaaacaagaggtatttcaggttcacataggaaaaaaatactgctcaaatgtcaatttccacaaatggatctayagattcaatagaatcccagtcaaaatcctagttattttgtggatatcaaaaaacggaaagatatggaaaggaaaaagactcagaatagtcaacacaatgctgaagagtaagagtaacatcagaggactgacactacctgtcttcaagacttactataaagctgcagtaatcaggcagtgtggccttgttgagagcaaacacaaatagacaaaatagactggtggcccagaagtagacccatacaaatgcagtcaaatgatctttgacaaaggagcaaaggcaatccaataaagaactgat

SEQ ID NO: 145534 - DNA, 601 bp, Human
atattaatccaactgccaataatcgtatgtgaatggtctaaatacaccaattaaaagaagactgtcagaatgggttaaaaaataacaacccgactctatatagtctacaagaaacctattttatttatttccaatttttattttaggttcagggagtacatgtgcaggtttgttatacgggtaaattgcatgtcacaggggtttggtgtacaggtaattgtcgcccaggtaatcagcatagtatcccactggtagtttttaaatcttcatccttctcctaccccccaccctcaagtaggcmtgggtgtctgttgttgtcttgtgtccatgtgtactcaatgaagacacccattttaaatataaaaacacacagataaattaaaagcaaagggatagagaaagacagaccctgataacactaactgaaagaaagctggagcagctatattaatttcaggcaaagtatgcttcagagtaagtatgtatacacacacatatatacatacatacatatatatatgcacacatatataccaaggataaaaagggacactacataatgataaaagggtcaattatacaaaaagacataacaatctgt

SEQ ID NO: 145535 - DNA, 601 bp, Human
tgtaaacataagtataactgctgttagaaaaagagagacaatggaatcacataaaatgctcaattaaaaccaaagaatgggagaaaaagaaaagactaaggacaacaaaaacagttacagttgatattaatccaactgccaataatcgtatgtgaatggtctaaatacaccaattaaaagaagactgtcagaatgggttaaaaaataacaacccgactctatatagtctacaagaaacctattttatttatttccaatttttattttaggttcagggagtacatgtgcaggtttgttataygggtaaattgcatgtcacaggggtttggtgtacaggtaattgtcgcccaggtaatcagcatagtatcccactggtagtttttaaatcttcatccttctcctaccccccaccctcaagtaggcctgggtgtctgttgttgtcttgtgtccatgtgtactcaatgaagacacccattttaaatataaaaacacacagataaattaaaagcaaagggatagagaaagacagaccctgataacactaactgaaagaaagctggagcagctatattaatttcaggcaaagtatgcttcagagtaa

SEQ ID NO: 145536 - DNA, 601 bp, Human
cacaatgtattcagttattatagcttttagataaataaaattaatgacagtggggagggatgggaggaagaaaatgggaatattgtgttctaaagtactccactattcacaaagcactagagtataattcgatactagattgagattagttgtacatacatattgcaaactacagggcaaccacttaaaaaattgtaaacataagtataactgctgttagaaaaagagagacaatggaatcacataaaatgctcaattaaaaccaaagaatgggagaaaaagaaaagactaaggacaacaraaacagttacagttgatattaatccaactgccaataatcgtatgtgaatggtctaaatacaccaattaaaagaagactgtcagaatgggttaaaaaataacaacccgactctatatagtctacaagaaacctattttatttatttccaatttttattttaggttcagggagtacatgtgcaggtttgttatacgggtaaattgcatgtcacaggggtttggtgtacaggtaattgtcgcccaggtaatcagcatagtatcccactggtagtttttaaatcttcatccttctcctaccccc

SEQ ID NO: 145537 - DNA, 601 bp, Human
aaattttatatactgaatatattaaaattctaccatttcaacatgtaatcaatattaaatgaaatagtttacatttttttttgcactaagtcttagaaatccagtgtgtatttcacacttactcaacatctcaatttgaattaattacatttcaattgctcaatagctcatgtggctaatggctaccaagtaccatactggacagtgaaggactaagtctttaataatcagcactatatttttaatgagtaagacacagtattttttaagtaagtcacctgactgctatcagagctttttycaaagtctcgcagctgtgtattacataatgttttagattactccaaactgttcctagcattccatggaagattcttgtttttggaaatgaacaggttgatgtaaagttatggaataaagagatacaacaacataaaaatcaatctacaatgtagcactaaaataagtcttcctacagatacgtatgtgggtgtacacatgaagccaatttctaatttccagattttctaacagtgaatttctgacagttaaattcaatagttacgactattctatgagcattactttgagctcccttaat

SEQ ID NO: 145538 - DNA, 601 bp, Human
aaatatggtagtggtgagcacctgtaatcccagctacttgggaggctgaggcaggagaatcgcttgaacgtgggtggcggagtttgcagtgagctgaactcgtaccactgcactccagcctgggcaactccattatacataactgctgttagtcgtctggagactctgtctcaaaaaacaaaacaaaacaaacgaacgaacaaaaaaacaaaccattaatgtctgtgcctgtgggtgtgtgtttgctgagagtaagtacatacatgtgtacttcttcaataattcatgtaagacaaaaccyaggaggatttggacaaaaatgttaataagtgttatttctgggtggtaaggtttatagatgatttgcactgtcgtcattattactctgtgaactgcctatgtctacagtatctgttggaaatataatgcaagccaataaccaatttcaattattttgtagccaacttgtaaatcaaaagtgaaattaatttcaataaattttatatactgaatatattaaaattctaccatttcaacatgtaatcaatattaaatgaaatagtttacatttttttttgcactaagtcttagaaatccagtg

SEQ ID NO: 145539 - DNA, 601 bp, Human
tcagaaagatcacattttaaaattcagagcattttacagaatgaaatacaaaaaaataaaaaaactcacatttgtttaacattacctggggactgggcactttcaagaactacaaagaaaacactagactgtcattataaaaggtacagattattggaaaatgcaatttggcaaggcaaaaattaaatttaaaactgagcaaacttatttcttagaaattgtcataaaagaatagatcaagtctggtgaagacagatgaagagcatgtgtgtgtggcctgctatattagggagtaaaaagrtagaaagggaaaacaacaacccaacaactgtccatctctaggaaattgctgattccataaatgtgtccactgataatggtatatatctactgacaagaaacaaggtccaataaaacattaatgtcagccgggcgcagcggctcacacctgtgatcccagcactttgggaggccgaggcaggcagatcacgaggtcaggagttcaagaccagcctgtccaacacagtgaagccccatctctactaaaaatacaaaaaaatatggtagtggtgagcacctgtaatcccagctacttgggagg

SEQ ID NO: 145540 - DNA, 601 bp, Human
acacacacacacacacacacacacacacacacaaacttatacaagaacacaggagccttattcataatagtcaaaaacgggaaactcaaatatccattaacagaagaacagacaaacaaattgtggtaaattcatggtaaacactgaccagttgactaataaaaaaagaatgaacatgtgtacaataacagagatgaatctcaaaaacgtatatactgagtgaagaggacaaaacagacaaaactaagccatcatgacagaaatcagaaagtgattgcaaagggtggacgaagataggagmgaggcaggaattagaaaggaaccaactggttagactcccaatggaactttttgaggtattacaaacattctaaactttattttgggggtatggtcatactctgtatcatttgtcaaaattcatcaaagttaatatttaagatctgtgtattttattatacataaattataccgtaatttcttaagtgaaaaaaagaatcttaagatgaagcgttaatgcaaaccaccaaaaacactaacgacttcttatgtttgacgcacttcatttcatggtagctagataaattggaaagaaagctct

SEQ ID NO: 145541 - DNA, 601 bp, Human
aatatgtgtcacacacacacacacacacacacacacacacacacaaacttatacaagaacacaggagccttattcataatagtcaaaaacgggaaactcaaatatccattaacagaagaacagacaaacaaattgtggtaaattcatggtaaacactgaccagttgactaataaaaaaagaatgaacatgtgtacaataacagagatgaatctcaaaaacgtatatactgagtgaagaggacaaaacagacaaaactaagccatcatgacagaaatcagaaagtgattgcaaagggtggaygaagataggagagaggcaggaattagaaaggaaccaactggttagactcccaatggaactttttgaggtattacaaacattctaaactttattttgggggtatggtcatactctgtatcatttgtcaaaattcatcaaagttaatatttaagatctgtgtattttattatacataaattataccgtaatttcttaagtgaaaaaaagaatcttaagatgaagcgttaatgcaaaccaccaaaaacactaacgacttcttatgtttgacgcacttcatttcatggtagctagataaattgg

SEQ ID NO: 145542 - DNA, 601 bp, Human
agaataccattagtcatcaaggaaatataatgaaaagccacactgagatgccatttcatatccaccaaaatgaccaaaaacaaaaggactgaccacataaaatactggagatgtggagcaatgggaagtctcatacatagctggtggaagtgcaaagattgcacaaccacttggagaactatctgaaagtttcttataaaaataaacatacatctttccagtgacaatgtaattcctgagctatttgcccaaaagaaataaaaatatgtgtcacacacacacacacacacacacacacacacacacaaacttatacaagaacacaggagccttattcataatagtcaaaaacgggaaactcaaatatccattaacagaagaacagacaaacaaattgtggtaaattcatggtaaacactgaccagttgactaataaaaaaagaatgaacatgtgtacaataacagagatgaatctcaaaaacgtatatactgagtgaagaggacaaaacagacaaaactaagccatcatgacagaaatcagaaagtgattgcaaagggtggacgaagataggagagaggcaggaattagaaaggaaccaac

SEQ ID NO: 145543 - DNA, 601 bp, Human
aaaacacatgtaattttacacagaatttatgcctctgaaacctatttctattttaatttacattaggttatatttaaaaaaaaacaatttcttgaaatatgtttttttcctcattagaatcccaaataaaaatattaatataacaactgtctagaactgatacttgtatcaggcagagtgctaagaactttacttgtattttcttatttaatatcaatcctagaaggaactaagttcatacatgaggaaattaaaattgagctagatttagtaacttgcccgttgtcacagaggtagaaaytcaaagaacagggttataaatttagatctgctttactgcagaccccatgctgtgaaccatgtgtctcagtgcagaaaacatttaaattaaatgtcccactggcttctggaagggggaggtgggatttcaattccttccctaaactaaaaatttttattcaacactaagtctgtaagaatccctaacagttaattttggtcacaagaaaagaagataaacagatcagtgttttaagcaaacataagttcactgttaaatattacctagagatctaaagcatattttttaaaggtcttgcaa

SEQ ID NO: 145544 - DNA, 601 bp, Human
tggtgttctatcttttacacattattgtggtacacaaactgtatgtaaatttaatgttctattaaattactcaataaatattaagtatgctcatcactactgtgctatgaaaatacggaacagacttttaaactcaagatgctaataatctgttttttttaaaaaaggagggatataatttgaaaactgtaaagctatgtatgcaaagataaaaattaaaacacatgtaattttacacagaatttatgcctctgaaacctatttctattttaatttacattaggttatatttaaaaaaaaacaatttcttgaaatatgtttttttcctcattagaatcccaaataaaaatattaatataacaactgtctagaactgatacttgtatcaggcagagtgctaagaactttacttgtattttcttatttaatatcaatcctagaaggaactaagttcatacatgaggaaattaaaattgagctagatttagtaacttgcccgttgtcacagaggtagaaactcaaagaacagggttataaatttagatctgctttactgcagaccccatgctgtgaaccatgtgtctcagtgcagaaaacattt

SEQ ID NO: 145545 - DNA, 601 bp, Human
ttcaaatgtcacacttgatcaagttttttcaatttcctcaagcaaatatttctccctttctgtattctcataatatttcatttatacatccaataaagcacttattgaatgacttataagttcccatgtagggtttgcttcaccaaaacactgttcaccctctaaagacaagggccacatgctcttgaactgttattacctttagcctccaacacagtattttatatgcgttttgcatttattcatttgccggattgaactgagaggggtgcctttcttagaatcgtattgattactgctrtgctatcaaaattgtcttaaacaatttttcagaacattacaaactgctaatctgtggtattgaaattatttttagaagaatgatgacacttttcttcttggcacttcataactaatcataaacatttatatgacatggtgaaaaacctcagttaatgcatcccccttcatactgttttaaatgccacaacaatttgcttctacaacagcttccccaatagaaggaagtggtgagagtttgggggcaaaaaaaagcataccaaagtcaacatacatttttaaaaagaatgtacttttccca

SEQ ID NO: 145546 - DNA, 601 bp, Human
ctgttcctgaaacttccttgttcaattctgctttggattccatgggatcctctggtagccaaaaaattcctttttggttgagccagccagaattagttcattttatttgtacaaaagaagcttagctaacaatacacttctaaaagattgtgtatattctcatatctctgaaatcttaatgaaattcaatgagaaatgacacactttttcattatatgtatatgctgttatatacaagtatataagcgagatctcaaatttataccttgctttggcctgaagtattgtaatagctcccccytcccaagaggagacactgcctctactttattctttcgtaagtgcttgccagttatcttttaggacacagatcaatatttgaaaacgtaacaggttcctatttgataaaaataaagtccaaactcttcttcaagaattcaagctatttcttagtctggggcaatcaacactttgacactatcttgttatgaacccaatatatatcagagatagcagccaattaatctgcagacccccaaacatatcatacttctcagcttatagtgttcactctgctgaaacataatgttgaaaacttttc

SEQ ID NO: 145547 - DNA, 601 bp, Human
tttagaaaaataattgtaggctggccatggtggctcacgcctgtaatcctagcacattgggaggctgaggcaggtagatcacttgaggccaggagttcaacaccagcgtggccaacatggcgaaaccccacgcctctattaaaaatacaaaaatcagccaggcgtggtggtgtgtgactgcaatcccagaggtatgagaattgcttgaacctgggaggcagaggttgcagtgagccaagatcgccactgcactccagcctgggtgacagagggagactctgtctcaaaaaataacaacaamaataataataattataacaaagtataagtaccaaaatgaaagcaagaataaaaatgttctgggaaggctaagaagggagccctgaatgctaactggacacaagtgagggcaaagaatcaggaatgtcccagggaagaatagtgttatgactgaaagcacagactctgggaatagattccaccacttattagcaatgtggttttaagcaattactgaactaccctatccctgttttcccatctataaaatgggactaactttatttagttaatacatgtaaagttccttattatagggtta

SEQ ID NO: 145548 - DNA, 601 bp, Human
cagcatgtccaacatgatgaaaccctgtcgctactaaaaacacaaaatttggtcaggcgtggtggcgggcgcctgtagtcccagtcccagctactcaggaggctgaggcaagagaaatgcttgaacccaggagacagaggctgcagtgagctgcgattgagatttaataaatgttctctattttttagaatgtataaattaattgggaatgatttcactttgagtccacacagatcttttacactgttactgtcctctctaggtaagctccaaagctgggtggctttgggggtgggggcargggcaggcgggagggtactgttagtttctggactcatcttgcttttgctctctggagctgtactgtttaataaggtcaccactagccacaatggctattcaaatatgttaaaaatgttgtctctcaaagtcacacctgctacatttcaagtgcgcaataatcacagatgtctaccatattggacagcatcataaaaagttctattggacaataatgctctggaaagtcctagggataatctcatgcaaataatttattagaacaagatatggaatttataaggtcaacagaaggtcaaag

SEQ ID NO: 145549 - DNA, 601 bp, Human
caacaaaaaaccccaccaaagaatccaagaacctttctcaagttttgtttttaagatttacattttattcacaatttaagagacttaaggctgggtgtggtggctcacatctgtaatttcagcactttgggaggccaaggagagtggatcacctgaggaccagcatgtccaacatgatgaaaccctgtcgctactaaaaacacaaaatttggtcaggcgtggtggcgggcgcctgtagtcccagtcccagctactcaggaggctgaggcaagagaaatgcttgaacccaggagacagaggytgcagtgagctgcgattgagatttaataaatgttctctattttttagaatgtataaattaattgggaatgatttcactttgagtccacacagatcttttacactgttactgtcctctctaggtaagctccaaagctgggtggctttgggggtgggggcaggggcaggcgggagggtactgttagtttctggactcatcttgcttttgctctctggagctgtactgtttaataaggtcaccactagccacaatggctattcaaatatgttaaaaatgttgtctctcaaagtcacacctgct

SEQ ID NO: 145550 - DNA, 601 bp, Human
aagggctttgtaacaagtaacagtttaaattcaacatacaacctaaggacttaaagtacaacatttgagactctcatgtacattacacacaagagctagatagcatccaccccaaaaaacaaacaaacgaacaacaacaacaaaaaaccccaccaaagaatccaagaacctttctcaagttttgtttttaagatttacattttattcacaatttaagagacttaaggctgggtgtggtggctcacatctgtaatttcagcactttgggaggccaaggagagtggatcacctgaggaccagyatgtccaacatgatgaaaccctgtcgctactaaaaacacaaaatttggtcaggcgtggtggcgggcgcctgtagtcccagtcccagctactcaggaggctgaggcaagagaaatgcttgaacccaggagacagaggctgcagtgagctgcgattgagatttaataaatgttctctattttttagaatgtataaattaattgggaatgatttcactttgagtccacacagatcttttacactgttactgtcctctctaggtaagctccaaagctgggtggctttgggggtgggggcagggg

SEQ ID NO: 145551 - DNA, 601 bp, Human
cacaaaatatatggttacccccaaacctgtttcccaacaaccagtttatcatataagaattaaaatcagttcagtaacgtgtttgatctatttaactaaaccagggtaaaggggtaacacactttacaatgacttctatcaaaaccattatttaaatcattaattcaaatcttcagaatcttaaaattatccaaaattactcgaatattttggtcatcaagaaaaatacacactcattaaataaagcacagttcagctatacaaataggataccatacagctgcaaaaaaaaaaaaaaaaagttgttattcaagtaatgataagatgaacaagatacactgttatctgaataaaaggcaagatgtaaaagtaagggtagcatatactaacgtctgtacacaataccacaaacaagaataaataacttacatttgcctatgtatgcacagaaccttctgaagaacagacaaaactagtaacagttgtttaaaggttctgtgtgtggacaggtattttgttggagaagaaatgactaggcaaatgaaggactggataaatgagaaacatcactttcttttcacactgtgggattttttttttt

SEQ ID NO: 145552 - DNA, 601 bp, Human
tggagccccaagtcctgataacaaggggaaaaaaaagagagggagggagagtgcaactgcaggatggagggagagagaggtaaagagagagggagagagaaagagggaggcaggaaggaagggggagagaaagagagatttttgttttttaactttgctactactcttctgtgggaacagtttgggatgagagggtgaaaagtagttactgcagttgctggtgggatgtgggtattcctgaatgctagagccaaatagcacttaataccacttcaccatatattttatcaagcatataatmcaatcccctcattttataggtgagctcaatttatttgccagaggtcacatattatacagctttggatgaatttcccaatcagctgctaattctatactcaacatacactacataatcagtgattcatcccaatcctaatttgtcatatttttgccctatgccagctaaatgatcctccaagaaggatatatccttaatatagttttatttctctaacgcccccttttggtttgttttttaccttaattttggggcagggaaaatggcagggagggagagtttgtggtagtggttgtagaa

SEQ ID NO: 145553 - DNA, 601 bp, Human
taactgtaacctccgcctcccaggttcaagcaattctcccacctcagcctcccaagaagctgggattacagaaacccaccatcatgcccagctaatttttgtatttttgtagagatggggtttcagcatgttggccaggctggtcttgaactcctgacgatctgcttgaatctgcttgacgattgcttgaactcaggcgatctgcttgcctcaccctcccaaagtgctgggattacaggcgtgagccactgtgcccggcccaaagtttaacattactagtggagccccaagtcctgataasaaggggaaaaaaaagagagggagggagagtgcaactgcaggatggagggagagagaggtaaagagagagggagagagaaagagggaggcaggaaggaagggggagagaaagagagatttttgttttttaactttgctactactcttctgtgggaacagtttgggatgagagggtgaaaagtagttactgcagttgctggtgggatgtgggtattcctgaatgctagagccaaatagcacttaataccacttcaccatatattttatcaagcatataatccaatcccctcattttataggt

SEQ ID NO: 145554 - DNA, 601 bp, Human
gctaactgtaacctccgcctcccaggttcaagcaattctcccacctcagcctcccaagaagctgggattacagaaacccaccatcatgcccagctaatttttgtatttttgtagagatggggtttcagcatgttggccaggctggtcttgaactcctgacgatctgcttgaatctgcttgacgattgcttgaactcaggcgatctgcttgcctcaccctcccaaagtgctgggattacaggcgtgagccactgtgcccggcccaaagtttaacattactagtggagccccaagtcctgatracaaggggaaaaaaaagagagggagggagagtgcaactgcaggatggagggagagagaggtaaagagagagggagagagaaagagggaggcaggaaggaagggggagagaaagagagatttttgttttttaactttgctactactcttctgtgggaacagtttgggatgagagggtgaaaagtagttactgcagttgctggtgggatgtgggtattcctgaatgctagagccaaatagcacttaataccacttcaccatatattttatcaagcatataatccaatcccctcattttatag

SEQ ID NO: 145555 - DNA, 601 bp, Human
aataaagttggaaagggggtaccctaggagtcccagctcaccaatcagtttatttttatttttatttatttatttagatggaggctcgctctctcacccagggtggaggagtgcaatggcacgatcttggctaactgtaacctccgcctcccaggttcaagcaattctcccacctcagcctcccaagaagctgggattacagaaacccaccatcatgcccagctaatttttgtatttttgtagagatggggtttcagcatgttggccaggctggtcttgaactcctgacgatctgcttgamtctgcttgacgattgcttgaactcaggcgatctgcttgcctcaccctcccaaagtgctgggattacaggcgtgagccactgtgcccggcccaaagtttaacattactagtggagccccaagtcctgataacaaggggaaaaaaaagagagggagggagagtgcaactgcaggatggagggagagagaggtaaagagagagggagagagaaagagggaggcaggaaggaagggggagagaaagagagatttttgttttttaactttgctactactcttctgtgggaacagtttgggatgag

SEQ ID NO: 145556 - DNA, 601 bp, Human
tacacagcaggcttaggtcattcacaaccacacaccaatcttatatactgcctatgatttaaattcatacatctagaaaactgcaaagtattatgtggcacagacctttagcattaccagtaaacaatcaaaattagatgttaaaactaaaaatggcaagtcttactgtattctcaactttctactaccagaaggataatcatatacagataaaggtgagaggaatactgatctcattatagactgggttatatttgcaaatgggtgaggacactgtgttaaaagggcagctcataggtgyggctggttctcttctgccctaccctgtaacttaagtggatctacttaaaaggagtttttcctctctcttctgtctccttttccttctgtttcttgcaaattcagttggattatggtaaaacctgaaatttgggtctggattttcagggaataaagttggaaagggggtaccctaggagtcccagctcaccaatcagtttatttttatttttatttatttatttagatggaggctcgctctctcacccagggtggaggagtgcaatggcacgatcttggctaactgtaacctccgcctccc

SEQ ID NO: 145557 - DNA, 601 bp, Human
atgaaggaggaaaaccacaaaagcataaaataacaaacagaatctcaacagtgaagaaaaacggagccagatagaaacagctgctatcttagggaccaaacacagagagtcttttagatcttagctgctttttaagaaaatttctctgccagacatatttgttcaccaaatgtttatgaagaacctactatgtacaagggactgggataactgggggtgaggacaagaatgaaaatgagggcaaatacaaaaatgaattagacaaggtcctcataaaacatctagttaataaaggggagaytggcattaataactattaaaatgctactaggaaaaattagtatgcaagaaaaatgtaaaacctaactagtgtaggaaggcttccctgaggtgacatcttacctgaagaatgaaaaagggtgagtcaagtgaacaaagcgctggtgaggagtaagtatggaggaaatggcattctaagtagactcatcaaaaagaccctaccataggaaagtttggtgaactgtgtggagtaggaaataagaaagagaagagtggcatggattgaagacacagatttaatgttaaagtaatacaaaacaca

SEQ ID NO: 145558 - DNA, 601 bp, Human
gaaatcataaatttaaaaaagaaaaacaatgtatctggcagggaacaacaactcctgagagtggtgagtatcagtaagaactatccaggaaaagaaaacacaaaaattcactttggagacaagggatcttatcacctggtaatttctacaatgagaaataaccagaaaagaaaagagaaaacaaacaaaaacagtacacgttttaaaaagaatatggcaatgacaaaagactccacaagaaataaatttctaaaaaagcaaacctggaggaatgaaggaggaaaaccacaaaagcataaartaacaaacagaatctcaacagtgaagaaaaacggagccagatagaaacagctgctatcttagggaccaaacacagagagtcttttagatcttagctgctttttaagaaaatttctctgccagacatatttgttcaccaaatgtttatgaagaacctactatgtacaagggactgggataactgggggtgaggacaagaatgaaaatgagggcaaatacaaaaatgaattagacaaggtcctcataaaacatctagttaataaaggggagattggcattaataactattaaaatgctacta

SEQ ID NO: 145559 - DNA, 601 bp, Human
tgttacacaggctggtctcaaactcctgacctcaagtgatcctcctaccttggcctcctaaagtgtagggattacagatgcgagccactgtgcctggccaaatatatattttcaataaatatccaaaatacactaaatgtggggggaaatcatatgacttaacaaaataaagtcttttctatgatcatgttggcctagattaacagtcaaatactccaacttttatatgtacgcatgtatctgaatgttgcatttggcctcaaatgtctgaaaactaacatgagaaaatccattctaagtsttctcattatataaaagctaagatttaaatacattcctagatgctctgatgatatatttacatgaaatgacctattattactctgaatatacagttggcccttgaacaatatgggtttgaactgtgtgggtccacttacatgcagatcttcttcactaaatacagtcaggactccatatcgcagggttctgcatccgcaaccaaacgtggattgaaaaatacagttattagcaggatgagatacccacaaaacaggagggcagacttttcacatgggtgggttctaaaggacctcagtat

SEQ ID NO: 145560 - DNA, 601 bp, Human
cagtctaactatgttacacaggctggtctcaaactcctgacctcaagtgatcctcctaccttggcctcctaaagtgtagggattacagatgcgagccactgtgcctggccaaatatatattttcaataaatatccaaaatacactaaatgtggggggaaatcatatgacttaacaaaataaagtcttttctatgatcatgttggcctagattaacagtcaaatactccaacttttatatgtacgcatgtatctgaatgttgcatttggcctcaaatgtctgaaaactaacatgagaaaatycattctaagtgttctcattatataaaagctaagatttaaatacattcctagatgctctgatgatatatttacatgaaatgacctattattactctgaatatacagttggcccttgaacaatatgggtttgaactgtgtgggtccacttacatgcagatcttcttcactaaatacagtcaggactccatatcgcagggttctgcatccgcaaccaaacgtggattgaaaaatacagttattagcaggatgagatacccacaaaacaggagggcagacttttcacatgggtgggttctaaag

SEQ ID NO: 145561 - DNA, 601 bp, Human
tttaatactgaataactgaatatttaataataactaaaattattttaatctaacaaatatacaatgttaaagaaaatatttaaacatattttctctttttatttttgagacaaggtcttgctctgtcacccaggcaggagtgcaatggtgagtgagatcgctcaccacagcatcaagcccctaggttcaagtgatcctcctacctcactcagccttctgagtagctgggactaccagcacacaccactatgacgggctaattttctaattttttgtagagatgcagtctaactatgttacrcaggctggtctcaaactcctgacctcaagtgatcctcctaccttggcctcctaaagtgtagggattacagatgcgagccactgtgcctggccaaatatatattttcaataaatatccaaaatacactaaatgtggggggaaatcatatgacttaacaaaataaagtcttttctatgatcatgttggcctagattaacagtcaaatactccaacttttatatgtacgcatgtatctgaatgttgcatttggcctcaaatgtctgaaaactaacatgagaaaatccattctaagtgttctca

SEQ ID NO: 145562 - DNA, 601 bp, Human
ttaaaaactacatgttctgattttgataatgatactacaataataacagaatgactctgattttaggatatatagcctgaaatattataaagaggcattatgtctgcaacttattctcatgttattcagaaaaaaataacatgcatgtatacatatatatagagaaaaaaacatggtaaatgtaataaacatttggcaaatctggatgaaggatatatagaagttctttgtactgtatctttaagtatgaaattatttctaactttaacaagcacgaatgattcattaaaatgtatgaccyttagctctctttcacaaccacagcaatcttgagaaggtggtcctctccccagagccattactacctctatatatgttagccactgctgcaatggcccaaaactaagaaaactcccacttcctcctattccctctatatgtgtaccaactttcttaaaagttctatcctgcataagacttaaaccacaaacattcagcacttctactgtttaaattcctttcacattttcagaacaaccacattatgtaacaggtcagaataagaattttagatcaggaaaataggtatttctttgactac

SEQ ID NO: 145563 - DNA, 601 bp, Human
agtagtagcattagtaatggctgacttgtataaagcagttaagcacttatctagataaggattgagacaaacttgaaagcagtattaccaccctggaaggcagattatagtatctcctttctaaagtgagtttaagattgtaagtgatttgcacaagtggccacgcagttttaatgctatactgaggatatgaaaaagatttgagtgactattgtctcaattttaccaaggatagtccctaaatagaaccctttcagatgtataggagggaagctaactcgttacatgcaatggacacttyagggcattaggattttccagtacaccatgttgcccccttcctcaagactatatcatgaaaaggtgtaaactaattttattctaaattaagtttactttataacctagaatgtaactattcaaccttaagtttctatgaaagtgatacacacttacactgataaagcacttacaaatcctctgaaagccataattatgttttctgataaagtaatttcacttctaaactagaaattaagaaaatcatttagaatataatacttcatattttaatataaatataaaaataaaatatttcata

SEQ ID NO: 145564 - DNA, 601 bp, Human
ggggtaatttgcccaataccacacagctaaatggcagagctgaaattccaaatccaggcaatttgtgacttcaaatctagcattcttactccccctattacactgtttcccaataaagtgaacacttaagcaatgaagtagtagcattagtaatggctgacttgtataaagcagttaagcacttatctagataaggattgagacaaacttgaaagcagtattaccaccctggaaggcagattatagtatctcctttctaaagtgagtttaagattgtaagtgatttgcacaagtggccacrcagttttaatgctatactgaggatatgaaaaagatttgagtgactattgtctcaattttaccaaggatagtccctaaatagaaccctttcagatgtataggagggaagctaactcgttacatgcaatggacacttcagggcattaggattttccagtacaccatgttgcccccttcctcaagactatatcatgaaaaggtgtaaactaattttattctaaattaagtttactttataacctagaatgtaactattcaaccttaagtttctatgaaagtgatacacacttacactgataaa

SEQ ID NO: 145565 - DNA, 601 bp, Human
taattaaaatctcattgcacttattgccacatataaatattaatcatggaggcttacttacagaaaggttttttaaaaaaataatggagacttcatcttagcaaaatatttttatgacaactgtaagaaatgaatacctaacaaggtattcaatctataacaatgtgatttatgattggaagggagggatataaagctatgaaaatctgaatatatctatcatgagaaacaatataaggaaaaatgagtagcaaacagatttttatagatattgaaatgttttaaacctgggctaaataayagtacatactgagctaaaatattattttgttgttacctgaacagactatctacgctattctataatgaaccaggtggaataaaagagtttcattaaaaaaatacagagtgtaaagaaagcccaagaaccaacaggcataatttaaaaaaaaaaaaagccttaatgcgtggtagcaggagaaagataaaataggaaactattcacattctggcttcagacatgttcccatttggtcatgatttccgtatgcaatatctaaaaaccaagcttcactcttctaatattagtttatgtataaat

SEQ ID NO: 145566 - DNA, 601 bp, Human
aaaccaagatggttatctgattttacaaataaagctgagaccagaggtgtaaaaatctcttcactgttatctatcaggtcatattagcgcccaagagtttaaaggcagttttagttttttgtaattaaaatctcattgcacttattgccacatataaatattaatcatggaggcttacttacagaaaggttttttaaaaaaataatggagacttcatcttagcaaaatatttttatgacaactgtaagaaatgaatacctaacaaggtattcaatctataacaatgtgatttatgattggragggagggatataaagctatgaaaatctgaatatatctatcatgagaaacaatataaggaaaaatgagtagcaaacagatttttatagatattgaaatgttttaaacctgggctaaataatagtacatactgagctaaaatattattttgttgttacctgaacagactatctacgctattctataatgaaccaggtggaataaaagagtttcattaaaaaaatacagagtgtaaagaaagcccaagaaccaacaggcataatttaaaaaaaaaaaaagccttaatgcgtggtagcaggag

SEQ ID NO: 145567 - DNA, 601 bp, Human
acagcagaacccatctctataagaaaatacaaaaattagccaggtgtggtggcatgcacctgtagtcacagctactcagaaggctgaggtgggaagattgcttgggccaaggagatcaaggttgcagtaagctgtgcactccaggctgggtgacagagcaagagcaagaccctgtctcaaaacaacaacaacaacaacaaaagaagcactaatttaccaaataccataactgagatctcatttaatctcagtgaaatacctcataacaaaccaagatggttatctgattttacaaataaakctgagaccagaggtgtaaaaatctcttcactgttatctatcaggtcatattagcgcccaagagtttaaaggcagttttagttttttgtaattaaaatctcattgcacttattgccacatataaatattaatcatggaggcttacttacagaaaggttttttaaaaaaataatggagacttcatcttagcaaaatatttttatgacaactgtaagaaatgaatacctaacaaggtattcaatctataacaatgtgatttatgattggaagggagggatataaagctatgaaaatctgaata

SEQ ID NO: 145568 - DNA, 601 bp, Human
ggatcacttgagtccaggagtttgaatccaggctgggcaaaacagcagaacccatctctataagaaaatacaaaaattagccaggtgtggtggcatgcacctgtagtcacagctactcagaaggctgaggtgggaagattgcttgggccaaggagatcaaggttgcagtaagctgtgcactccaggctgggtgacagagcaagagcaagaccctgtctcaaaacaacaacaacaacaacaaaagaagcactaatttaccaaataccataactgagatctcatttaatctcagtgaaatacytcataacaaaccaagatggttatctgattttacaaataaagctgagaccagaggtgtaaaaatctcttcactgttatctatcaggtcatattagcgcccaagagtttaaaggcagttttagttttttgtaattaaaatctcattgcacttattgccacatataaatattaatcatggaggcttacttacagaaaggttttttaaaaaaataatggagacttcatcttagcaaaatatttttatgacaactgtaagaaatgaatacctaacaaggtattcaatctataacaatgtgattta

SEQ ID NO: 145569 - DNA, 601 bp, Human
catcttcaaattcttaacttttgcagagtacctttctaattatatactagtataagtagtattaatcatgatgcagaaagagactgataattaaaatgtatcaaggttaaactatggataagagtgccatgatggctgccatatctattgccatagtataaaaaatatgtttaatcttaataccaaaggtgacgaattatgagtgtccagcaattggaaataagtggttagagaaagatagtcattgccctattcagaaatgcaaggttctacctagaccacaatttaaaaatatgtaaartacactgttcacacattataaccactgcaatggaatccctttcttcttagtggagtagtaagtgtatgccatttctaaatagtgcttctcaatggttatgagaaatatgtcaaagcacttgggggtttctttcaaactacgtatgtgttccccaccccccagaatcactgccatagttagccactgctagtgattactagtaagccactgctagtgacagaagcatgtcatatctctcagctgtcttggaagcagacattaagatgcactaatttagcccgggactggtggctcaggcct

SEQ ID NO: 145570 - DNA, 601 bp, Human
tgtttatattaaaaataacttttaatgcacacatgtaacatatttataatatataaatagtgtcacataatctaatcagtaatttcttaaaactgcaaacactggataacgtatctttcataaaacctacatatcaagtcagtttaattcagctaagatataatctcactagccaaccatttccaaattcagctacttggtcaaatacataataaccagaataattactaggtcatcaatgttacatagaaggaataggatacttttgtacatgaactgattaccaaagcacagttccacyagcaatatttagacaatgtactatcaaacactgcaggaatactttatgttcttttcctcaattttatagatgtgggagggtcaaatataccttccttgtactgctaattaaccatcttcaaattcttaacttttgcagagtacctttctaattatatactagtataagtagtattaatcatgatgcagaaagagactgataattaaaatgtatcaaggttaaactatggataagagtgccatgatggctgccatatctattgccatagtataaaaaatatgtttaatcttaataccaaag

SEQ ID NO: 145571 - DNA, 601 bp, Human
aaagatggcaataaagaaaaatatgacttacatctccagcaaaggtatgaaaatatcctctaggactattatatacaaagttattgtatagctcttgttcccacaatagtttcccatcctagaaaaaagttaaaaattaaaataagaactaccaaaacataatctctaggaataaaacaaagaagatgactcatattaagaaaactgtttatattaaaaataacttttaatgcacacatgtaacatatttataatatataaatagtgtcacataatctaatcagtaatttcttaaaactgmaaacactggataacgtatctttcataaaacctacatatcaagtcagtttaattcagctaagatataatctcactagccaaccatttccaaattcagctacttggtcaaatacataataaccagaataattactaggtcatcaatgttacatagaaggaataggatacttttgtacatgaactgattaccaaagcacagttccaccagcaatatttagacaatgtactatcaaacactgcaggaatactttatgttcttttcctcaattttatagatgtgggagggtcaaatataccttcc

SEQ ID NO: 145572 - DNA, 601 bp, Human
agcacatgttctttcttctgaaactcatctgcttaagatgattttggagaggttcccctttcctagtcacccttctccactttacaagagaaacacctggttcactgttgtcaagtaatagttctactccaattaacttaaagctttatactatcctgcattgttctataattgttttatatgtgttagagttgtttcacacactaaactaagttccttatgggttttatagtatatagcattaggaacaaaatagaaagacaaggcaatgtttacagatcttgttagcaactctgcttayttgcttctaagcttacctaaagtctttgtttacaaagtataaaatacttttaaaactttacaaaaaatgctatcacaaatgcaaaattaaaagtcaatatatatgaaattttatcaacaaaaaaggttattgtattgggcccttcggtaaatctaaaaaaaatagttctcaacaaaaatattatttattttaaggtaaggaccaccaaatttttttgtaaatagtaaatatttcagataataattttggctttgaggaccatatatcactgtcatcactatttaactgtgttgtgacaaa

SEQ ID NO: 145573 - DNA, 601 bp, Human
agaagaatattattaaatatatgtaagacaacatcaacataaaaaaattaattcactaaactgtcttattcctaaattgacatacgtgtgactaaggaagatttttcagaagacccgacatttaagtagagatctaaataaaataagtaagggaacaatacattcaaaggccccaaggagggtgcaacatgaaagaacatcatgaagactggactacagtgagcaaatggcacagtgaaaggagacaagaaggaaagtcagggactagatcatgtagggttccacaggccatggttaaggmctatagattttatgtgtatatgataggaagctcttacagaattttaaatagagaaagtgatataacctaatctacaattctaaaagtttactctggctactgtatagaaaagagatagtaaaaaggattgagtagcagcaggaagaccagtcagagagctagtgtggcagcccagctgacagatcatggtggcctggattaggatggtagcagcagaaatggtaagaaatagtcagacaggacatgtttttgaaggcagagtcaataggactctgataggatttatgagggaccatggtg

SEQ ID NO: 145574 - DNA, 601 bp, Human
tttaacaacactattaaaaaaaaaaccctccatttatttaatgaaagaagtctgaaaccactgggccaaatgattaaaactaaagatttaaaaccaatggccaactcatagaaagaaactacatttaattcttttttttttgagacggagtcttgctctttttgcccaggctggagtgcaatggtgtgatctcggctcacttgcaacctccgccttctgggttcaagcaattctcctgcctcagcctcccgagtagctgggattacagacatgcgccaccatgcccagctaatttttgtayttttaatagagacggggtttcgttatgttggccaggctggtcttgaactcctgacctcaggtgatccgcccacctcagcctcccaaagtgctgggattacaggcgagagccaccgcgcccggcctgaaactacatttaattctaagtgggtctcttagtaggggtaataaaattatgaaacaccactgttatataaagaattttcaaattctatctattcatggaaactagatgcctcttcagaaattcattttataaatgttcagccctccatattcacagttccatatccatgcattc

SEQ ID NO: 145575 - DNA, 601 bp, Human
ctaaaagaactcaagtttcccattaattacataagaagcaaagaagcctcaccaaggaaaacagttgaaaaacaggtggcctagaggcctctgatgtcaagcagtcacgaagctgagaacaaatcattggaaagcatatatgctaaaatgtgagactgaccaataaagaaattaggagtgaggaagttactgaactgcattttaggaatgtatgtaaattctacataaagtatctttttaataattaaaatttgaaaaggtgtggtaaactgataatctaaataaggatctgagacaaagyacctgcatagctactggaggacatggtccaggggcccactgccacctagtggtggtgcaccaaatacagtaaagtaataatgctgcctcctaaacagtggtctccacttagtggggaaagcaagatagttgaatgcaaagcagttttaaaatattacaacttgtattaataattatttatttcattctttgtgtattaatatattaattccatattatatgtatattttataagtatacaagtattggcaatacatgctgtataattttgtcctttaacaacactattaaaaaaaaaacc

SEQ ID NO: 145576 - DNA, 601 bp, Human
aagtcaaactacaaggtggataacaccgctaattttacaaatgtcataatacattctttgtttgccaatttttcagttttcttggtctgtggtccaacaagtcattattcaacaaatatttactaacaacttacagaatttagaaaaaaatggatttctatacattcaagaggttaggtactcggttatttctgttgacaatggttatttactttagagtttgaagatgttaggaaataagtttaaaatggtattctagagccaaattaagtatctgtttcaagcgacacactaaaaaaastgataacctgtttaaggtatagagccattttttaaacaacataaagtatatgaaagatttagtaacagatgtacgtactgaagtcatttctagtaaagtttaattattccatttatgaaattacactcctcctaagaactactatgtaaacatataatgaaggcgggctgttttccttcttttttaaaaaacaaatgacaaattaactccttctgattaaggataactgttgcatgaaaaggtttttaaatgttcttgtgaacagacatgtctagttaattttaaatctaaaagaactca

SEQ ID NO: 145577 - DNA, 601 bp, Human
caatggcgccatctcggctcactgcaaccttcacctccgggttcaagtgattctcctgcctcagcctcccaggtggctgggactacaggtgtgtgccactaagcctggctaatttttcatattttagtagagatggggtttcatcgtattagccaggatggtcttgatttcctgacctcgtgatccacctgcctcggcctcccaaagtgttgggattacaggcgtgagccaccgtgcccggccaactattctacctcttatacctcttacacaaaagtcaaactacaaggtggataacacygctaattttacaaatgtcataatacattctttgtttgccaatttttcagttttcttggtctgtggtccaacaagtcattattcaacaaatatttactaacaacttacagaatttagaaaaaaatggatttctatacattcaagaggttaggtactcggttatttctgttgacaatggttatttactttagagtttgaagatgttaggaaataagtttaaaatggtattctagagccaaattaagtatctgtttcaagcgacacactaaaaaaagtgataacctgtttaaggtatagagcc

SEQ ID NO: 145578 - DNA, 601 bp, Human
aaaaaagtttatttacatgggtaaattgtatataccctattttctcccaactctactattaaagataaaacaaaactaaaacaaatttatgaaagccatgtcaccttatcaaaaaagtaaataatttggaaaggcatatttttaatatcaccaaaattcaactcttttcccttaatattcaaatcctatttatatataatattttaataatcctaaagttttagttacaatttcattcaaaaattccataggaagttgttgatatggataagaaatagtttttgggaaaaatgagagctastgaataatatggataaaatcattaaaagcttttttagtgcccaggaataatatgaaaaataactagatcagtaagtaaaggtgagttaagcagtatcgaatgacctgaaagggtgattaggatgtgaattttcaaatttgctcaggtatcagatttcgacatttatgtagttgtacaaaataaaggacttactgagaatatccagaatgtagggactagagggttgaattggggttacactcagaccttcacagacttatctggtggtctacttttacttctcattcttccctttctgcc

SEQ ID NO: 145579 - DNA, 601 bp, Human
ttcttaaaaattcaactaaagggcaacacatgttcctcagagatcctatttttatatatggttctctgacaaatcctcctttgagaccaagttcctctgaggtgactacattaacgaccacttccaaaacatatgaaatactatcatcgttgtgtagaaaagagtttaaggcagcacactttagactgctcttcttagaaaggaccacttgcaaggttggccctcagttgaccacttgggaagttggatttcaagagggttcccactattccctgacaaggtgggcttattgtgtctaaaytgtttgtgctaacaatgcagtttatgttgaacatctactttccttctgggagtctgaaatcttggtaagtgcaaggcagggtagacctatgtaactagccctcaacgaaaaccctgggcaccaagtctcaagcttttcctttagacaacatttcacaagttgtcacaattcattattggaggaattaggtgcaacctctgtgttctccactgggagaactcttggaaacttgtgtgtggttttttttttttatgaacttcatcccatgtgtctttccctttgctgattttgttttatatg

SEQ ID NO: 145580 - DNA, 601 bp, Human
caaaggcatctttccatattattaatagtatcttcagaagtggtactaaatgtagcagaaaacttgtcttacaattcaaaataaaattcttgatcttaaaagtatgaaagtctgaatgtggagcattcaactgaaaaatttcttaaaaattcaactaaagggcaacacatgttcctcagagatcctatttttatatatggttctctgacaaatcctcctttgagaccaagttcctctgaggtgactacattaacgaccacttccaaaacatatgaaatactatcatcgttgtgtagaaaasagtttaaggcagcacactttagactgctcttcttagaaaggaccacttgcaaggttggccctcagttgaccacttgggaagttggatttcaagagggttcccactattccctgacaaggtgggcttattgtgtctaaactgtttgtgctaacaatgcagtttatgttgaacatctactttccttctgggagtctgaaatcttggtaagtgcaaggcagggtagacctatgtaactagccctcaacgaaaaccctgggcaccaagtctcaagcttttcctttagacaacatttcacaagtt

SEQ ID NO: 145581 - DNA, 601 bp, Human
aacggtatccaagtgatgaatgtacacaccctcccgaaaagagaagaaaattttctaacaagttaaaaatcaagaacagcaatgaataaatcaaaagtgaagataagaacaacaaaagaactgtcttactggaaattgcttggtgttcctatatctgccttggttaatctcttctttttagcttttcccttcttcttttctttggtatgggagatgttgttgacttgtggaccataaaatctatttgttgtgatttctggattttttatatcaactgtagccatgggtagattaggacctrcaaataaaaccaaattatataaaagggatataatttaagataactgatatacaatcataatttacaatttaaatactttttctgaaataggatcacttcattataaattatttatattttaaacttctacatttttttcataaagtgctgcctaaatttctaaaacctgttaagttcttgaaatgagtgtagatgcactatttcaaagcaaacttacatttttatgccattaaatttcataaagaatatgaacttccagctagaatttaaatataattagtctaatctcttaaattttga

SEQ ID NO: 145582 - DNA, 601 bp, Human
ctaactaaaatattttattaaaaaaaactgaacagatatattccctattttattcttcttttttgttccctgccttcaaaaagagggcatctcatttagatttctattagcctattcatgattcagacatctccaatgctcatttattctaccttgtcctaagtaagtatgtaaaaatcaggaataaacacaaaaaaagtaaattaatttgaaaatctgagagcaaggatcttcctgtaatcccaagcaccttgcacaatgcccagcacaagaggtgctcagtatgtttgttgagttaacrttgtagctataacaaaaataactaaaaatattttttactccaatcacaaataatatctctttaaaataatgcatccaaacgctgattaatttttgccagcagtttcacagtgctataaaacaacggcaaaactgccaaaaagaacaggagaatgaaaagatctggagaattcaacaactgaatattcagaatttgattatactactttctagtaatttggtatacactcccctgaaattatcacttggcagaaatgattttcttctcttggctttcaaagcacaaggattttatttatac

SEQ ID NO: 145583 - DNA, 601 bp, Human
gcagttcatttttaacagcttcaacacctcctgttttttcaataaagtcatatataacttttgatgtttctctgtctttaagttgtgcctctgagattccacacatatcgaaaagattcttcaattctggatccaaattattcagctacaaaagaaagtaactgctaactataaaaatatatcccaatttaaaaaacataattttaagtctcatctgtgtccttctgaaattattttgcctaaacttttaacatgcttatattacttatgtgctaactaaaatattttattaaaaaaaackgaacagatatattccctattttattcttcttttttgttccctgccttcaaaaagagggcatctcatttagatttctattagcctattcatgattcagacatctccaatgctcatttattctaccttgtcctaagtaagtatgtaaaaatcaggaataaacacaaaaaaagtaaattaatttgaaaatctgagagcaaggatcttcctgtaatcccaagcaccttgcacaatgcccagcacaagaggtgctcagtatgtttgttgagttaacgttgtagctataacaaaaataactaaaaa

SEQ ID NO: 145584 - DNA, 601 bp, Human
tctgctcaaggaagggttcacatgtatgaatgttaactggtttccatgaaactgacctcaaaagattaaaacaaaacagaacgctgaatagagataaaagttaccttgcctccgcagttcatttttaacagcttcaacacctcctgttttttcaataaagtcatatataacttttgatgtttctctgtctttaagttgtgcctctgagattccacacatatcgaaaagattcttcaattctggatccaaattattcagctacaaaagaaagtaactgctaactataaaaatatatcccaayttaaaaaacataattttaagtctcatctgtgtccttctgaaattattttgcctaaacttttaacatgcttatattacttatgtgctaactaaaatattttattaaaaaaaactgaacagatatattccctattttattcttcttttttgttccctgccttcaaaaagagggcatctcatttagatttctattagcctattcatgattcagacatctccaatgctcatttattctaccttgtcctaagtaagtatgtaaaaatcaggaataaacacaaaaaaagtaaattaatttgaaaat

SEQ ID NO: 145585 - DNA, 601 bp, Human
actaaaaccatggaattcaaaaatatatgtgagtattcaatacctcctactagctctttaaagtaagtctatggttttatgttaatcatattcatcacagaataaattgatgatttactcaaaaaatttaaagaaacatagccatagaaatttcaaccacaaaatggtctttttcaaaaaataacgaactcggattacatgtataacatgccaatagttcactgattatgcaccctatgattgcaataaatgcaatcaaaaggaaagtgattatttaggataaaaatggcccccattcttmcacatcaattaacaggttttgctgcttctttttttttttttggaaagaaagggagagttgggatgggagaaagttatggagaaagtaaatagaaatttaactcttaaactttttaaaataaatgaggatacaactttattcgttaaaaattttaaatcaccttattatagctaaatgagagaaagaaacaaagttggtttgtgaaaaggaaatagaaaaggaaaacaaaaaggtgggttaggagtgagagttacgggaatgagaatgacacaggaactagcagagattccaaggtaaaag

SEQ ID NO: 145586 - DNA, 601 bp, Human
atatttagactccagagttgttacgtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaattataattaaagatgaaacagcatagctgtaytaaataattacctatgttttaatacatacatatataatatatatttttgaaattcttaatcatttcccaaagacaattttatttagacaaactttccattttgatctgtacaattcttcctctaatactccttgttctttctggagtaaacaccttttttaaaaaaattcaaagtggttccccctaagatatagattcattccttagtattttggctttaaacattatgtattaactatttccagtatagaagtaccacaaatgaaaaaagataacagagagtttcagagctttgtattt

SEQ ID NO: 145587 - DNA, 601 bp, Human
atttcatgttataaacagaggttaatatttagactccagagttgttacgtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaattataattaaagatgaaacagcatagctgtattaaataattacctatgttttaatacatacatatataatatatatttttgaaattcttaatcatttcccaaagacaattttatttagacaaactttccattttgatctgtacaattcttcctctaatactccttgttctttctggagtaaacaccttttttaaaaaaattcaaagtggttccccctaagatatagattcattccttagtattttggctttaaacattatgtattaactatttccagtatagaagtaccacaaatgaaaaaagataac

SEQ ID NO: 145588 - DNA, 601 bp, Human
ggatttcatgttataaacagaggttaatatttagactccagagttgttacgtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaattataattaaagatgaaacagcatagctgtattaaataattacctatgttttaatacatacatatataatatatatttttgaaattcttaatcatttcccaaagacaattttatttagacaaactttccattttgatctgtacaattcttcctctaatactccttgttctttctggagtaaacaccttttttaaaaaaattcaaagtggttccccctaagatatagattcattccttagtattttggctttaaacattatgtattaactatttccagtatagaagtaccacaaatgaaaaaagata

SEQ ID NO: 145589 - DNA, 601 bp, Human
aagggatttcatgttataaacagaggttaatatttagactccagagttgttacgtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaattataattaaagatgaaacagcatagctgtattaaataattacctatgttttaatacatacatatataatatatatttttgaaattcttaatcatttcccaaagacaattttatttagacaaactttccattttgatctgtacaattcttcctctaatactccttgttctttctggagtaaacaccttttttaaaaaaattcaaagtggttccccctaagatatagattcattccttagtattttggctttaaacattatgtattaactatttccagtatagaagtaccacaaatgaaaaaag

SEQ ID NO: 145590 - DNA, 601 bp, Human
tcaagggatttcatgttataaacagaggttaatatttagactccagagttgttacgtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaawtataattaaagatgaaacagcatagctgtattaaataattacctatgttttaatacatacatatataatatatatttttgaaattcttaatcatttcccaaagacaattttatttagacaaactttccattttgatctgtacaattcttcctctaatactccttgttctttctggagtaaacaccttttttaaaaaaattcaaagtggttccccctaagatatagattcattccttagtattttggctttaaacattatgtattaactatttccagtatagaagtaccacaaatgaaaaa

SEQ ID NO: 145591 - DNA, 601 bp, Human
aagacaaaaaagatatcaaactggcaagcgcaggacaagattaatcaaattaacaagaaataaactgctgccttaaagatattattcaaaaatatttcctttccatcttaatgtataagccaaaaatacatttccaaatctatgtttacattcagataacaaaccctctcctgaataatacttgctgggttacttctgtttattccagcacacacagacttagatgatcaactttaaagcttttatcaagggatttcatgttataaacagaggttaatatttagactccagagttgttacrtgggacgcacactgaagatattgaaaaacaactgtagaaacttatatttgcctacaaaaattcagctttacacctttatgttacatttataccttcaaaatgaacctcttttctcatagtatataatttctttttaaggagatgagttgagcaactttcaaaatgtacctgcctcactaggcaagtaacaatccctaactgaagtacttccagctgtgccaaagtgcattcatgaaaaaaaaaattataattaaagatgaaacagcatagctgtattaaataattacctatgttttaata

SEQ ID NO: 145592 - DNA, 601 bp, Human
tcatttcaaaatgaacctctctctcaacagtctgccccctatttcccttttctgttagacttttgtccttacttcatgtcaccatttaacatactgtatgtttttctagttttctttgtttattgcttgtctctctctctcattagacctaatgcatgtcgatgaaggcagggactttttttttgttaaaattttattattattccacaataaatatttatctctatctctgtaatggagggtaggtacaaatatgcctatttaaggaaaacaaacattgctcaaggatcttaagacatgsacatccttacagagaaacaaaaggaaggtaacatttattaagcacctactatgtgctaggcaatctgcaggttagtgacatactatttaattctcacatctatatgttttgtgagttctctgaatgtaacaaacaagaaactgaggctcacagagattaaataaatctaagaagaaagatctgattctagcacatcatgttggagaagctatttagcaaacctcaactactccaatcagcaaaactcatattcttgttctttctttaaaggaatatttatatggtggtatgtatatgttt

SEQ ID NO: 145593 - DNA, 601 bp, Human
tggttcacttcctgaactgctggtcttttctcaaatgtcacctcagttaggctttattgtcccttatcatcctttatcatttcaaaatgaacctctctctcaacagtctgccccctatttcccttttctgttagacttttgtccttacttcatgtcaccatttaacatactgtatgtttttctagttttctttgtttattgcttgtctctctctctcattagacctaatgcatgtcgatgaaggcagggactttttttttgttaaaattttattattattccacaataaatatttatctcyatctctgtaatggagggtaggtacaaatatgcctatttaaggaaaacaaacattgctcaaggatcttaagacatggacatccttacagagaaacaaaaggaaggtaacatttattaagcacctactatgtgctaggcaatctgcaggttagtgacatactatttaattctcacatctatatgttttgtgagttctctgaatgtaacaaacaagaaactgaggctcacagagattaaataaatctaagaagaaagatctgattctagcacatcatgttggagaagctatttagcaaacctc

SEQ ID NO: 145594 - DNA, 601 bp, Human
tctgttctttccatcggatacactttccctagttttctacatggttcacttcctgaactgctggtcttttctcaaatgtcacctcagttaggctttattgtcccttatcatcctttatcatttcaaaatgaacctctctctcaacagtctgccccctatttcccttttctgttagacttttgtccttacttcatgtcaccatttaacatactgtatgtttttctagttttctttgtttattgcttgtctctctctctcattagacctaatgcatgtcgatgaaggcagggactttttttttgttaaaattttattattattccacaataaatatttatctctatctctgtaatggagggtaggtacaaatatgcctatttaaggaaaacaaacattgctcaaggatcttaagacatggacatccttacagagaaacaaaaggaaggtaacatttattaagcacctactatgtgctaggcaatctgcaggttagtgacatactatttaattctcacatctatatgttttgtgagttctctgaatgtaacaaacaagaaactgaggctcacagagattaaataaatctaagaagaaagatctg

SEQ ID NO: 145595 - DNA, 601 bp, Human
gtaagactaggtgacatacgtgtgggttacatgtacagaacacagaacaatctttttcttctatttttctcatgtaaaattgattgtgtgaaggtagtatttgaagaagtactggagctctagtattagaacttgaaaattaacagaagcccaagagaagcaacattatcttctcttagccctaaactaagttgttacttttaaaacgataattatttattatttatttatttatttatttaagtctcatggtcagctctaaattgttacagaatttatttggaaaggagttcaattgagycatgttaatttctgtttactcttctagcaagggaaataatttgctaccagattttgctagacatgcttcacaaaatttacctggatgaaaagcatcaaagacacctgactatgctggcattacagactgacaaaagacagaaacttatcagtatctatggtgaagaggaagaagtagctaataatttcatcatcaggtactaccacagaaatactaacagttaaaataaatgggtctgaaaataagtaaaaaccatcctatattttcattatattagcgtgactattacatactattaaa

SEQ ID NO: 145596 - DNA, 601 bp, Human
tactctccacaccaccatcacatcctgcttggattattgcaactctagagtctatttgactcagagcaaatggagtgatattatttaaatttcaagtttaaaaaatatgttgctacccttcttaaagtcctcctgtggctaccactgctatttgaatgaaatctgatgctacctccctccataagaccctacatgatttgtccagttattgtctctctctctccccaaacttctctcatatgtactctcccttcaagtcactctctctagtaagatggtctcctttctgtcccttaaactyaccaatcttattctggctttagaacttctgcagtagctatttcttcgttaaactgaatcttttcatcatttagaaaccattcataaactacttcctcagagaggcctttcctgaccatcatatgtaaagtatagctcttccccataatcagtaacggcctatcccattttactttcctcatatcacttgctaatatctaaaattattgtactttatctattaagctccatgacagcacggaccttgcctatcttatttctcactgtatcctcaacaccaaaacagcactacacaccagcc

SEQ ID NO: 145597 - DNA, 601 bp, Human
attattattacttcctcctttttcacgatccaattatcaagcctgctctttttcacctctttcactgctactctccacaccaccatcacatcctgcttggattattgcaactctagagtctatttgactcagagcaaatggagtgatattatttaaatttcaagtttaaaaaatatgttgctacccttcttaaagtcctcctgtggctaccactgctatttgaatgaaatctgatgctacctccctccataagaccctacatgatttgtccagttattgtctctctctctccccaaacttytctcatatgtactctcccttcaagtcactctctctagtaagatggtctcctttctgtcccttaaactcaccaatcttattctggctttagaacttctgcagtagctatttcttcgttaaactgaatcttttcatcatttagaaaccattcataaactacttcctcagagaggcctttcctgaccatcatatgtaaagtatagctcttccccataatcagtaacggcctatcccattttactttcctcatatcacttgctaatatctaaaattattgtactttatctattaagctccatga

SEQ ID NO: 145598 - DNA, 601 bp, Human
ctcaataaatggcatcaccatcctgtcacataatcaggccaaaaacctagaaattattattacttcctcctttttcacgatccaattatcaagcctgctctttttcacctctttcactgctactctccacaccaccatcacatcctgcttggattattgcaactctagagtctatttgactcagagcaaatggagtgatattatttaaatttcaagtttaaaaaatatgttgctacccttcttaaagtcctcctgtggctaccactgctatttgaatgaaatctgatgctacctccctccrtaagaccctacatgatttgtccagttattgtctctctctctccccaaacttctctcatatgtactctcccttcaagtcactctctctagtaagatggtctcctttctgtcccttaaactcaccaatcttattctggctttagaacttctgcagtagctatttcttcgttaaactgaatcttttcatcatttagaaaccattcataaactacttcctcagagaggcctttcctgaccatcatatgtaaagtatagctcttccccataatcagtaacggcctatcccattttactttcctca

SEQ ID NO: 145599 - DNA, 601 bp, Human
aaaaaaggcaacaaaaatatacagcaaattggtagaacatttacatgataattttacagaatccacagacagaaagtagtgtttagtatttcaccttaaaaatatatatatatatataatatatagatcagtcttcccactcatcatcatcctcaaaatcttcttcatcatcttcatcttcatcttcatctacaagaaaatcaagacaattaaaacatatgcataaataaaatgacattacataattcttgggtggtttctccaattatttaactcctgaaacacagataatgtgactcccagaagaatctagttactaaaacagtttaaagtgaatctaaagaaatatatctatagagtatgatagtaaactaaagattaaaacagggcttagaagacaatggttctagttccttaatatctatgtgacaaatttcaacctgttaatgtataaaatcatctgggttgacctttctgtcacaaatccaactaccttcttgtactcttcatatggattctcaaactcaaaacttctaacttttatttccttccccaatcttcttttcctgctccatcctggtctgctgctccatctcaataa

SEQ ID NO: 145600 - DNA, 601 bp, Human
cagtctcacatatagtatttaaactcccttgttgatggaatgaaaaatattcacaaatcaagtgagcatcctggtgtaaacttgcacacaataacagggagtagctttgtagaggattacgacaaacctttacagattaaatgaggtattgcacagattaaaaaaaagcaaaaaaggcaacaaaaatatacagcaaattggtagaacatttacatgataattttacagaatccacagacagaaagtagtgtttagtatttcaccttaaaaatatatatatatatataatatatagatcaggcttcccactcatcatcatcctcaaaatcttcttcatcatcttcatcttcatcttcatctacaagaaaatcaagacaattaaaacatatgcataaataaaatgacattacataattcttgggtggtttctccaattatttaactcctgaaacacagataatgtgactcccagaagaatctagttactaaaacagtttaaagtgaatctaaagaaatatatctatagagtatgatagtaaactaaagattaaaacagggcttagaagacaatggttctagttccttaatatctatgtgacaa

SEQ ID NO: 145601 - DNA, 601 bp, Human
ttaaggtttttgtcagtctcacatatagtatttaaactcccttgttgatggaatgaaaaatattcacaaatcaagtgagcatcctggtgtaaacttgcacacaataacagggagtagctttgtagaggattacgacaaacctttacagattaaatgaggtattgcacagattaaaaaaaagcaaaaaaggcaacaaaaatatacagcaaattggtagaacatttacatgataattttacagaatccacagacagaaagtagtgtttagtatttcaccttaaaaatatatatatatatataatatatagatcagtcttcccactcatcatcatcctcaaaatcttcttcatcatcttcatcttcatcttcatctacaagaaaatcaagacaattaaaacatatgcataaataaaatgacattacataattcttgggtggtttctccaattatttaactcctgaaacacagataatgtgactcccagaagaatctagttactaaaacagtttaaagtgaatctaaagaaatatatctatagagtatgatagtaaactaaagattaaaacagggcttagaagacaatggttctagttccttaat

SEQ ID NO: 145602 - DNA, 601 bp, Human
cattaaggtttttgtcagtctcacatatagtatttaaactcccttgttgatggaatgaaaaatattcacaaatcaagtgagcatcctggtgtaaacttgcacacaataacagggagtagctttgtagaggattacgacaaacctttacagattaaatgaggtattgcacagattaaaaaaaagcaaaaaaggcaacaaaaatatacagcaaattggtagaacatttacatgataattttacagaatccacagacagaaagtagtgtttagtatttcaccttaaaaatatatatatatatataatatatagatcagtcttcccactcatcatcatcctcaaaatcttcttcatcatcttcatcttcatcttcatctacaagaaaatcaagacaattaaaacatatgcataaataaaatgacattacataattcttgggtggtttctccaattatttaactcctgaaacacagataatgtgactcccagaagaatctagttactaaaacagtttaaagtgaatctaaagaaatatatctatagagtatgatagtaaactaaagattaaaacagggcttagaagacaatggttctagttcctta

SEQ ID NO: 145603 - DNA, 601 bp, Human
taatataaagaaataacaaaaaatataagttcagaagaaggtatatggcccttggtaaagtattttatgtgtcagaaaatcattgtaaaatgataattttctttagtaaattcttaatttttattagttgtttccccaaatccataaactcccttctcaaatgtcctattatttaaaaacttataaatatttataaattctccatactattttcttttctttttaaaaaaactgaaagctccactcttactctgaggaggagtgaatcaggcattcctcaatgaataggttgacatgacayactatttaagtgtcatgcttgttttttaatggcactttaagcttagattcaaattctactactatgtctctcaaatcatcttcagtattatccataccagagacagtccttcaacttttatatgattattttctccttaatggcattgtcccaaaattgttccctatagactctgttgtatatatttctgctatctttctcaacttctgatcattttaaataatagatctatcattacttccccttttttctatgccatttgtaatcaatagtcatggattacatgttatgttttctctg

SEQ ID NO: 145604 - DNA, 601 bp, Human
actgggactccaatcagggcaaatgtcctagagaacatactctaacacactttaacagctgtagcattctatcccctgattatgttatgaattacagaggacgagcaagggtaaggaatactaagcctcaattagtcaattattcagtggaatgaagtggcatgtgaaacttataagtcttacaaaaagcagttggaataatcttgttggttaaggtaaaaaagaaattatcttctacttcttgctatctctggttttcattcttctgtaaaaaaattgcttaatacactaaattaattckcatttgaactaacttgtcctttgatattctgactgtcttataataattttacagaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttct

SEQ ID NO: 145605 - DNA, 601 bp, Human
catcctttagaaaatcacttctctgttcttttttcagcttcttcaaattgcaaactgtggtggtttaaaatacgttcataaattctttgacactctttaagatggagcccaactcccttccctttgagagtgagctggatctagtatctcacttctaatgaataaagtgagagtgacaggtgcagctttggggatttggtcctacaaggcactgtagcttctctctgttctctcttttggacaacttgctctggggaaagccagctgccatcatggggacaaacagcctaagacaagggcyatgtggtgaggaactgtggccttctgacaacagccagtgaggaactgaggactttttttgccaacagtcatgtgaatgagctaccttggaagtagatcttccagccccagttaagcctccagataactgtgaccctgctaaactgcaaactcaggaggaaccctgagccagaactacccagcaaagccactcacgggtgattcctgactctcagaaactgtgagatgatacatttctatcatgttaaattgttagaatttggagttgctatgcagtcatagataactaatacacaaacca

SEQ ID NO: 145606 - DNA, 601 bp, Human
atctgcaaatgagctgatcttagagtttaaattagatttttggacacatgtcaaataaacatggactgcatatttttgacatttcataacaccaactttcttttttaaaatgctctttgatgaagaacatcttgtatatcaaagcctaaagtaccaacaagatttgattccagtctctatgtgctggagtgtccaggcggttgaggcaaacttacatggggacagctggagtgaaggctcatgaacccacagttagtcatcctgagaaacacctgttctttctgatgtctccctgaaaacrtcatatatttggagactagattttaatctctagtcttaaaaaaactcaatatggtttaaaaaatatctaagcataatttaatgaaattacatatttttacaaaaataaattaaaattggcttgaataagaaaagtaaccattttcttttttccttttattattaaatattgatcatctacatgttttctctttccaaggtccacctattgaaaaaagagcttcacatctatttgttaatttggattttaaactcaataattagttaaatctttgagtaaaagggtaggtatcatcataat

SEQ ID NO: 145607 - DNA, 601 bp, Human
gaaggcctttatggcgatctacttccatttagtaaacagaaaatacattttctcttccttatgattttcttaataatgttttcttttctctagcttactttatcataagaatatagtatataatacatgtgacatacaaaatacctgctcattagccatttatattattgacaaggcttcccgtcaacagtggatcattgtagttaagtttaagctatctgccgactttcagttgcaggaggggttggcacccctcaactccccgtagctcatcaaagatcagctgtacctcaaaatcacrgaacactttctaggaatgtctgccaactgatagatgctttccagatgaatggtatgcagaacttgtttgtacatttgtgaacagtttctttaactaaaataaatactctccaaagctttccatctttgcacttcaagctgtctcacaggcagaaagtctagcgaggcttatttccaatctgcaaatgagctgatcttagagtttaaattagatttttggacacatgtcaaataaacatggactgcatatttttgacatttcataacaccaactttcttttttaaaatgctctttgatgaa

SEQ ID NO: 145608 - DNA, 601 bp, Human
tgaaagttttaagtcctataggaaagaaattggtttaatctggcttacctggtgcctccaactcttggattgcagctctctgctccacctctctgtaccccaactcctgccctgctcctggcagcatctgttggaacctggattgcatgacccgtactctggaaaatgctgctctatatttttgtagtcaagaaattgctttatttctggaaagtttttttctttttttccctcaactacagctgaatagctcaaagtgcttgtgttgaaaacacaggaaacctgagtttgcaaatgttaytccttggacagacgtccctgtccttttccagactggaactgtccagtagaactttctgcagtgatgaaaatgggctatatctgcactgttcaatacagtagccacttgccatgtatggccactgagtgcttggaatgtggttactgtgattgaggaactgactttttaattatatttacttttaaatagccatatgtggctaaaggctgccatgtcagacacacagccccagacagaggtcagagcacgaccaaaataaatgcacagaaacaatgctctccacacagaaacaatgcaatc

SEQ ID NO: 145609 - DNA, 601 bp, Human
tccctaagtttaacctcaaagaaacactttgcctaaaaaggtgtaaaattctacctaatataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcacttcctctacccaaaggcagccactgttcccggggtgtctttgattctttccagaaaatatcttawatgctcatgtgcatggatccccttttcatgctgtctttacttcattctgtgtattaaaagtgattccgtatcaggacacggattgaccttactcttcataacagagtattgtattccactgtataattatgtcaagaacatacttaactgctataatactatggaaaagtggatcgtttccatatttttatctattacaaaatagtgctggaaaggggaagatcaccattcagaatgctgggggttggggagatgcaagctgcctgtctggtggggggccgccaggtctgccccagctgg

SEQ ID NO: 145610 - DNA, 601 bp, Human
tgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaatataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcactt

SEQ ID NO: 145611 - DNA, 601 bp, Human
tgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaatataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcac

SEQ ID NO: 145612 - DNA, 601 bp, Human
tgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcrtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggta

SEQ ID NO: 145613 - DNA, 601 bp, Human
ggaatctcaggaaatgtgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgkgtgaagagtgagggcgtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagacc

SEQ ID NO: 145614 - DNA, 601 bp, Human
cctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaaccctggggcccactgagatgccaagcggagaaggaggaaaaatggctgcatttcttggaatctcaggaaatgtgatttctacatctgttgcagatccttggagaccagtgcccatgggactggctggtctttacccaagaaaagccctattacckcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacccccaaggg

SEQ ID NO: 145615 - DNA, 601 bp, Human
caggtgtacctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaaccctggggcccactgagatgccaagcggagaaggaggaaaaatggctgcatttcttggaatctcaggaaatgtgatttctacatctgttgcagatccttggagaccagtgcccatgggactggctggtctttacccaagaaaagccytattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacc

SEQ ID NO: 145616 - DNA, 601 bp, Human
cttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacaggaagagtgaacacagacttcctccaaattacagccctgccagtttagcactaataccttgagaggaattgggaaaaaatcgcttggcatcaaattcccagactgtccctgaactctggtcaataaccaacacrgctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctggttcaagaatgggcaaacagacaggcaagggttatacatttgacctgggcct

SEQ ID NO: 145617 - DNA, 601 bp, Human
tcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacaggaagagtgaacacagacttcctccaaattacagccctgccagtttagcactaataccttgagaggaattgggaaaaaatcrcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctg

SEQ ID NO: 145618 - DNA, 601 bp, Human
ctcagcctccggagtagctgggactacaggcacccgccaccatgctcggctaattttttgtgtttttagtagagacggggtttcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacrggaagagtgaacacagacttcctccaaattacagccctgccagtttagcactaataccttgagaggaattgggaaaaaatcgcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgac

SEQ ID NO: 145619 - DNA, 601 bp, Human
agtccttagtaaatgaattcctttggtcattattaagagaaataaatgcctgtgtgcccattaagagattttgattggagaaacagaaagccccaatttaactggcttaaatagaaaggaaatgtatcatatcccatgacaggcagtccaaccatggagtggcttcagagctgatgaactcagtagggcaatgaactctagaagggcctggatcttctgaaacctgatcactagtaagggtcaagggattagcaagactggtttagactactcagaactcactactgacccggaaaatgasgtcatttcccaaactggtccacacttgaaaaaaaaaaaaaatctgttctgttagcaagagaaagggggagatggccgtcaggagggaaaccgacattttagtgtacagtctgtctgctgtgcacacagagattctaaccatgacctgatagaaacttacccctgccagctgccagccaggtgctgggggtcatgctctatcagcaagcagttctgtttgtacagggaaggtgcatagcctatagagtcggtttcatgctggctattttattcacattctgaggtagtttgtgtccctgca

SEQ ID NO: 145620 - DNA, 601 bp, Human
actcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggartacgagtacgatgttgtgtgctacttccagatttgacctttaaagagactgggaatgtcctcttctctttcccctttgtttctggttgaaaagtggacctggggctgagccaccttgcaccatgtagatgagggcaactaaaggcttggtggagtggagcatcccagctccagacattttatgagagagagaaataaactcccatccccttaagccactgcagtcttaggaactggccacacaccacggaactaacgtcagaataatataatggagcctactacaatccatttagccaga

SEQ ID NO: 145621 - DNA, 601 bp, Human
ctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtctaatttctcatgcctgggaatacggaaagtgaaaaatatatattgttacaaaaaaagataaccaaggaaatactcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggagtacgagtacgatgttgtgt

SEQ ID NO: 145622 - DNA, 601 bp, Human
tgtttcttcagcacagtggctgtgacatcacctctgtgtgcctgtagcatctagcagagagccacatacatgctggataaccaattcatgcatgtagaataaacaattttcccctacaagtattactgatttattttaaatataagaaagaatatactgaattttcccccttggtgcatgtttcttatgagtacagcttagttgctaaaaacagcgtgatttctagtgattgcggtagaagaataaaagctaaaactcctaggacttctgttagaaatgtaaatcagaagctgatattacytcaagtgctacgtgaaataccacattcaatttgtaactccaaaagctttagtctgtggtacatgtggttctacatggtttagtagtgcctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtcta

SEQ ID NO: 145623 - DNA, 601 bp, Human
taacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaaccttttcctttctcactgcatcattcatgattgatacaacgatgagtgtgctgaatgcaggcrtcgttgctgaggatacaaaaatgaatagaaggcagctcctgctcaccccaccagcggccccacagcagctccacgtgtgggcaagtggtatgcacacgagcaatgtgatacacgtgactatgagatgtgttcaaggtgatgcggaaactgggtacgaaggcccttaagtatcctggatttctgtgggacattcccctgcacagttacgtgttgccatgcggctatgctgtttcgcatagacatgtcttgtcttcccattagatgacgtgtttcttcagcacagtggctgtgacatcacct

SEQ ID NO: 145624 - DNA, 601 bp, Human
tgccctcctctctcctttcttccgcctgttaaactttccactccttaacccacccacgtgtctgtgtacttaattttcttggcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcaygtcacttcccctggaagcccttgcctggcctccattgtctgcaggatgaagtactgaatccttaacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaa

SEQ ID NO: 145625 - DNA, 601 bp, Human
cagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaaccctttttttcagacatctctctctcttgcaaggagctgccctcctctctcctttcttccgcctgttaaactttccactccttaacccacccacgtgtctgtgtacttaattttcttrgcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcatgtcacttcccctggaagcccttgcctggcctccattgtctgcaggatgaagtactgaatccttaacccacagggccagac

SEQ ID NO: 145626 - DNA, 601 bp, Human
tggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatcgacctgcagacacaaacaagcatgctggaagcttgcacrggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaacccttttttt

SEQ ID NO: 145627 - DNA, 601 bp, Human
aatattctatagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagccygtaaaatcgacctgcagacacaaacaagcatgctggaagcttgcacaggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaa

SEQ ID NO: 145628 - DNA, 601 bp, Human
gatgctgggatatctgagtcaagaagggtggctgtcactgtccaccccttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatattctrtagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatc

SEQ ID NO: 145629 - DNA, 601 bp, Human
ctcaggagtttactccatactctatctcttccagagtaggctgtgattcccagtgtactaatgttaaatgttctagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcatgcacrtggatgctgggatatctgagtcaagaagggtggctgtcactgtccaccccttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatatt

SEQ ID NO: 145630 - DNA, 601 bp, Human
tccctactcaggagtttactccatactctatctcttccagagtaggctgtgattcccagtgtactaatgttaaatgttctagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcrtgcacgtggatgctgggatatctgagtcaagaagggtggctgtcactgtccaccccttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtata

SEQ ID NO: 145631 - DNA, 601 bp, Human
agttctattaaaaatcaatcaatctatccatcctatctctgtcttgcactctctctctctctctctctctatatatatatatatataatctatctatgtgtctataagtacaagatgcttcttgcagaaaaatttgcctagagactgggatttgtgtaaaactaactggattaaaattaaaattcgcaagttttagggttcacttaagcaaaaaaataactttttcattggtaaaatggtaaatttatttctggatctagtttgtgaagcaggagtgtgtatatggctgtgtgtgtatgartgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttctagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatgg

SEQ ID NO: 145632 - DNA, 601 bp, Human
gtaaaaatttgcaaatcttcaccatcctacccttccctgaaacaaaaaactaatttcaatttaaaattttcactatgattagttctattaaaaatcaatcaatctatccatcctatctctgtcttgcactctctctctctctctctctctatatatatatatatataatctatctatgtgtctataagtacaagatgcttcttgcagaaaaatttgcctagagactgggatttgtgtaaaactaactggattaaaattaaaattcgcaagttttagggttcacttaagcaaaaaaataackttttcattggtaaaatggtaaatttatttctggatctagtttgtgaagcaggagtgtgtatatggctgtgtgtgtatgagtgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttctagagacattgaaaatatctagggttgttataaattagctttgtggggtttttttacttgcttttgtttgtatttttgaata

SEQ ID NO: 145633 - DNA, 601 bp, Human
gcttgcttctttttttctttttttcttttttttttttgagatggagtttcactcttgttgcccaggctggagtgcaatggcatgatctcggctcaccgcaacctccacctcccaggttcaagcgcttctcctgcctagcctcccaagtagctgggattacaggcatttaccaccacgcctggctaatttttttctatttttagtggagacggggtttctctatgttggtcaggctagtctcgaactcctgacctcaggtgatccgcccgtcttggcctcccaaagtgctgggattacaggygtgagccaccacacctggcccaaggcttgcttcttttaagagaaaaaggctgtcatgctgctctacttcagagaacagaccaatttttagagagcttcaacaatttctttctaatgataattcaaatctttaccaaaatcctaacacatcaaatttcagtttcatattttcaactacctacgggatattttattgcttcaaacagaacatagcactccaccatctgataataatgtttattttacctgaatgcaagttccgtaagttccatcatttgcccagccttaataataattgtgc

SEQ ID NO: 145634 - DNA, 601 bp, Human
caataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagayacaaaaatagttttgaaatcaaaaaagatttataaacattattggtacaactgatttttgtctctggctggaaaatttttcatgggttacacattctttcatatatttctcacatttgagaagtggagatttaattgcttacattttgatgatgaagaaaaataccacttgacacaaattaatgtcaatccttgagggaccagttccttttccacggcatatataataaaataacacaggaacattaatctactttgtagagtagtgaaacttattgagcatgttataaaaacaacagag

SEQ ID NO: 145635 - DNA, 601 bp, Human
gactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgyaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagacacaaaaatagttt

SEQ ID NO: 145636 - DNA, 601 bp, Human
gtcttgtttgaatatcttaatttaggagtctgctacttaaaacagctgtcttatgtctatgagatatacgagccacaaccacagactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggc

SEQ ID NO: 145637 - DNA, 601 bp, Human
gatgaaaattcttggaaattaagccacaactgaaaaaaggagccaaataaataaggccttctctggggcctcataccgtgtaccaagggtcgaagaagtaaagtttgcctgactcatgattctagcttagaaggcaggaatcctgctttgttttatttgaattattgcattgatattcacaacaacagtcttgtttgaatatcttaatttaggagtctgctacttaaaacagctgtcttatgtctatgagatatacgagccacaaccacagactctacgctgcgttcctctccctagtcascgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaaga

SEQ ID NO: 145638 - DNA, 601 bp, Human
atatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttmacccttttggagaggtgagcagtcttgaagccctcaataatatccaccagcaccccagcgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttgcgagatacatgggattgagacttctgcag

SEQ ID NO: 145639 - DNA, 601 bp, Human
tgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttaacccttttggagaggtgagcagtcttgaagccctcaataatatccaccagcaccccagcgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttg

SEQ ID NO: 145640 - DNA, 601 bp, Human
tccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttcccccyacttagtccccagagacttagagttaacttgaataaattcccctaatctgagattgaaaagatagaaaagatagaaatcttttcttccttcaaaatacttaacatatatttgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagct

SEQ ID NO: 145641 - DNA, 601 bp, Human
tgctatgcccacatgagggaggggtgccttctaattcacagcaagatgccttctgctaccaagtgctgtggcctctctctgcctgaggggtggagtgaggaacatctgcccatgggtagtagcaccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattasactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttccccccacttagtccccagagacttagagttaacttgaataaattcccctaatctgagattgaaaagatagaaaagatagaaatcttttcttccttcaaaatacttaacatatatttg

SEQ ID NO: 145642 - DNA, 601 bp, Human
taccatcatattttggggtgaagtgtcttgagccccaacggcatcaagtatgaacttggagccagggctttggtgtacatttctgtaatttgtgcttcacacaaacaattccacctataaggccagaagggctgggaaacagggcatttccctccctgaaccttacaacctgctggatgctatgcccacatgagggaggggtgccttctaattcacagcaagatgccttctgctaccaagtgctgtggcctctctctgcctgaggggtggagtgaggaacatctgcccatgggtagtagcrccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttac

SEQ ID NO: 145643 - DNA, 601 bp, Human
ctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataamatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggtaaggtatca

SEQ ID NO: 145644 - DNA, 601 bp, Human
tgctaattctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaayacgataaaatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggta

SEQ ID NO: 145645 - DNA, 601 bp, Human
aacagattacagttgcttattgtattgtacttgagtattgaataattgcttcttgcttactttgaaaagtacctaagctacaacaatgggcaaaaagtttctcgaatgcacacaaactaaaatattaagtgatattttcctattgtcttcttttttgttgtcctgtcttgctaattctttcttgtttacatgctataaccattagaagctctgctaacatcttaaataaaatagaaatattaaaatatatatataaatataagtaatataaataaatataatgaaataaaatctcaaagcwtcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataaaatacatacaaatttattacatacatatgcatgagagtccctcaaaatataaggctcaaagaaggggtaggtaattggagtttatatagaatccctgggctacagaaaggaatagaggtttgggg

SEQ ID NO: 145646 - DNA, 601 bp, Human
cagaccaaggataatagaaaatgtaatgcaaagatgacagcagcattgtcctatctgtgaacatcagtttcaattcatgtgtctttcccttccgtagtgaacggaggtcctgtgtagggtacttcccttctacctcaatcccatcacaaagacacaaacaaaaagcccagtgacatcgtatcaataaagaaataagtaacattagatgacagatgttgtatacctatgtttgaggaaggtcaaagtaagaggtaacttcacgtttgcatgttcaaacttacttatctatctttgatgctakgcaagacaaaataaacggaagccctttaaatttccacctcctaacactagcctgtatgcaagaaaaatatattcttgctttttaaaaaaaaactctaaatgcattatgttttggtacatactttaatattagtttctattttatttttccataataaagacatggttgaatccagtgtatctattatgctaagataatttatgctaggataatatttttgataggaattctcataacaaatcagcttcatgtaccaattacaaaattgggagataactaaatttttataaaacgttttgg

SEQ ID NO: 145647 - DNA, 601 bp, Human
ttattatacacattactaacgtggcaagctctgaaggtcagggagtggctggctggtcttcagcttgacccatttgggaggtccattttcatctttggattatctggcctctcagtttgattactggggccataaacagctttcccgtgagagctgaggtgaacatttcttgctcattaggcctcttccagacaagcctcccttgcatgcaatgaatatgcacttgatgcccagtgaacatgcacttgatactcaatcattgttcttgacttgacattctggttgattatcagacatgtamtccatcagaacagagatgcaaactgaggatcttgaattttgttagtttcattccagagaaagctctgttggggctgggaggggtggcagaacggatgtggacggcgaatattgatgcggtgtgtgtgtatataatgttctcctgggagaggtgtttcttaaaaagccgagttggttttcaacgtgatatttaaccgaatgctgccaaattgtgctacctccccagcacgttaaaaaaatccattaataaagtgtttgttgttgtcagaatgcctattccaaagcttgggctgtgtgaagg

SEQ ID NO: 145648 - DNA, 601 bp, Human
tgagtttgtcctcagcaggatctcaaagtcataagagagctacaaagattgacaattattagacagtgtcagagttgggggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaaytaggatagaaatcccattgtgttaaagttccatggaaattatgcagaaactcaactgcacagaagagtgcattaaagatacagtggttgccctggggaagcttgctttcttcttaagtattaaacatgtcattttcatatttgagcaaaaacctgaataaactctgccctcaaagaaatgaaagataaccactgactgtgcacttcatataagcttcactgctacattttaaagtatcctgaatagtcccatgatgttaagatagcaacactttattatacacattactaacgtggcaag

SEQ ID NO: 145649 - DNA, 601 bp, Human
actccgcatagtcatctttgtatcacagatgcttacctagtatctgacatagggtcaatacccataaatgcttcttgaaatcagggttcagttagacacaaagctacagagcttaattaaacatataacaagatcattggtcattattacgaataaactcatgtttactggcctcttctcccgtatgtgaagagggatttcttattaatcccgggtcttaaatgagtttgtcctcagcaggatctcaaagtcataagagagctacaaagattgacaattattagacagtgtcagagttggrggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaattaggatagaaatcccattgtgttaaagttccatggaaattatgcagaaactcaactgcacagaagagtgcattaaaga

SEQ ID NO: 145650 - DNA, 601 bp, Human
agatcatttttacatttagccatcatcttcattgacgatgcaattcttagagtaccttagagaatctagaggaaatagagtggtggccttcagcgcattcctccatcttattctcctgcccacacccaggaccagaagaagaacacattgtcattcagtctgataccacctcaaagaagcagggtttggtaacaattagaaggtgaaagagaaaaatcacctaagctgatctaatttctttctaaagggaggaagtgtattaattgagggtggggaggaggaatagcttgaggaaacttgygtttccaagaaacagcctcaccagtagagattgtctgtggtttgcctgttcttgctgtaggcaggtgcacagttgatggaaggccatgcttatgagtcttcgatgacaaatgatgggtacatgatgggttgaaactctcctgagctttcttcactttcttggcttctctctatgctcaaatctctctatgcatttttttttttttttttttgagaaagagtcttgctctgtcgtccaggctggagtacaatggcgtgatctcagctcactgcaacctctgcctcctgagttcaagtaatt

SEQ ID NO: 145651 - DNA, 601 bp, Human
aggaaggctgagcacaagagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtaggsaggagagaggaggtttgtgtggatggtgctgttcaaggttcccctctgaatcctgctcacctttaaatacctctggcaggcctgcataaagggcccatttcccttcctcatctagtcgaaaataccagcaggattgctctgaatgaggagacaggagcctccattaaaatgcagacgccaattactctgcaggatgggcactaagcttatcctccagacttttactggtctagcaatgttgattagtatcagggtagtaacatatctccctccaaagcgtggagagctcagaggggaggg

SEQ ID NO: 145652 - DNA, 601 bp, Human
gcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaasagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtagggaggagagaggaggtttg

SEQ ID NO: 145653 - DNA, 601 bp, Human
aggctgggcagcagcctgggcagcaaggtcaagtgcaggctgctgtggcactgggcgctgcccctggctgtgcaatcccagggctctgggtgagaggtgaaccgagactcacatctgcccttgctgggttccaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggcyggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaatctccctctgtccacagaaatgcctgagcatggaactctgggaaaactgcactcgtgtccagatgcaagtaaatgataaactcctcgagacttcagacagagagcatagacatttata

SEQ ID NO: 145654 - DNA, 601 bp, Human
aagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagaggtgaaccgagactcacatctgcccttgctgggttccaccaccttctggcaaagagcattattggttcaatgttaatgccacggcctycccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaa

SEQ ID NO: 145655 - DNA, 601 bp, Human
attctctcaggacagctcagccctgctttccagaagatgagaggacttcacaaagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagaggtgaaccgagactcacatctgcccttgctgggttscaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcag

SEQ ID NO: 145656 - DNA, 601 bp, Human
ggtatggtggctcacgcctgcaatctcaacactttgggaggccgagacaggtggatcacctgagattaggagttcgagaccagcctggccaacatggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaaaaaaaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgatttcaacttacgatggagtaaacaggttttgtaattgccttgggaaagccagaacagaaaaagtaattctatcagcaacatggaagcaaaatgagt

SEQ ID NO: 145657 - DNA, 601 bp, Human
gaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagacaggtggatcacctgagattaggagttcgagaccagcctggccaacatggtaaaactccatctccactaaaaaacaaaaactagccaggcatggtgtcgcatgcttataatcctagctattcaggaggctgaggcaggagaattgctgaaacctgggcrgtgcgggttgcagtgagccaagatcgcaccactgcactccagcctgggtgacagagcaagactcaatctcaaaaaaaaaaaaaaaaaaaaaaaagaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgat

SEQ ID NO: 145658 - DNA, 601 bp, Human
gtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagacaggtggatcacctgagattaggagttcgagaccagcctggccaacrtggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaaaaagaaagaaaaaagaaaagtacaggaacatgactcttaaataagccaccatttcagtggatgcatttattgaattgatgctttcagtaagttgttt

SEQ ID NO: 145659 - DNA, 601 bp, Human
caaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagacwggtggatcacctgagattaggagttcgagaccagcctggccaacatggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaaaaagaaagaaaaaagaaaagtacaggaacatgactcttaaataagccaccat

SEQ ID NO: 145660 - DNA, 601 bp, Human
tcccagcactttgggaggctgaggtgggtgggtcacctgaggccaggagtttgagaccagcctgtccgacatggtgaaaccccatctctacttaaaaaacaaaaacaaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagacaggtggatcacctgagattaggagttcgagaccagcctggccaacatggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcact

SEQ ID NO: 145661 - DNA, 601 bp, Human
gcatggtaccaacgagaaatcagcatccaactgttttcccccttcctcttatctgaaaacacagaacagcgttagataatttaaaatgaaaacagcaaaagtgaccaataataacaccgtattaacctggttaagttttctggattctggatttcttgtgagtttttctccatgtacatatatttttgtaatattgtactcatagtaaatgtaattttgtggagcttattcttatatgactacactgcctttagagatgaatcttaattttcaggcatttggttgtgggatgcttaggctrtgagaagctggatctcaacatttaaagcaggatcatttaaaatgaggagtcaattgtgttacttcacatgtgtttcatttgaaacagtatatcattatgctactatgataactacagcaaatcctccttaggactgatttaagcattgaataaatgaagttaaaattgagtacactgccattttcagtgcttcttgacttctacacacttatcaactactacaaatctgatggcatccactttccagtgggttagctttcacctcgacaggtctcaaggttcttctgatgggattttagt

SEQ ID NO: 145662 - DNA, 601 bp, Human
tgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctccgggttcctctcccctgaagccaagggtgtcccctggtctcaagcagcactgaactttgaggtggcagttgagaggcccaattgttagttaaagatgggccagggggaatatcttcatcacaagatgcataaaagcgaytctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatggtaccaacgagaaatcagcatccaactgttttcccccttcctcttatctgaaaacacagaacagcgttagataatttaaaatgaaaacagcaaaagtgaccaataataacaccgtattaacctggttaagtt

SEQ ID NO: 145663 - DNA, 601 bp, Human
aggggacccagtgactaggggctgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctccgggttcctctcccctgaagccaagggtgtcccctggtctcaagcagcactgaactttgaggtggcagttgagaggcccaattgttagttaaagatgggccagggggaatatcttcmtcacaagatgcataaaagcgactctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatggtaccaacgagaaatcagcatccaactgttttcccccttcctcttatctgaaaacacagaacagcgttagataatttaaaatgaaaacagcaaaagtgaccaataataac

SEQ ID NO: 145664 - DNA, 601 bp, Human
atcttggggaaattatttaactttcctgaccttttgttccctcctctataaaatggtgacaaatagaataccttcctgacagggttgtagagaggactaattgagacaaccaacgtgccagcattttgggaatcattaaggtctatgaaaagttggtggttgtgtaactgtaacagctgtattttaggaccccaggaattacgatcttctcaaagcagaaatgtatttctttgtaaccttattatctagtatatttcctggtgcaactaggatctcaggaactgtaaataaacaatagatktaaagaacaaatgactgaatgaatgagagaaccaaagaaaaaggagtagagagagtggaaaaaaacaaaacaaaaccccagagtccttgctttctcaagatttctgcaaatgaaagatatttatttatccaactgggcaaggactctttaggcaggttgcacagacaggagttggatggtgaatgtggtcatgatcttgagaaacaaaccgggtctgagctgcaggacagggtcagaccatataaggctgggactgggactctgaacagttttttgggggtaaagttttattttgaggag

SEQ ID NO: 145665 - DNA, 601 bp, Human
actttgggagtcatacattaacctgccttcctcttgcctctcagagaaatgcccatctggcctccacagaaccactcttgccacggtttcgatttctcaggtcaggaccaggacaagttccactcacttaggaaagcagatgtttaggagtttcctatttggcgactcatgaaaatgatagactggtttctagaaataaaaatttggctgcctcttaagctattacattctcaaactgtgacgggatattcccatttgagcttaaagatacatgttttgtttgtttgcttgctttgttttwtgagatggggtctcgctctgtcacccaggctggagtgcagtggtgcgatctcagcacactgcaacctccgccccccgggttcaagtgattctcctgcctcagcctcccgggtagctgggactacaggtgcatgccaccacgcttggctaattttttttatttttagtagagacgggatttcaccatgttagccaggatggtctcgatctcctgacctcgtgatctgcccgcctcagcctcccagagtgctgggattacagcacattttttttttttttttgaaagagccctttctgcttt

SEQ ID NO: 145666 - DNA, 601 bp, Human
gtgcacacacacctacattgttgtcactgtatgcagaatctcctgccaagagccaaagtgacaaaaattatacagtagcttgatgggaataagaacacaagtgtacctaatctattcaatgtaagtctgaaaatggaaagaggtctacaaagaacagtattactaaaacagtaacagaggtggtttcatttttattagtaaaaaatgctctaaagcctctgactgctgcaaatatgataaaacagcacatcccaagctcagaaaaatggtttaaaacaactctaaggaaatgaccccccctgaaaatcaaatggaagtggaaacacacttggccaaaaagggaggctctggtgcataacagacaatataataaaattatagggaaacaatatgatagaaatgaatctgatgaagtgtattgctattgtaagtaaattcatgcggagaagtattgaacaaaccacaagaagggacacctcgttggtagggatgacacctttgacgtgctaacaactgctcatttctcacggtcaacagagcgggcttcctttcaggtcaccatattgaacacacctggcttggactgaaattcctggtgaat

SEQ ID NO: 145667 - DNA, 601 bp, Human
ggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacactkaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatggagtttcactcttgttgccgagactggagtgcaatggtg

SEQ ID NO: 145668 - DNA, 601 bp, Human
aatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacrttggtcagcttcctccgtatcatgtcccttaatacactgaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatg

SEQ ID NO: 145669 - DNA, 601 bp, Human
gactacaaaagaaatgattgcatgaatagctgagattccaggtgttaattcaatagcaaaaaaatgtgtgtgtccttgtactttagtttctgatggttaggagctgatgtgtacttgcttttgaattcactaaaatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttmtttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacactgaataaatccgccctgagctcccttttcctcagacttcataaatccaattcctcaagccgatcctcacagatcagttttgcaaccctttaatcattttaataatttttgtcactctcagttgaatcatt

SEQ ID NO: 145670 - DNA, 601 bp, Human
ttttgtcaaagtatcttttcagtgtggcatttgtaacactgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggggacagccaagctttcctctcrgcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttcggtggtatttcatattttcctaccctcactgcaacctccttaaacattcagtaaactatattttcataacgggttttcacgtccagcctgaatcactccccgaccacccaagtaagctcgttgacttacttttccatctttgtatg

SEQ ID NO: 145671 - DNA, 601 bp, Human
gggctaagaagacgagtgactttttgtcaaagtatcttttcagtgtggcatttgtaacactgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggrgacagccaagctttcctctcggcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttcggtggtatttcatattttcctaccctcactgcaacctccttaaacattcagtaaactatattttcataacgggttttcacgtccagcctgaatcactccccgaccacccaagtaagctcgttgac

SEQ ID NO: 145672 - DNA, 601 bp, Human
taaaggcatgaacacagcgttatctgcacctcagagctgggcaaggtctgactccctgaggaagagccggtggggattgccatggggaccactccctgccaggcatagccttttcccaaccctgagcgtccgagcagggtttcaggcagggcgggtcggaaacctcaggtgtgcggggatgggaaaagggggtgaaccctgtgttccccagacctgtactgactgagtcatgttacaagtcaggagttgttgcagggataaatgggaacagaccaaacactgtgaaactttcttttttttwttattattatactttaagttttagggtacatgtgcacaatgtgcaggttagttacatatgtatacatgtgacatgctggtgcgctgcacccaccaacttgtcatctagcattaggtatatctcccaatgctgtccctcccccctccccccaccccacaacagtccccagagtgtgatgttccccctcctgtgtccatgtgttcccattgttcaattcccacctatgagtgagaatatgcggtgtttggttttttgttcttgcgatagtttactgagaatgatgatttccaatttcatcca

SEQ ID NO: 145673 - DNA, 601 bp, Human
aggctagtctcgaactcctgacctcgtgatctgcctgcctcaacctcccaagcgctgggattacaggcaagagccattgtgcccggctgtgtttagttttctaagaaactgccagactgtcttccaaagagactataccattttgcattcccaccaacagtgaatgagagttcctggagctccacatcctccccagcatctggtggcatccatgttttgggttttggccattttagtaggtgtgtagaggtatctcattgttttaatttgcaaatgccaaatgacatatgatgttgaacaycttttcatatgcttttttgcatctgtatatcttttttcggtgaggtttctgttcagctcttttgcccatttttaatcttgttgatagttttcttactgtcaattttgaaaagttctttgtatattttggtaatagtccctttatccgataggtcttttgcaatattttctcccagactgttgaatgctttttttttaatggttggtctgtttccaggaatcagaaatcaggcttcacacccagcccagatgttcaagtggttgtttgacttgtctgccatctgcaactgtctctcttctg

SEQ ID NO: 145674 - DNA, 601 bp, Human
cccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccrggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgtttagttttctaagaaactgccagactgtcttccaaagagactat

SEQ ID NO: 145675 - DNA, 601 bp, Human
atctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccaggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgttt

SEQ ID NO: 145676 - DNA, 601 bp, Human
tttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccaggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgc

SEQ ID NO: 145677 - DNA, 601 bp, Human
agtatgtagtcttttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtaygtttagtttagtttttttttttctttttttttttttttttgagaccaagtctccctctgtcgcccaggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaa

SEQ ID NO: 145678 - DNA, 601 bp, Human
tctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccccatacatgcacagcctcccccactatcagtgttcctcacaagagtggtacatttgttataaatgcaaaatgtacattgacacatcatcacccaaagtcctcagtttacatgaggytcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtcttttcagattggcatctttcactggtaatatgcacttaaggttcctctatgtcttcccatggcttgacagtacgtttct

SEQ ID NO: 145679 - DNA, 601 bp, Human
gccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccccatacatgcacagcctcccccactatcagtgttccycacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtc

SEQ ID NO: 145680 - DNA, 601 bp, Human
agataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctccccyatacatgcacagcctcccccactatcagtgttcctcacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctag

SEQ ID NO: 145681 - DNA, 601 bp, Human
atcttgagaattactgctctgtggctgaggtcatcatatattcagaaccaagttctacgaatgggtaaagaatttttattctcttctagctttgaaagacccttcagaaggtagaatttggatgccaaaatgctatgatttctgaaatggtgtccaggaataatacaatgaattatttgaaaccgcagctgttcccaagattacagataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccccatacatgcacagcctcccccactatcagtgttcctcacaagagtggtacatttgttataaatgcaaaatgtacattgacacatcatcacccaaagt

SEQ ID NO: 145682 - DNA, 601 bp, Human
caggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttctactgaagcccccgatgctttgcaacctccgcacatttctcagaactcaggctgaaaccctgtgatctagtccaaaccaaccttcccagctagggtttcgttcaaaggtcacaactggtggcttgtgagcagggtstggacacacacacacacacacattttttttttttttttggctcacagagtgcttgaaaagaatctaagacaacatttacagattgggagatcaacgtaaaagatgcatcctaaacttcccttgctaaagtgaagaatgaggacaccctgggcctccactccttcccttcagttgctatttgtcattacacataaatgtctgttgcatatagggaaatatttctgtcccatgtctctatcaaaagtgggaaagggctgtgtttttctaaaagtaagagaaagagtgtatttctttgtggag

SEQ ID NO: 145683 - DNA, 601 bp, Human
cactctctggtttggaattcaagcctcctcccaacacaccacatgaccccgccgtgccagccattcacactgctcacagggtcttcagctcccttctccctgagagcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgasgtcacatcagtctccctgccaaccctattggacaggccttacgcgtgagaaacaaacctttgttgtttcaaaccactgaaatgttgaagttgtttgttactgcaacagactttagtctgtgctgactaatacatccaggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttc

SEQ ID NO: 145684 - DNA, 601 bp, Human
tttagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagrgcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgaggtcacatcagtctccctgccaaccctattggacaggccttacgcgtgagaaacaaacctttgttgtttcaaaccactgaaatgttgaagttgtttgttactgca

SEQ ID NO: 145685 - DNA, 601 bp, Human
tgctttccaattattttcacttcaaagaaatactttaatatatttagttcaaattgcatgatggtaattatgcttctaaatctgatcaaatgacgggagagaggaaacctttgcttccatgaggggatatttgttcttcaatagatgggtctaattttccacagtgggaggactcacaagcactgagactggcttttttcattagttatttataaagctcttattagattggttaaattcacatgtgggaaaaaagacaaattattgttaatcaatttctaacctatactattcataattyagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagagc

SEQ ID NO: 145686 - DNA, 601 bp, Human
ccaggtaagggcgagtggaggacagggtgtccccactacaggaagaaagagagacatcatcattcagctctcacagacattcctccttcaaaacagaccctctggcaaaggttatcctttaaagaaaaaaaagttcttgctcctctgtcttgaactgggaataaattaggagagataagagacagatattactcctttttaaaactctgtattcccattgaaaagagtcaagggtacaattctcaagtctgtgtgtgtgcacagtgcttacatgtctctctctctctctctctctctctcwcacacacacacacacacaccatatcccacttacagactgaatactttgcaccacaaagtattttcagctgctcttctcgctcctttccctttcaattcagaaggctaactctagctcaattatctcttccttttgacagaattcacatcaaatgcaaacaagatgagaccaggattctgcctggttctgttgccaaggtgggtgggaagtcggcagcagggatcagtagctgtagctgcttcagcctttgttgaggctaactctcctcccaaggtgtctcaaatagaaaggcttgttcct

SEQ ID NO: 145687 - DNA, 601 bp, Human
ggccatgagatgatgggagcagagactggagtgacacagccacaagccaaggattgctggcaaacaccagaagccagaagatgcaaggagggattcttccccatgggtttcagaggaacatgaccttggaggcaccttgatttcagacttctggcctccagaaccgtgagacaacacatttctgctgttctacgccacccggcttgtggcactttataatggcagccctaggagcaaatacatcaaggcagaaaacccgtcacaaacctgctggcatgcccgttcctcctggctacgactscacagcctgttcccaggggtcagcccacaggccagggccaggcggcattgctggctagtggcctgcaggaggggcacttatcagtacttcctcactcccaacatgaaaagtcaggtaaagaagtacaggaagctctgccaaggagtggaagggatttgtacctccttaggacaacttcccaggtaagggcgagtggaggacagggtgtccccactacaggaagaaagagagacatcatcattcagctctcacagacattcctccttcaaaacagaccctctggcaaaggttatcctttaa

SEQ ID NO: 145688 - DNA, 601 bp, Human
tatattcttctatggtattaagtctttgaaatctggtttgtattttacatttgcaacacacctccctttggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacattycctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctgagagaaagaggttcctgttttgttcacacaactattgttc

SEQ ID NO: 145689 - DNA, 601 bp, Human
catcctgtaatcagcataaaaattactaataagatatcttatattcttctatggtattaagtctttgaaatctggtttgtattttacatttgcaacacacctccctttggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagscttcactgggcacgtgtctgccaggtacagactacatttcctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctga

SEQ ID NO: 145690 - DNA, 601 bp, Human
actctgttgttgacatctttcttgccctctacactgttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctcccttyggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacatttcctggcctctcctgcactcagggtcccatgtgactggatctggcacctgagatgtaaacgaaagtgaa

SEQ ID NO: 145691 - DNA, 601 bp, Human
ctgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcgtccccagcctttccccagtcttctaggactcctctcccttgctccgccttgaactctgttgttgacatctttcttgccctctacacygttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctccctttggactacccacattttgagtgctccaaggacgct

SEQ ID NO: 145692 - DNA, 601 bp, Human
aaagcctcaacaaaaatgttctccatcaccatgttatcaggtgtccacgtcagctgagaagcctgactggtccttttcatgcctgtggaacaagggactgaatcttaaggagagtggagaccttgtgttacttacattctgcattcaagaaactatttctatgaagtttaatgatcaatgatgctttttccttcaaaactatccaaagatttcaaatctgtttgtgcaaggaggcactggattgaactgaatttctagtttcttcatcgactggttccttcattcagtaacaaaactgaasattttaatgtgctgatactgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcgtccccagcctttccccagtcttctaggactcctctcccttgctccgccttgaactctgttgttgacatc

SEQ ID NO: 145693 - DNA, 601 bp, Human
cgaacggaaggactaacgggggttgcagcacagagtcgcctgaatatgtggcaatgaacaaagaagggcacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccytcaattagcattccttcaaaatgccatctgtaagtgactaaagaagtgacagccagaaggcagaacacagggctatctccgcacagacaagacaagagccgggaaggcagggacgctcgatcagccgtttccagcaatgttaacgggtccacccactaaactaaacaaatgctttcttcctaccatggagacagaaactgaaaaataatttttgacagcactgtatgatttagtgggtgcttgcagacacagcctatacttagttttataccatatttaatagaacatttcaaactttca

SEQ ID NO: 145694 - DNA, 601 bp, Human
gacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggcacagattacaygaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccctcaattagcattccttcaaaatgccatctgtaagtgactaaagaagtgacagccagaaggcagaacacagggctatctc

SEQ ID NO: 145695 - DNA, 601 bp, Human
tcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggyacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccctcaattagcattccttcaaaatgccatctgtaagtgactaaagaagtgacagccagaaggcagaacac

SEQ ID NO: 145696 - DNA, 601 bp, Human
tacatagttataaaacataaccgttaaattctagttaaatgccaccaaagataaaaataataaagtagcttcaaattgtacttattgcaaggtgacctatctgaaatgtcttcttggtcatattataagaggacttaagatgccaaaggggaggatcatagcctattcatatttccatctcccacaaagtgtctggcacacatgtaataattaaagtagacaatctttattgaatgttctcttgtttaaagaagtattttaagcccattatatttaataattcacttaaccatcaaaactsctcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagg

SEQ ID NO: 145697 - DNA, 601 bp, Human
ctctaatcataagatagttgaaattttgtactttgttctagacaccacatattaggagggccttattatattaggtagaaagaaccttggcaagtcactgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtgstgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttggtcat

SEQ ID NO: 145698 - DNA, 601 bp, Human
ccatctctaatcataagatagttgaaattttgtactttgttctagacaccacatattaggagggccttattatattaggtagaaagaaccttggcaagtcactgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaaygtgctgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttgg

SEQ ID NO: 145699 - DNA, 601 bp, Human
ggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcastgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtgctgttcccagtggatctgagtagaggctggtgattgtgggaagattctcacactgggtgtcatgttagaccagctgacctctaagggccctatcatgt

SEQ ID NO: 145700 - DNA, 601 bp, Human
tgagaaccaaattaaatatcactctataagtgaaagcactttaagacctaaatcaatgttaattattataatgatgaggttgagtattgcttcatccttgatgctactctcctcagtaactttgccaatgatttaaagatgtagaagctattcttgtcagatggatggcacaggcccggggtgggtctcctggtaggacaagaccaagattatggcctatggtcttggacaagaccaagattatggtgacagttgaaattgataaggggtaaaagtaaaagtttcttttatgttcaaaaakgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcactgttttgaaaatacggtgggtgaaggacctttaaatgtttgaagttgccatctaaaacaaggattatacatgct

SEQ ID NO: 145701 - DNA, 601 bp, Human
attaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttaagacctaaatcaatgttaattattataatgatgaggttgagtattgcttcatccttgatgctactctcctcagtaactttgccaatgatttaaagatgtagaagctattcttgtcagatggatggcacaggcccggggtgggwctcctggtaggacaagaccaagattatggcctatggtcttggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattagga

SEQ ID NO: 145702 - DNA, 601 bp, Human
tttgtacgggaaagtgacttaacttccttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcctgactaatttttgtattttttagtagagatggggtttcaccatgttggccaggctggtctcgaactcctgacctcaggtgatccacccatctcggcctcccaaaatgctgggattacaggcrtgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttaagacctaaatcaatgttaattattataatgatgaggttgagtattgcttcatccttgatgctactctc

SEQ ID NO: 145703 - DNA, 601 bp, Human
ttgtgatttgggcaaatccactctctgcacctttcagtgctggggtattaggtaaagacacacatttcagagtggcatgtagagaagttcaaatcccagccatttcatttgctcctggaactttgtacgggaaagtgacttaacttccttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgccygactaatttttgtattttttagtagagatggggtttcaccatgttggccaggctggtctcgaactcctgacctcaggtgatccacccatctcggcctcccaaaatgctgggattacaggcatgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatcc

SEQ ID NO: 145704 - DNA, 601 bp, Human
ggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggggtattaggtaaagacacacatttcagagtggcatgtagagaagttcaaatcccagccatttcatttgctcctggaactttgtacgggaaagtgacttaacttccttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcctgactaatttttgtattttttagtagagatggggtttcaccatgttggccaggctggtctcgaactcctgacctcaggtgatccacccatctcggcctcccaaaatgctgggattacaggcatgagccaccgtgcccggcctatgactt

SEQ ID NO: 145705 - DNA, 601 bp, Human
ttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctgggrtattaggtaaagacacacatttcagagtggcatgtagagaagttcaaatcccagccatttcatttgctcctggaactttgtacgggaaagtgacttaacttccttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcctgactaatttttgtattttttagtagagatggggtttcaccatgt

SEQ ID NO: 145706 - DNA, 601 bp, Human
gttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggsgtattaggtaaagacacacatttcagagtggcatgtagagaagttcaaatcccagccatttcatttgctcctggaactttgtacgggaaagtgacttaacttccttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcctgactaatttttgtattttttagtagagatggggtttcaccatg

SEQ ID NO: 145707 - DNA, 601 bp, Human
acctagaccagcaattacaatacaatgacgtaagcattttcctcctctagtcaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgctttctctctctctctctctctccctctctctctctctttctttctttccttttttttttttttttttgagacagagtctcactctgttgcccaggctggagtgcagtggcatgatctcaatctcagctcactgcaacatctgcctcctgggttcaagcgattctcctgtctcagcctcccaagtagctgagcttacaggcaggcaccaccacgctcagctaatttttgtatttttagtagagatggggtttcttcatgttggccaggctggtctcaaactcctgacctcaggtgatcctcccaccttggcatcccaaagtgctgggattacaggtgtgagccactgtgca

SEQ ID NO: 145708 - DNA, 601 bp, Human
aaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctctagtsaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgctttctctctctctctctctctccctctctctctctctttctttctttccttttttttttttttttttgagacagagtctcactctgttgcccaggctggag

SEQ ID NO: 145709 - DNA, 601 bp, Human
tccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttcttccttgaattgttgagacctgatttattaggtgaaggatgacattgttttcaagggaaaggaatgctgttaaaaaccaagctgttayacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctcta

SEQ ID NO: 145710 - DNA, 601 bp, Human
agtcccagctactcaggaggcgaggcaggagaatcacttgaactccggagggcagaggttgcagtgagccaagatggcgccacttcactccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttyttccttgaattgttgagacctgatttattaggtgaaggatgacattgttttcaagggaaaggaatgctgttaaaaaccaagctgttatacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggt

SEQ ID NO: 145711 - DNA, 601 bp, Human
agatgaagaggtcacgatttaccattggctgataacctactgtgatgacatttctcaggaacgaggcgactagaagaaaaacatgaaagaaaagggggctaagagttttcagaattctcacaatactttttaaaaagagtctcaaaaatcaaaaccagttttggcatactgatttctaagacataattcactctccttcttcctatccctcccttccttccttttcttaatagaaattgttttatttatacattttgtattttagttgccttgtcagttaagtgattacattcatactggaaaaaaaaaaacatgggcaatataatcataaaaatacaaatttctggccgggcacagtggctcatgcctgcaaccccagcactttgggaggccgaggtaggtggatcacctgagttcaggagttcaagaccagtctggccaacatggtgaaaccctgtctctactaaaaatacaaaaattagccaggcatggtagcacacacctgcagtcccagctactcaggaggcgaggcaggagaatcacttgaactccggagggcagaggttgcagtgagccaagatggcgccacttcactccagcc

SEQ ID NO: 145712 - DNA, 601 bp, Human
acacatatttactgaatacctacaaaacttctatgactaaaaccaatgagattctcccatgaaatggggtggagagaggggaaaggcagaaaataagcaaggcaattgaataatgtaattccagttagtggtaagtgatgaagaaagcagggctggcttacagggtgagatcgtgcagtggttggggaaggcatggtctaagcaggcctctcctgggaggggacacctgtttagagggctaaatgaatggaggcagccatgcaaaaagctgaaggaaggtcctccaggaagggagagtcayggccctaggaagaggacaagtctgcttcatttagagaacaccatgaagggccagggtactggagcattgtcaacaaggggaaagtgatcgggccgaggacagaaggccaggtcacataggtctttgtagtgtgagaagaactccaaattttattctccggagtggagctgcttaaactgttagtataaattataatggaatttaagtaatgttcacagaggagcagagaagataacagagaccgagaaggacatctgaatttattatattttaattaatttttttagagatagggtcttc

SEQ ID NO: 145713 - DNA, 601 bp, Human
ggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtctaggatttatatgttacagacatatttaatattaatttaaagcaccagagcagaatgaattgtgcattccaattttttagctctatcawacactctttaatcaaggatttttcaagaacttgctttgtgctagcaggacctgatttttcccctcaggaagctcacagtttaattaaggagagctcatattagtaacaatgcacatcagtgtctgagtaagagtttaggggaggtgtagctcgtcttcatggaggttaggggcaagtgagtttagtgaataggtgccacggagtgagacggggaaagatgggtgtcctggttgaggggcgatgaggtaagaatgactaatgcttatgaaccattgcctgataaacactgtgcccaggact

SEQ ID NO: 145714 - DNA, 601 bp, Human
ctttctatatttcattacgttgcctagatcaagcaaacactgatatacccagataagtgtggcaaacagttatgtgtttttttttaaacacctcattttacaattttgtaattcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtrtgaatacagcttctcacataagaggtgagttaacagaggctcggagcagataagtcactggtgctgagtcacaggctggcagagcaaggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtct

SEQ ID NO: 145715 - DNA, 601 bp, Human
gttctaaggtcccttaagattatgtagaagagatgtttactttttagcaaagaaaatattgtccagaaacccattttttagaaatagataaactatttatttttaataaattaagcttatttttggtgaacacaaacttttgaaatttagttttttgaaagacacatgtaatcatgtattatttcgttctttctatatttcattacgttgcctagatcaagcaaacactgatatacccagataagtgtggcaaacagttatgtgtttttttttaaacacctcattttacaattttgtaatkcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtatgaatacagcttctcacataagaggtgagttaacagaggctcggagcagataagtcactggtgctgagtcacaggctggcagagcaaggatcagaatgcaggtcctctgcct

SEQ ID NO: 145716 - DNA, 601 bp, Human
attattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaatagataaactatttatttttaataaattaagcttatttttggtgaacacaaacttttgaaatttagttttktgaaagacacatgtaatcatgtattatttcgttctttctatatttcattacgttgcctagatcaagcaaacactgatatacccagataagtgtggcaaacagttatgtgtttttttttaaacacctcattttacaattttgtaattcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataa

SEQ ID NO: 145717 - DNA, 601 bp, Human
agacttagaacaataatatataaggctttatatattatatatatattgctttatattgaaatttcatggaattattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaayagataaactatttatttttaataaattaagcttatttttggtgaacacaaacttttgaaatttagttttttgaaagacacatgtaatcatgtattatttcgttctttctatatttcattacgttgcctagatcaagcaaacactgatatacccagataagtgtggcaaacagttatgtgtttttttttaaacacctcattttacaattttgtaattcactttattaaacagaaactttagctcaaggctgcacaaaataatgaattttcagtttctgctaagagtatgtatatgttgttt

SEQ ID NO: 145718 - DNA, 601 bp, Human
ggaaggaagggagggaggggggaagccaaaagaaacaaggattgagtttgttggagtcactttagaacattagtgccacactggtccataaatatgttcattttgcggggggtgggggagactgcaacaacatcatactgtatcaatgatgaattcagcagtcacttaaaatgaaaaatgtaggtggctttcaaagaaacaatctcaagtaaaattgttaacaaaatttatcaatttttgaaaactgtatattcaaatagataacataaaaacaagaataatttaaagcatgttactcaastagatttcacaacaaatgatacatttaaagttttatggctccaatattaatgctttaggaactgtgtggcaaacatttactaaccaggttctcatgacctattgactgtgtgaagaatatttgtcagcatgccagcgtgcagtgttaggttctgttaggatcaaaacaatctccctcaggaagcttatataaaaagttgtccttgtccctactcttaggtcaagaaaacattgtcatcaatatgaatatgaagagatgcatgaaataatatgactaagttctttaagggagaaagccgcc

SEQ ID NO: 145719 - DNA, 601 bp, Human
accgcttttaatttcattgctataactaattagcattagagaaaccattttcataagcagtgtgctaacaacccattggtaactggaaaggaaagctgatggtgcagctttctccatggtaaccgggcaaggagaaaagcgcttcacagccacgaagagggggttcctgagggaagcacgagacgcgggctccaggcagcagcacgtggaagtgggcaggcactgcccctgacttcagatgccacaaagaacattggcatattccagtcaagggcagtgttttgaactgaaaatattacaygccaccatagaactgttttctacatattccttaaaagctattcaaaccgtatcaagatttttttagaaagggctctaccaattaaaatcacattggtttttcctaaagaattcctatcaactctcccacccaacatatcctacctctgtacccagtacagggggcagaaggcatcaggaaaagtaataaaaagaacctttggctgggcgcggtggctcactcctgtaatcccagaactttgggaggcagaggcaggcggatgatgaggtcaagagattgagaccatcctggccaacatgg

SEQ ID NO: 145720 - DNA, 601 bp, Human
tcagcctcggccttgatgaggagggcagccttcagccgtgtgcaggccatagcatgagcgagaaatgaacttttgttgggtgaagccactgagattttggagtatttattatcactgcagcgtttcctatctgatcatgactatataatttgtgaagcccagtgcaaaacaaagacacagagccccttcttcaaaaatgatttagcatttcaagatattagcagtagagcctcaaactctggggggccctgtgagtatggggccctgtgagtatggggccctgtgagtatggggccctgtrtgactgtacaggtcgcacactccaagctggccctattttcctattccaccatcacaacaatcctggaaaagaatcttaattctcttatttcacatatgagaaaattgagagcttaaacagcttgcttaaaatagcagactcacaaaatgccagaagcgagagtttgattccattggtattaataacactgcgatgatgggtcttttgtgcattcctggttctgggctttggggcacaaggagccaagtacactattacaggaagcagacaagactcaggaaatatcgtctcctttgtagg

SEQ ID NO: 145721 - DNA, 601 bp, Human
gtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctgtrttgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgagcg

SEQ ID NO: 145722 - DNA, 601 bp, Human
gtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctrtattgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgag

SEQ ID NO: 145723 - DNA, 601 bp, Human
aatgatgacatttgaaaaatagcatcattatcactatatttagtacgtacatgcccataatagagcagtccataaaacactatctacgcattcacatgtataataatactaatagtttaaaaagtttcaagtgtgggtatgtatcctaaaatgcctagaaagataagtaataataagtagtgagattcctgatcttactggtttttgctttttatgttaactttctactttttcattttgcttgaatgtgttataataatacatttatattgtataatcagaacgcaagcagcaatgccayttccatcttgaggaagtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactg

SEQ ID NO: 145724 - DNA, 601 bp, Human
ggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagacatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcrggcggatcacctgaggtcgggagtttgagaccagcctgaccaacacggagaaaccccgtctctactaaaaatacaaaattagccaggcgtggtggcgcatgcctgtaatcccagctactcggaggctgaggcaggagaatcgcttgaactcaggaggcagaggttgtggtgagccgagatcacaccattgcactccagcaacaagagtgaaactccatctcaaaaaaaaaaaaaaaaaatactggtacttttccttaggataaggttaatgaatcaaggtgatgaagatggcctttctta

SEQ ID NO: 145725 - DNA, 601 bp, Human
aagacgttatccagcatgaaaaggaaggcaatggaaaccgagagccagcatacaggagctgctaacagaaaaactggtgggcgagctgaggtgaaatggcttggacacaaaccagtgcatgcagttctaatgaggcagtaaggcaggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagayatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcaggcggatcacctgaggtcgggagtttgagaccagcctgaccaacacggagaaaccccgtctctactaaaaatacaaaattagccaggcgtggtggcgcatgcctgtaatcccagctactcggaggctgaggcaggagaatcgcttgaactcagga

SEQ ID NO: 145726 - DNA, 601 bp, Human
catatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaattttat

SEQ ID NO: 145727 - DNA, 601 bp, Human
tacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggwctataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaatttt

SEQ ID NO: 145728 - DNA, 601 bp, Human
atgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggwtaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaata

SEQ ID NO: 145729 - DNA, 601 bp, Human
agatatgcaaacaacctaagtaagcatcaaaggatgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaawgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacac

SEQ ID NO: 145730 - DNA, 601 bp, Human
cggtagcacgggttggagaaaagggaaccctgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgaatggataaagaaattgtggaatatattatatacayatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggg

SEQ ID NO: 145731 - DNA, 601 bp, Human
cttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaactcaacatagatgaaagaacttaacataggacctgaaatcataacattcctagtagaaaacacagggaaaccccatcgccttggcaataactttttggataccacaccaaagctcaggcaacaaaagtgaaaataaacaactggactacaccaaactaaaaagcttctgcacagcaaaggaagcaacgaacagaatcaaaaggcagcttacagattggaagaaaatatttgaaaaccatgtatttgataagtggttaatatccaaaatgtaaaataaatgcctacaactcaatagcaaaaaaccccaaataacctgattaaaaaacggacaaagagcctgaatagacatttctccaaaaaagatataaaaatggccaacaggcatacgaaaaggtaatcaacatctctgaccatcagggacaggcaaatgaaaaccat

SEQ ID NO: 145732 - DNA, 601 bp, Human
gtggcaagacctcacctggaatctgtttaatttcaataccaactttgggagacattaaaaaaaaatactgaagcctatgaagaagaagttctctctcatttgaaaaatttttgaaaaacctaatctagtattttgaccatgttaagaaggaaggacacatgcatgtttggaccagggtgttttgtagagttggtaatcttcttcatggcctgctttaatgactgaaggataagcccttcacagaaggactaaggcttccaagtaccccaggacaacagagggaggttgattttagctagayataaagaaaaacgttgtaaaaatcagaactgtttgaaaatagaatggatgcctttagaagagagcaagtcttacttgcagaacgtgttgggagtttaaggaaacccaatccatgacacctactatccctgtctcagcttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaac

SEQ ID NO: 145733 - DNA, 601 bp, Human
cactcttaaaaaacacccatttaatagaagaggaaagtgagccacagagaagttaatttgctcaaaattgcatagctaggaagtgaactctggctagggtctaaacctagacagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcacycttctgctggagctgggagtggtggaagacctgaggttttcctctaggtagaaggaactcccattatgaacactcaagagtaattctcaacggatcagaacttcctgagagcaggacactctggattacctgagaagcactcccagtctaaccctttgacccactcaagagatgtcctatgtcttagagggttctgccctggccctcctctggccacacccctcttcctggagcaaagagtctgtggagctaaaaagctgcacccacaacagcacatgcttgcccttcagactatgcccc

SEQ ID NO: 145734 - DNA, 601 bp, Human
gaactgtgagaggtagaggaccactagcctgcattttctcatagaagctatagcatagcattaataatagtggtaataataattgttccgcttaaaaattagctaatgcttgcaaagtgcttactatgaaccgggcattgctaggctgaacatccaacatacatagtttccttcaattcaccaaggtaggcactcttaaaaaacacccatttaatagaagaggaaagtgagccacagagaagttaatttgctcaaaattgcatagctaggaagtgaactctggctagggtctaaacctagrcagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcactcttctgctggagctgggagtggtggaagacctgaggttttcctctaggtagaaggaactcccattatgaacactcaagagtaattctcaacggatcagaacttcctgaga

SEQ ID NO: 145735 - DNA, 601 bp, Human
atgggcgctccctacaggccaagtaaaattccttcatgcatctcctaatgactccccaccaaaatgctgccaaagagtcaatactgccacctcccccatgtctgtgtactcatccctggaacttatgaatatggtagcattcatggtttggttctgtgtccccatccaaatgtcaccttgaattgtaataatccaccatgtcaaggatgggaccaggtggagataaatgaatcatgggggtggtatcccccaggctgttcttgtgatagtgagtgagttctcagaagatctgactttttttataagaggcttcccccttcactgggcacccattctctctcctgccaccctgtgaagaggtgccttccgccatgatgtaagtttcctgaggcctccctagccatacagaactgtgagtcaattaaacctcttttctttataaattactcagtttcaggtatttcttcatagcagtgtgagaacagactaatacatcgcaacgggagtttgcagaaatgagtaggttaagggtcttgaggtggggagataattctggactatccaggtgggtccagtgaacaagagaaagagagagagagag

SEQ ID NO: 145736 - DNA, 601 bp, Human
ttagtagctgggattacaggcatgtaccaccacgtccagctaattttgtatttttagtagagacagggtttctccatgttggtcaggctggtcttatactcccgacctcaggtaatctgcctacctcagcctcccaaagtgctggaattacaggcgtgggccaccatgcccagctggtactttctcaagccagggattggattgggaaaactgatggagttggccaattcctatggaagtcacatttcattcctggaaactttgaatctcagattttcttttttaaagaaacttcatctakatatcatttatataatatgaaatatgtcagttttaattgtatactttgatgagttttggcaatatatgcaccactacaatcaggatgtattttataacctttccatgttctgaaaaaggttttctcacgcccatctgcagtcaacaccatcctatgcccacctagcctaaggaaatcattgaacttctttgtgtaactacagtcttggtattggtaatttctcagaaagtgtaaactcatgttcattagcagacaaatagaaaaatgaattaccaaataattaaataatgccttgaaggg

SEQ ID NO: 145737 - DNA, 601 bp, Human
tcatcgccgtgagcatgacttccagggatgtccacagctgtggcttctcccaggtatttatagttcatttacagtcctgcctgtcaagatcccacacaccaaccaagagttatcttttttttttttttcttcagatggagtctcgttctgtcgccaggctggagtgcagtgtcacaatctcggcccactgcaatctcagactccctggttcaagcaattctcctgcctcggcctcccaagtagctgggactacaggtacgcaccaccacgcccagctaatttttctttcttttttttttttagcagagacggggtttcaccatgttggccaggatggtcttgatcacctgacctcatgatctgcctgccttggcttcccaaagtactgggactacaggtgtgagccaccatgcccggtccaagagtcatctttatcataagtacttactgtctattaaccccataaacattccacctgcatcagtttttcagaaaacagaactgaacgtcaagtttgtcctcagggacagagaaagagttttgctagccagtggctcagaggaagcagcggcctgtgcaaaggtctggaggtctgaaaagt

SEQ ID NO: 145738 - DNA, 601 bp, Human
cctccatggctatgtaagtcaattctttgaaataaagagaactccaactaatgcacaacggtcggtccatccctccctccctccctccctcccttccttcctcccttccttcctttcctcctcccctcccctcccctccccttcccctctccccaaattcaaaaaaagttaactttatgattaccctttctgggaatactagttgttactatacacattattcacatagaaaaatcagtaatgtaccagttggtagttgaattcttcagagggaaagattagtatcttattttttatttartgagatgaggaactaaaagagcattactattctttactacaatatataacagaagtgttttcttggtgtctgcaatgcaaattctgatgtcagtaaatacattgagagactaatttgtcaagcaagcacagaccacacatggtttctttttatttctttctttctgagatggaaggaaacctaaaagtaacaatgtacacaactcgctagggttgccagcagcattttggcgatgtccccttgggtcacagaacggcagcatgggttctataggtcggggtggcattagcactgacggca

SEQ ID NO: 145739 - DNA, 601 bp, Human
acaatctatttgatgaaagtttttaaaaaatggaatattcaatcctttatagccaatgagggcctgagccttgaaccagtgaacagtactgagtagcagttaggagggcggggagtcagactgcctgggcttaacgtcgtggctctgtcactcatttcgtactcttaatcatcatgctatagaaactcccacaatgtgtgtgtgtgcatgtgttattaaatccttcagatacttctcagactcttgcctgtgtagataaacaacgtgtgttttctatcaccttggcttgtctctagtaccyggttttttaaccaaacattactctgggtgttgtggtgaaggtatgttgtagatggggttaaaatctacaatcagtgggattgcccttgataatcttaacgggcctcatccatttagttgaaaggccttaacaggtttctcagaggaagaaattctgtttcaagattacaacatcagctcctgctccgttcccaaccttctggcccgccctgtaggattcagacttgggggcctccatggctatgtaagtcaattctttgaaataaagagaactccaactaatgcacaacggtcggtccat

SEQ ID NO: 145740 - DNA, 601 bp, Human
atgaactattaaaaacaggggtctcttttatcctaccgtcatctcatttccagataaaacacctccagtttcttcaatgacttccacgagaagacctctctggagaggtctgaacattgtcttctgtcagctccctcttgattttgggaccaagcattgaatataaagttaggatgtggcctgattagcataggcagagtactgagaagccttccttgtgcctgtcactacacttccatcaacagactccatcaacaggaggcaacgcagcctcaggataccacctgcccacggcccaccygagggaacctgctgcccacagcctctgctcccagagggacctacccagtcccaaagctgaggcaccacccatccttgaatggccagagtaacctgtctcaagaatatgagcaagatgattccaagagaaagtggcagtcaacagtggttttgtacaatgcggataaatattagaaaggccatccaggatgcgtcatttgcaagcttgggtggacaggcagctgccaacagtgacagcaggtggcccatgagtgaaacttagagaattaggggactgctttggtcttggcagatttcctgg

SEQ ID NO: 145741 - DNA, 601 bp, Human
aatgttttctttttctttcttttttttttgagacggagtctcgctctgtcacccaggctggagtgcagtggtgcgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgatctcctgacctcgtgatctgcccaccctggcctcccaaagtgctgggattacaggcgtgagccactgygcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttattt

SEQ ID NO: 145742 - DNA, 601 bp, Human
taatgttttctttttctttcttttttttttgagacggagtctcgctctgtcacccaggctggagtgcagtggtgcgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgatctcctgacctcgtgatctgcccaccctggcctcccaaagtgctgggattacaggcgtgagccactrtgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttatt

SEQ ID NO: 145743 - DNA, 601 bp, Human
ttaatgttttctttttctttcttttttttttgagacggagtctcgctctgtcacccaggctggagtgcagtggtgcgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgatctcctgacctcgtgatctgcccaccctggcctcccaaagtgctgggattacaggcgtgagccacygtgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttat

SEQ ID NO: 145744 - DNA, 601 bp, Human
tctgcactggtgtttccaatgcccaattgttttcttgacttctccataagtttcagcatatctataaaccactcataccatgatttacttaatgttttctttttctttcttttttttttgagacggagtctcgctctgtcacccaggctggagtgcagtggtgcgatctcagctcactgcaacctctgcctcccaggttcaagtgattctcctgcctcagcctcccgagcagctgggactacaggtgcccgccaccacacccagctaatttttgtatttttagtagagacagggtttcacygtgttagccaggatggtctcgatctcctgacctcgtgatctgcccaccctggcctcccaaagtgctgggattacaggcgtgagccactgtgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcagg

SEQ ID NO: 145745 - DNA, 601 bp, Human
ataccatttaccctactttgcaatacataacaatctgcactggtgtttccaatgcccaattgttttcttgacttctccataagtttcagcatatctataaaccactcataccatgatttacttaatgttttctttttctttcttttttttttgagacggagtctcgctctgtcacccaggctggagtgcagtggtgcgatctcagctcactgcaacctctgcctcccaggttcaagtgattctcctgcctcagcctcccgagcagctgggactacaggtgcccgccaccacacccagctamtttttgtatttttagtagagacagggtttcactgtgttagccaggatggtctcgatctcctgacctcgtgatctgcccaccctggcctcccaaagtgctgggattacaggcgtgagccactgtgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcct

SEQ ID NO: 145746 - DNA, 601 bp, Human
gtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctccctacagctgcctcatagctttggctcccaagaggtaaggtacaggtagtctggctgcctgcattatcctccagcctcaaaatacatggggaamtgaaaataaacaaactgttgattccttgagcttaagaaggcctcttggtgttcctttataccttttcgagtctctcctaagatcagagagaggagtgaagagggggaaggtgtatggccaaaggaggacttgccctgattgccactggcaaagacgctgagccttagggaccatccagaggcatgcaggacccctgctgcagcattcttgaaaaatgatgtcttcctacgcctccctgactcaaccagaagctcacaggtaagaacacatcccatgttgcgaagctccatctattgtgag

SEQ ID NO: 145747 - DNA, 601 bp, Human
ttttctcatctatccgtatgtactctcccactgctcatcgtgggccccagggaaaggcgattttattcaaagaaggtaactctgaacgtactcagggccgtaatatgtgaaatgtctcccagtgtttgacaaaaagactctcttttcatgttcatattccatggaaatcttaagtcaaagcaacaataaaataagctgacccataagtgcacgtgttgaagaggctcagccaagaaaaactgtttggtagttgctgaaaactggcatctagacctcaaagaggaaatcagaaccaaagtgsagacttgtcccaccagagatggtgggtgttggactgagtcagcgacagtgaggcactgactagacttccgtaaccagccatactttctagtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctcccta

SEQ ID NO: 145748 - DNA, 601 bp, Human
gcaagaggctagacatctctggctggaaaggcactccctgcagatctgggaagccatgagccacaggagcattagctgttcctctaccctttcgtttctttgctggacaatccttataagctggagtccaagttaaccttcccaaatgagtggcactattattttaaaataaaagcgttcaaggtagaggatgactttgggactctggcaacacaggaagcccagtgtgttctccccaaggtcacattaaaaaggtggtgcatctgagatggtgactgctcagaataaagtgataaggggwcaaaaggtggatggcttacttacaggtgttatgaatgagaccatcagggctcgggtaagaacattgtctgggataaatggtttgtggttattgatctggaccaacctgatagaaaagaagctgtgtgtattattattacaatttcttggtttatgcttgcaatttataatttgtatgctcagtcaattctgccaatataaaatagtaatgccccggtttcaaaatctgatattggattttgtcccacgatttagcatgtcctctaagcaaaataactgtccaaccagatcacttgccttc

SEQ ID NO: 145749 - DNA, 601 bp, Human
cttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcccaygcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctctgt

SEQ ID NO: 145750 - DNA, 601 bp, Human
agacttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcycatgcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctc

SEQ ID NO: 145751 - DNA, 601 bp, Human
tttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtggagtgatctcagctcactgcaacctccgcctcccgggttcaagcgatgctcctgcctcagcctcccgagtagctgggactacaggcatgcaccaccatgcctggctaattttttgtatttttagtagacacagcrtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggaccttccaaatttcacaggcctagaggaaagttaagccctggaaatggagttgtgagagcaggctgttttttctctctggtgcgtgaccactgcttcctgatttttgtgttgagatcttagaccttaaccagacttat

SEQ ID NO: 145752 - DNA, 601 bp, Human
cttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtgragtgatctcagctcactgcaacctccgcctcccgggttcaagcgatgctcctgcctcagcctcccgagtagctgggactacaggcatgcaccaccatgcctggctaattttttgtatttttagtagacacagcgtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggacct

SEQ ID NO: 145753 - DNA, 601 bp, Human
gaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgcgacccaaaggggcctggcttgggacctatgcagctgtrggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaacaattcatcctcatctaatttat

SEQ ID NO: 145754 - DNA, 601 bp, Human
ccaggtatctggagcatggggtggtggtggggtggtgggaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgmgacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagc

SEQ ID NO: 145755 - DNA, 601 bp, Human
tcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccaggagtttgagaccagcctgggcaacatggtgaaaccctgtctctataaaaaatataaaacttagctgggtgtggtggcacatgcctatggtcccaggtatctggagcatggggtggtggtggggtggtgggaggatc

SEQ ID NO: 145756 - DNA, 601 bp, Human
tttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggacygtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgcca

SEQ ID NO: 145757 - DNA, 601 bp, Human
atgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtayggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggc

SEQ ID NO: 145758 - DNA, 601 bp, Human
gtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgakcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttt

SEQ ID NO: 145759 - DNA, 601 bp, Human
cgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggytgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatag

SEQ ID NO: 145760 - DNA, 601 bp, Human
gctgcctaattgcagtcattaaggagcctgtgactttaaatgacaaaggtagagatgctggcatcagcagcctgttagcatttaatttacatgaaattcgattcagtgtgcacgaactaactaggaggcgccaggcttaggccttaggcagacaaagagcaaaagtgtgggaggctgggtggggccggtgagctctggagcttctggctcctggactgggggactgggaatcggccaggccaggcccagcgggtgggagctgcagataccacttctccaggacccatcccagggcagcttmatgggatgggcctggctgagtgagcttcctaaggaaatcctcttgcctggaagaggctcccaatcatctgtcaacttgtctttcctatttagcaaacgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttgg

SEQ ID NO: 145761 - DNA, 601 bp, Human
tctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggtggctcatgcttgtaataccagcactttgggaggccaaggcrggtggatcacctgaggtcgggagttcgaggccagcctgaccaacatggaaaaaccccatctctactaaaaatacaaaattagctgggtgtggtggtggtgcatgcctgtaatcccagctacttgggaggctgaggcaggagaattgcttgaacctgggaggcagaggttgcagtgagccaagattataccactgcactccagcctgggtgacagagcaagactccgtctcaaaaaaaaaaaaaaaaaatcagggagtgaagttcctccaacacgcgtggtcttatactatgtcactgtga

SEQ ID NO: 145762 - DNA, 601 bp, Human
cttttattcagaaccattactcagtatgattttaaaatctcgggcttcatcttttggataattcacatgaccttctccttagtgggcgagtacaagaaggcactgaatagcgtgccgttccgcaccaccaagcggaagggcagcactgcttgtatctaaggtggcgacctggaccaagggtggccttcgctgtcttggactggacgggctggactcccagctgaaggtggcttggaatttagctgttccttcggggccccgcttacacaccaacacccatgaatgcttttcaacgaagttrctagaatgcagccgtggagacgaacagcttaccgagagcctctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggt

SEQ ID NO: 145763 - DNA, 601 bp, Human
aggttctgctgccaaggcatcccaggggcctcagggtcccaggaagggccaaggctgcagctgccacctgcctgggggctcctcggccatccggcatcttccctccctccatccctggcctgctgttctgagtctctgagaagagcgtctggcggctggcaaaggggctaccatggaggaatggtcttcaggaagtggataaagctggccctgcctcatgccaatcagcccagcaagcagggaggacatcgccaatgagtttctggttttcacttcagaagttatagagacgatgtaagaygaaatactgttcagtgggctaatgcagccacacgagtgagttttattttcatccctactttaataaacatacatgtgccaagctggctctgaattatttaaaattacagcagtcagaagagagaccttctcaaagtctgtcagaaagatttttaatcatctttaagtaaacttcaatttctctgaaattgaaggagaattatttctccacttcaaaagtcagtacagagccattgaaggggctttccacctcctacgataagtaaaaacataaaatgattagcacaaaaaatacaccatg

SEQ ID NO: 145764 - DNA, 601 bp, Human
gatggggagcactcctagcaggcacagggtaatcagaaaagtgctttggaatcacaaaatgaaaaaacaagtgtcagctgtgggagatgtagaaatgcaaataagtacgaatgcaaataggccggataaatggcagtgtgcaatcacccaaagctctgtttacaacccgaaggcagctccgtctgtaattatctgggcgccattaactgcgtgggagcagctctcaacgggtacaagagagataccaccagaagtgaaatgtcctctctcccgtgatgaagccagatctccgagcgattcyatctacactgaactaaaccggtttgtgccaaagagctagaagtgtacctttggtgaaacaaggaagctagatttttttttattgcttactgcgcatctgaacgtaattcttgccattaattaagaaaacagatgataagagatttggcttcaataaacatgtactgaaagctaccacatcattgagtttaattatgcaagcaatctcgtggggcaggtactatgagctcagatagacttggtcaaggtcgtcccagtagagctgagattcgagcatcagtattttgggcctaggtttttt

SEQ ID NO: 145765 - DNA, 601 bp, Human
aagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttctttyagcagtttcagagtaggctatctcaagctgattgctacagactcaaattttaagtcgcatttctttcagaaacagaaggaaagtcaatctcactttcgaaaagagaaagtaaggtgacccttgtcatagtaacataatgcagcaggtcccaggtgtaacccggaggaaaaggcagacaaggtcctgcgatgccgcagctgaaaggaagctgacgccaacgggcttctcagaagaacaatgactcattagtcccgggctcacggcagatgcggtctcccaacaactggcctccctccaaaa

SEQ ID NO: 145766 - DNA, 601 bp, Human
cctcgtaatccgcccaccttagcctcccaaggtgctgggattacaggcatcagccactgcgcccggctgaattctgttaaattttacatacagcatgtagggcagaagacatactttaaactcataggttttcttactttcactcagaggggaagggaaaacagtacaattcggcaaaataggaaatctaaatctttcaatgcatgggtcatgtggaaaccgagagagagaagaaaatcgaaaaatagatgatggatgttgttaaggaattagtaaaccgttaagtgctctatcattattwgatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttcaga

SEQ ID NO: 145767 - DNA, 601 bp, Human
tgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaggggaagggaaaacagtacaattcggcaaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttc

SEQ ID NO: 145768 - DNA, 601 bp, Human
ttctcctgcctcagcctcctgaggagctagaactacaggcacacaccaccacgcccagctattttttgtatttttagtagagatggggtttcaccatgttggccaagatggtctctatctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaggggaagggaaaacagtacaattcggcraaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggta

SEQ ID NO: 145769 - DNA, 601 bp, Human
caacctccgcctcctgggttcaagtgattctcctgcctcagcctcctgaggagctagaactacaggcacacaccaccacgcccagctattttttgtatttttagtagagatggggtttcaccatgttggccaagatggtctctatctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagargggaagggaaaacagtacaattcggcaaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaata

SEQ ID NO: 145770 - DNA, 601 bp, Human
tgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctccygcctcagcctcctgaggagctagaactacaggcacacaccaccacgcccagctattttttgtatttttagtagagatggggtttcaccatgttggccaagatggtctctatctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaggggaagggaaaacagtacaattcggcaaaatag

SEQ ID NO: 145771 - DNA, 601 bp, Human
ggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattmtcctgcctcagcctcctgaggagctagaactacaggcacacaccaccacgcccagctattttttgtatttttagtagagatggggtttcaccatgttggccaagatggtctctatctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaggggaagggaaaacagtacaattcggcaaa

SEQ ID NO: 145772 - DNA, 601 bp, Human
attggtaaacatttgtttattcttcccttgtaattgacacagtaattatatgagcccacatctatcctcatccgtttaaatacagagctggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctcctgcctcagcctcctgaggagctagaactacaggcacacaccaccacgcccagctattttttgtatttttagtagagatggggtttcaccatgttggccaagatggtctctatctcttgacctcgtaatccgcccaccttagcctcccaaggtgctgggattacaggcatcagccactgcgcccggctgaattctgttaaattttacat

SEQ ID NO: 145773 - DNA, 601 bp, Human
caagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaagtgaagtcgttttgttaatgttgtttataaagaagcactgagcttctactttgtgcagagagctttacaaatattcatatgagctttatgaatatttacaaatattggcgcattaaaaaaataaaatgtgytcattttaaatataataatgtaggtgtcattgctatccccgttttaccattgcagaaatggaatttcagaggtgtcaggggccagctcaaggtcactgatgaatcaggacccgcttatccagctctctctgccttcagagctctcttgacttttctgcatcacttcctttaccaggaatgatatttaaattattccaaaatgtaaaatatagttagttttccaggcagttgtatttatttctggatttttttttccctaaataaaacctgtatctacatgaaaactcctccaggatttcc

SEQ ID NO: 145774 - DNA, 601 bp, Human
tgctgaaggaaattcagtatcattcctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagrtctggtgagacagcatgggaagaaataacacatgggcttttgtgcagctggatataatgaaggtaaattgggtggaattcaaagatttgccagaaaaaagagagatgatttcactctaaaatcattttgcaagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaag

SEQ ID NO: 145775 - DNA, 601 bp, Human
tgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagtagggaaagaaagctctttgaaaagtttaatgcaatttgaaacatgaaaatcttcaaggtcctaaaattggggggcatgctgaaggaaattcagtatcattcctttctgtaatayattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaaataacacatgggc

SEQ ID NO: 145776 - DNA, 601 bp, Human
ctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagtagggaaagaaagctctttgaaaagtttaatgcaatttgaaacatgaaaatcttcaaggtcctaaaattggggggcatgctgaaggaaattcagtatcattyctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaa

SEQ ID NO: 145777 - DNA, 601 bp, Human
ttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagtagggaaagaaagctctttgaaaagtttaaygcaatttgaaacatgaaaatcttcaaggtcctaaaattggggggcatgctgaaggaaattcagtatcattcctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggcca

SEQ ID NO: 145778 - DNA, 601 bp, Human
tttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttagttttctgtgtgcttttttcctctgccattatcccaggctaacgtctacggtgcagggtgagggagggtggcatctgcctgccggctgttggggaatttccctaagtttctgctttgyacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagtagggaaagaaagctc

SEQ ID NO: 145779 - DNA, 601 bp, Human
aaaaaaattgtcagtttttataacactccaggagtttcactttttgctactacttaagcctaggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttagttttctgtgtgcttttttcctctgccattatcccaggctaacgtctacggtgcagggtgagggagggtggcatctgcctgccggctgttggggaatttccctaagtttctgctttgtacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatc

SEQ ID NO: 145780 - DNA, 601 bp, Human
gccgaggcaagcagatcacctgaggtcaggagttcaagacccgcctggccaacatgatgaaaccccatctctgctaaaaatacaaaaattagccaggcgtggtggcacacgtctgtaatcccagctactcgggaggctgagagaggagaattatctgaacccgggaggcagaggttgcagtgagttgagatcacgccattgcattccagcctgggtgacaagagcgaaactccattaaaaaaaaaattgtcagtttttataacactccaggagtttcactttttgctactacttaagcctrggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttagttttctgtgtgcttttttcctctgccattatcccaggctaacgtctacggtgcagggtga

SEQ ID NO: 145781 - DNA, 601 bp, Human
cttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaaggctttgtacatattttcattacagaaatatrtactggatgaccaataaaatattttcaaatataaacacatgttagagaataagagaagtgaaatggactactaggagtatgaggcccgatataaactccctttgataaagaagagcccattcatgtgtttacaaaatgaatgatgtggaccctctggtgtacagattctatttctgtcatttaaaagattgctgtctctcttcttttataaaatatttgtcagtattaggctgagcactgtggctgtcacctgtaatcccagcactttgggaggccgaggcaagcagatcacctgaggtc

SEQ ID NO: 145782 - DNA, 601 bp, Human
tgaatgtattaaatgaagggtttctaaatgcacaaaataaaaggtacaattaatagttattcgtaagatcctcataaaacctttatggcatacttctaaaaaactgaaaaggtaaatcagcgtgccaataatttcatggcaaagggcaaaaaatacttttgcttctaattctttgttcctgaagattttgaaaaataaaaatatgttttgatgatagactatcatgtgattttggcatataactgcaaatgacttttaaaaaatagaatgatactgctaaaagacttcttccattgcaatstacctatttatatgaacaaagttatttagtgcttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaa

SEQ ID NO: 145783 - DNA, 601 bp, Human
agcagataaacattttatgtggttccttttagatgtggtacacattatttaacaaggtagttaaaacctgttttattaaatcatatcataaaatttttattcccagtgcaatcaatactcatattttatattataaagtgtttaatattttccacctcttattaacaacaaattaaaattgtttgctagctgctgagtcagaatattttcttttctttctttctttcttttcttttctttttctttttctttttttttgagatggagtcttgctccattgcccaggctggagtgcaatggygcgatcttggctcactgcaacctccgcctcccgggttcaagagattctcctggctcagcctcccgagtagctgggattacaggcgcctgccaccacaccccgctaatttttgtatttttagtagagacagggtttcaccatattggccaggctggtctcaaactcctgacctcaggcaatccacacccgccttagcctcccaaagtgatgggattacaggcgtgagccactgcatccggcaataatattttctatctatagctatatctacgtttaagcttttcactttcttgacaatgt

SEQ ID NO: 145784 - DNA, 601 bp, Human
ttgcttaacctgttctctcttgggattgtcagtaaatgcactgctcttggggaaaaatgtggtgagagcaaacacagagagaatggataagaaatactgaatgggccgggcgtggtggctcacgcctgtaatcccagcactttggggggccgaggcgggtggatcacgaggtcaggagatcaagaccatcctggctaacacagtgaaaccctgtctctactaaaaatacaaaaaattagcctggcatagtggcgggcgcctgtagtcccagctactcgggaggctgaggcaggagaatggygtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctactaaaactacaaaaaaaattagcacggcacagtggtgcatgcctgtaagcccagctactc

SEQ ID NO: 145785 - DNA, 601 bp, Human
ttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatcccagcactttggggggccgaggcgggtggatcacgaggtcaggagatcaagaccatcctggctaacacagtgaaaccctgtctctactaaaaatacaaaaaattagccyggcatagtggcgggcgcctgtagtcccagctactcgggaggctgaggcaggagaatggtgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctac

SEQ ID NO: 145786 - DNA, 601 bp, Human
cagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatccmagcactttggggggccgaggcgggtggatcacgaggtcaggagatcaagaccatcctggctaacacagtgaaaccctgtctctactaaaaatacaaaaaattagcctggcatagtggcgggcgcctgtagtcccagctactcgggaggctgaggcaggagaatggtgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcgg

SEQ ID NO: 145787 - DNA, 601 bp, Human
gttctcacagggtggtttgaaatggaccagatggcagctgcacatggcatgggttgcattacaggtgtgaggaccctgactttagggaatctgagtcttttataatgggccgtgagcaggcctgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcaytgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatcccagcactttggggggccgaggcgggtggatcacgaggtcaggagatca

SEQ ID NO: 145788 - DNA, 601 bp, Human
ttttaattcttgtcaggaactgtgaaggatccaagattttgctttctttgcaagctaacaagttagtctgctcagttttacggaggccaggagaagaccagaggttcctgggtcagagacaaaggaccatgcattatttacagcaatatcttttttcctgtgctggtttctcaaatcccagttctcacagggtggtttgaaatggaccagatggcagctgcacatggcatgggttgcattacaggtgtgaggaccctgactttagggaatctgagtcttttataatgggccgtgagcaggmctgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaatt

SEQ ID NO: 145789 - DNA, 601 bp, Human
catagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcacggagagacaggcggctgctccgtccatcttckaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctgagtacctctaccttggaaaacctccatcttgtc

SEQ ID NO: 145790 - DNA, 601 bp, Human
cctcaaagccgtgcgcctccatctcagggcaacatagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcayggagagacaggcggctgctccgtccatcttctaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctga

SEQ ID NO: 145791 - DNA, 601 bp, Human
aggattcctgaaaagtgcagtggtctgtcctgtcctccttttagagactaatacccagcctcagttccaacaccgagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaataccyaaaggggcgtgctgaagtacctcagggatatgattctatgctattgtgatggttaatactgagtgtcaacttgattggactgaaggatgcaaagtattgatcatgggtatgtctgtgagggtgttgtcaaaggagattaacatttgagtcagtgggctggggaaggcagacccacccttaatctgagtggacaccatctaatcagctgccagtgtagctaaaatataaagcaggcagaaaaacatgaaaagactagactggcctagcctcccagcctacatctttctcctgtgctggatg

SEQ ID NO: 145792 - DNA, 601 bp, Human
gggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgcagtggtctgtcctgtcctccttttagagactaatacccagcctcagttccaacacygagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaatacccaaaggggcgtgctgaagtacctcagggatatgattctatgctattgtgatggttaatactgagtgtcaacttg

SEQ ID NO: 145793 - DNA, 601 bp, Human
gttgccttacaacacatcaaaaatgcacctcctgaaaggttatcgctgcacccattgcaatcctgatctgaaagttcacagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctrctccccagtcagacatgataaaggtgcctcatcacccactggagaggtgtcttcagggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgc

SEQ ID NO: 145794 - DNA, 601 bp, Human
atgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcayagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctgctccccagtcagacatgataaaggtgcctcatcacccactggagaggtgtcttcagggggaagtcaagattacaacta

SEQ ID NO: 145795 - DNA, 601 bp, Human
tctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgttt

SEQ ID NO: 145796 - DNA, 601 bp, Human
attctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctccttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgt

SEQ ID NO: 145797 - DNA, 601 bp, Human
aggccagccatggtggctcatgtctgtaatcccagcactttcggaggccaaggtgggtggatcatttgagtccaggagttcaaggccagcctggccaacatggcaaaaccctgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaacatgaccactgagttgggtttcagattgcagacacaggaactcagggcattggggccaccttggtctagcaggcttccatttaattactttaacagcaggaaccacaggac

SEQ ID NO: 145798 - DNA, 601 bp, Human
actggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccctgtctctactaaaaatacaaaaattagctaggcatgatggtgggtgcctgtaatcccagctacttgggaggccatggcagragaatcacttgaacccaggagacagtggttgcagtgagccgagatcataccactgcactctggtctgggagacagagggagattctgtctcaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaaca

SEQ ID NO: 145799 - DNA, 601 bp, Human
acacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccstgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaagaattgattttgatttgagcaaacagcaatcatgggtgggccagctctggatcacaagtggttcatggctccacagaaggggcaaagaggaaggcttttatggagtgaac

SEQ ID NO: 145800 - DNA, 601 bp, Human
ctcttgttcctggtctcataggctacacacaaccactatcatctttctccaccatttgtctagaagagggaggggactctgcctaggtctcatcattgtgtatgaattgacagaacagtgcccagtttacaggcagtgctgaacacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaaytgaggcatattaatattaaagagttgatttgaggccagccatggtggctcatgtctgtaatcccagcactttcggaggccaaggtgggtggatcatttgagtccaggagttcaaggccagcctggccaacatggcaaaaccctgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagag

SEQ ID NO: 145801 - DNA, 601 bp, Human
atagatgctctgtttatgcttcattttcttgtttcttttttattccccctttctctgctgaaagaattatgaagaaggaagaaaatttgaaaggaatagaggaaaataggaaggaaaaatagaggaaaaaaggaagaaggaaggaagaaaggaaggcaggcaggcagggagcaaggaaggaagagagaaaaaggaaaaaatgccccagaggcaaatgacatattttcaaagctacttcttctaggctggtaatttcccagtgccctgaccttgcattccagacttcaataaataaacgggratgatgccaatgatcgagacgccaacagcagcccttttctagggctgacatcgactgccacatcactcacagcatgtggaccaaaatatgagacaagctgggcatgcattcagacattttatttgtgtcttttagaaagcatttatatttcctataaatccatttacatgtcagtatcgtagtgagaaatgcacgcactatgagaaggccttgaaacatcaggagctgcagcactcttagagcagacttgacagctgcactgggtgtgagatatcagcatctttaatgtatgccagcctt

SEQ ID NO: 145802 - DNA, 601 bp, Human
gtggcaggatccacataaaacttattagccaaggattctacttagttccagttgaaagcaaaacagtaataacccaaaataaccgactaaggaaacacaaataaaatctttttttttttttttttttgagatggagtctcactctgttgcccacgctggagtgcagtggcatgatctcggctcactgcaacctctgccttctgagttcaagtggttctcctgcttcagcctcccaagcagctgggactacaggcacccaccaccacacccagctacttttcgtatttttagcagagatggsgtttcaccatgttagtcaggctggtcttgaactcctgacctcaagtgatccacctgcctcggcctcccaaagtgctgggattacaggcatgagccactgtgcctggccagacaacacaaataaaatcttgagaaaattaactttacacctatctcctctctttctttgactaacgcctatattctcatagatgctctgtttatgcttcattttcttgtttcttttttattccccctttctctgctgaaagaattatgaagaaggaagaaaatttgaaaggaatagaggaaaataggaagg

SEQ ID NO: 145803 - DNA, 601 bp, Human
agttaggcctggagtttactttctgggtcagaaccaatgtcctgagttcatgcagaaatcacatttgatcttcactaaaaattaagcaggaccagcatgagggtggatagagagtatgttgtatcttctgtagttacagcataacttcctttccccatgtagcattaacgggggaatggaggggactccggagatcacaggaagagtttgttcagatagagacgtttaccccttgaactgtttccaaccctggctgttgtatattattctaaagagactacattagatatttagggaaaarttaaggatagtataaagttagcataagaagaacttttgtgcagggtctacacagaagaaatcacatgaagagtttaaaaagtattttttaaaaagttaaaattttgaaatatgttcttgaaattctggattcagtatagtcagagatttactatcagtggtgttgaagaaattcttggtatattcttcagcaacagagtggctatgataatggaaaaaggttagaatttagtgaatttcagaagtaaagaattttgatagaaaagaacaactgaagttctttggatttctatgtagcatt

SEQ ID NO: 145804 - DNA, 601 bp, Human
gcatggctcatgggcttttggcatgatgaacagtttcctttattttcttttttttctttctttatttatttttgagacaggattctgctctgtcacccaggcgggagtgcaatggtacaataacatctcactgcagcctccactttctgggctcggtgatcctcccacctcagcctcctgagctgggaccacaggcacgcgccaccatgcctggctaatttttgtattatttgtagagagagggtctccctatgttgcccagtctggtttcaaacttctgggctccagtgatttccccccyacatcagcctcagttttctttactttttaaaaattaagatcctgattttacaaatgaagaaagctcaaagatgaagttacatgtccaaggtcacatagctgaagagagaatttgccgggctgctggatcttgttttttccatttgccgtactaaatcatgtgctacaatatttgtggttttcctcaactccacagagcttgcttctctgaaattcctattccttgctaacccctaattttgtatgtgaaccattggagacagggagcacaaaaggacagcaagagagaaagcaataaact

SEQ ID NO: 145805 - DNA, 601 bp, Human
tctttttaactccagtgttggttctttgctctttgaaatcaaaacattctgtattatttctgggattatacccagcaaagtgagaacaggagcttcttttagtaaataaacgtgatcatcttccgccagtaggtgtcactgttcatttagcacaaaccatacccgaaaggcaaggcaattacctcggctaaaataacaagcatgttttctggaaataaaataaccagtaagtactgggaaaaagattattttctttcacaggtgtctccaaatcaaagctgaagtgtgaacaacaattcaytctttctatggcctcccacatagtatttgcttctagagctttagcaccattgtaagaattccttctaaaccatgtttgtacctcagatctaactgcctgaccctataaacattttgcggttgactttgcttataaaatgcattggcattttcacatacaggcggtggagttttctagcgttccagcctaaatcagaaaacaatgtctggtgttgcctacacagaaacaatcgtatatcatagaaaattagaagtgaggcagtaaagcgagtctctgaaaatacgttggatgtaaacacat

SEQ ID NO: 145806 - DNA, 601 bp, Human
aggacagggccctaggcaaagctgagctgggggaatgtagacagacctcctactttccactccaaacctagacgcagactcagtggcccacccaggggcatgagtaatgctgggagctgcaggctggcttcccacgctccctcctgggcctggcccccaggcctggctgactccatggggggcctggcagtatcacagcgcagggctctcaggctgccagcagagcagctgttgtgttttcagctgcttattctcactaaaacttctgataaggccatctggaaaagtattactgtatatyaataaaaatatttaaataaagttacagaatggagagatttactttggaagtattaatatgtaatgagttagacagataacgtgtttgaagcagcctctgccaatctgtttactccacggagagaagaagaacaggtgtgtcaagccaaacatctttccttggcacttgaactgccttacttggagcagctctgacaagcttatttttgtggtggtggttgggggaacccagcatttttagagaagaaaagagcaatcttcactccagaaagtgaatctgtctatattcatgtatcggcct

SEQ ID NO: 145807 - DNA, 601 bp, Human
taacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcgcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatctattgtttcctgtaattgtcacagcagtactcaatacacacattttcacaggcaaggaaactcaggttaaataactttcacaacacattggaaatttaggctgccaattagtcatccctccggcccccctgggttttaacctctaga

SEQ ID NO: 145808 - DNA, 601 bp, Human
cgaggaaggagtaggaggtgtggctatgctagctcatgctcacccctcattcaagctccagacctgggccaagagcaagaagagagcttgcttgtgggtccagagtttctgatggcagcgggtttttgatggcctgtaaagtcatctaacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcrcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatct

SEQ ID NO: 145809 - DNA, 601 bp, Human
gaataaatgtgtgaatgaggcatatatttgctaaacaactcacccaaagtcactccagtgataggcccatcagctctcggcatccaaattcaaacccaggcagaccaacagagagtaatagcaacagagacccgttcttaccagtgacccccgaccagcctcatccgctgctgcctcgcaggagacagtgtcctatatttgctcataaaaaccaggcagggaaaaaggcaagctaccagcttttaatcttattaatatgggccagaaaggatggttcatggttctgaccataagacaaagygcttcaaggcaaggcttgtatcaaccgtgctacggagttgatacacaccgaactgtcacccgtcctcctgcccaggggccttggcgttttgaagactcccccatctagacgtccagcagatgctgagcacccaggagagaggtcagaatgcaggatttgcattgaaagccacgtctattggggaagcagctaaagctctggaatgaggtaccagaaagaagaaaggaagatggaggaaagaactctggagggagatggggccgaggaaggagtaggaggtgtggctatgctagctcatgc

SEQ ID NO: 145810 - DNA, 601 bp, Human
gtcctggtatttattcccagattctgtttagatgcacccgaggccccaggcaaaggtttctgcctgagacagtccttggcctccagccacggcttccgtgccatgtcccaaatgcaaagtgccactctcaaatgttctctgatctcctgttcgaagcaaataacagagtgctaaaatcttatttagaggagtcgtggtagaattatttattcacttctagccttttggctgagactgttttgaaaaatagaaaatggcaggtaattcaggtgtcacccttcaatggcatgtgttcttcttgatgtttcacagctactgcacatctgatgaagaggattttttttaactgagtaaggtcatcttttcctgatgaagccccaaagtgcaaaaggcatgaaaggcacattatgcttctccaccagaggagggtctccgcaggcagggcagccgctgaacagcaccgggagggtctgtagttgccagactctattattgtgggctataaattaagaggcttccgtttcaaatacaaactctctcatcagtcacaggaaattaaatgccttttgaaagggagctaggcataggaggaattcacttt

SEQ ID NO: 145811 - DNA, 601 bp, Human
tctgagctggacacacacagcagcgagaggggaagggcgagctatttcctccattctggtgctcatcgtgggccatgcgttggttacaaggaagcagatggagttggggaaacatggaatggaggatggggaggatgcagggaagagaatcggggtcactgtgagggaggggcaacagtgccatgggaaatgcatcattggtgctcatgacaacggcacgccaaggggcttgatggcagcagcctcaggtatgggcagaacgttgaatcctcagaatgatatgggattccttaaaaccaascaaagcaactcatcacctacccataagaataacagaaagggccactcgatggtttgatcatgtttacaaaatctggctaaacaggaagtttcatcctgaaaccggtttcctcaggtggaaggaaggcagttgactcatcctgcttccctgtagtagattttatttttcagataaaaaacctaatattatcagcggtgatataaaccagtgcagggcctctgggatgctggcaaactctagtttcactgtgaggcaggatttagggcctctgtttttactcatgagaccctggaggctcta

SEQ ID NO: 145812 - DNA, 601 bp, Human
tttcagggagtatttgaaacaggaagattaaattctgtctcatgtgtatcatgaataaaagtgctaagccaggcacagtgacctttcctgtacctgtgctaggatgcaaaagatcataggtgtaggctctgggcagcccgtgcatctgctgggtcagcggtctggcactttttttgagtgtctgctgcccttgaagaaggggatggggaaggattgcataagttgtggcagggggcctggggcaggtgggtggccaggaatctgaatgagagtgaacatgagtgagagtacgagcatgtcycagctggtagcccttgtcccagagctggtggcctgctgtgtcctcctccagtgtatctgggagtggtggttgatgtgagcgccatgctgagccccgctcatacccactgggcccagctctttttcagtcctttcctggcctgggggaagcacgtacaatccctgagctatgaacagtggcaccagcttttaagtaaggatgagggcttcccaaccaactgtaagggggctgctggtttgagcttttcaggtttcacagcaagctcttggtcccctaaggccctgctcctggcagatactc

SEQ ID NO: 145813 - DNA, 601 bp, Human
gctgggattacaggtgtgagccaccacccccggccaggagaacacatttttaaactctgtggtaatggttgagaatactcttcattactacaagcattttggacagaaaatctctgagacgatgacagcattgtgtgttctctaaagcgccaggttataacggccatatgtctccctgagtaggattttccagaagaaattaccaaatggcacacaaaaacgcagtgtgctgacactaatacataaaatgcggaaggacccagtctttccagagtgcccctttctcaggacatagacaagyagctttcctactgacagcacctctcagttcaaaggaaagtggtgtgcttgctggatatttttagattgccagaatgttcagtggaatcacataaggccgtcactataaaaatgaaagcaagcccaaccttggtgtgatgttttgcaataaacagcaatccatggaataagaatttaagacccaatttgaggtcacgtgctgcaaacccagtgttctttcagagtcaggtcgctgttagatgacaaccccttcagcaccggcctgaagaaagcgcaggcccagtggcagtctgccttctgt

SEQ ID NO: 145814 - DNA, 601 bp, Human
acatgtaaaacgtatctagaaagctctacagcaatgagtcaaaaatcccatgtccagccacgtgggattatgtttgttttctaggttttccttttttttttttttttggtacaatttactgacattgtctaatgagtatgtattacttttgtaataataaaaactctttcatttttccacttaacaatattgagggctgatgagcctgtgccatgggtcagggggtcggcgaggctgataccgggagtggacatgtgtggaatgcaagtaggatctgcaggaagaaaacagttgtgggaawgctgttggtggcaagatctgctgtgtatgttttgtccccatacaatgtcactagaaaccattcatgggcattaaaaaagaatccacaatgacatctcttttcattatttcattaaaataaaacattaggaaatagccaatgaaatcttatctaaaatgaggtggactttgcccatttatatgctatccccccaagtaattcacaagcatgcagcaagacttgcagatgctgtattaaggaggccacattttaattttaatttttattttttgagacagagtctcgctctgttgcccaggc

SEQ ID NO: 145815 - DNA, 601 bp, Human
tgtaatcccctcctctgctaacaatagataacctcctttaactgtaactttccactgcctacccaagtcctataaagctgcccctctcctatctcccttcgctgactctctttttggactcagcccacttgcacccaagtgaataaacagctttattgctcacacagagcctgtttggtggtctcttcacatggacaggcttgacaaaagctttaaaaacatgcacatgctttgactctctaacttcctcttctaggaatttttctttttagagaaaagtcaggaacacaggaaaaattcrgccgtgggaaaattatcatcattccgcaagatacacatttacataagtcatggcacaccctgacaaatggtcatcattaaacatggcgttagagaaatgcaaagatgtttgtgacacacaattaagggtgaaaaactggtaaaaaaaaaaaaaaaaaaagcccatcagcataaactcgtctctgttaaaattgcggacatgtgggtttgcgtatacatgtaaaacgtatctagaaagctctacagcaatgagtcaaaaatcccatgtccagccacgtgggattatgtttgttttctaggt

SEQ ID NO: 145816 - DNA, 601 bp, Human
ctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatataygtccagatggcctgcaggagccaagaagtctgaagcagccaaagaaaaaccacaaaagaagtgaaacagccagctcctgccataactgattgaccaaccttatgacattccaccattatgacttgttctggccctgccccaactgatcagttgaccttgtgacattcttctttcggacaatgagtcttatgatctccccaccatgcaccttgtaatcccctcctctgctaacaatagataacctcctttaactgtaactttccactgcctacccaagtcctataaagctgcccctctcct

SEQ ID NO: 145817 - DNA, 601 bp, Human
caaaattataactgctaagagagatgttaatggtaattaatcatgagtgagtcataaatatagaaacgcactgacttgataaataagaaacaatattgcttctcatttggcaaagctgaaaagggaggggctggggaagggggcagctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatastaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatatacgtccagatggcctgcaggagccaagaagtctgaagcagccaaagaaaaaccacaaaagaagtgaaacagccagctcctgccataactgattgaccaaccttatgacattccaccattatgacttgttctggccctgc

SEQ ID NO: 145818 - DNA, 601 bp, Human
gatttatttcaaattaagatcaccaaattatatttacataaaagcctctataatgagtatgctatatttgtcattaaaatgtctttatatttttataaatatggtttcacaattttttacagagtcataatctacatggaaaacaaaaagtcataccaaaattataactgctaagagagatgttaatggtaattaatcatgagtgagtcataaatatagaaacgcactgacttgataaataagaaacaatattgcttctcatttggcaaagctgaaaagggaggggctggggaagggggcrgctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataaccc

SEQ ID NO: 145819 - DNA, 601 bp, Human
caaagcatcatattttgaggtggcatttcctgaactcctgcaaagctgaataacaatggagagtgaagcatcaactgttctcagtgctgggcgcccttcctccctctcgatttagtggcacagactgttagaactgcagggccctcagagagctgatcatctgtagggtagaatactgcccctttttcttctggctctcttaataatattgggacctaatattctatatttttaaaaattgcctaacgacatagatcatggcaaacactaaaaaagcacaaaaaagccagattgttttgawaataacaatgatctaactccttattctttgaaatcccatctctgtgatgagaaccaaattttcaaaaggctaatagctcataaagggccctttactgttgtcctgtggagaaacggaaaaacgctcatggggtcggttattgttccaaatcaaatcattcctttatctcacaagcatttgttgagaggatgcttctctctggcagtgcagggcctcagggcaggagcacgtaatgactctgccccatctctgtgagaatcactctctggagagccacgcttttatcctctgctcctcagc

SEQ ID NO: 145820 - DNA, 601 bp, Human
ctctctactaataaatagctttttggtcccataacatgagagacattctggaagctgtgggggagcaaaagatggcttccctctaccctcccaggttctttggctgggctattgattaaaatggcatataaacagattaacaggagaaagagcatattcaattctgtacacatgagagtcccacagaatatgagactccaagaagggttagatcatggaagcctacagaactatatcctagatacagaaaagaacaggggcttggggattcttgtgagggggaggaggttagaggagggcraggagaggaattgtatggtgaataaaggttgtcttattatgtagataaacaatctctcaggtaataaaagttgtctccgagcagccctgagcagaacaggcagtagtctctccaggcatggtgtccacgtactcatcttccccggctgacacaattccctgggaggggattcacgacaactgagatccatcaattgtatttgcagagaagctagttcagagaaaggccctccccgaatttgctgttccccaagtgtcctctgttaaggagtcagcacaccaaagcatcatattttgaggt

SEQ ID NO: 145821 - DNA, 601 bp, Human
tatcctctcgatatgcatctctgccatgactatcagacaatggtgagagccagaaccacttagagagctgattgtcatcaccgccctgacagtctcagtggcaggccaggctctaaaggctcctctggatgcctgttggccaaagataactcatgcctcgggggtcgtgagcaggaggtgaagccaaatgccttcagtgacctgaaaaatgctatctcccagcaacatgcacaccttgcagtgtcttatgaaattataaaataaaacccagacttataagactcttcccctgcctaagttytctttttctctctcaattttattgctttgctaaggacatagaaagcaaactaattaaatgacagctaaagagcaagtgactgtgtcccagggcggctgagataatgcgcggatctcaggtgagtcgaggaaatgccacagacattgctgcctctctactaataaatagctttttggtcccataacatgagagacattctggaagctgtgggggagcaaaagatggcttccctctaccctcccaggttctttggctgggctattgattaaaatggcatataaacagattaacaggagaaag

SEQ ID NO: 145822 - DNA, 601 bp, Human
ctgcagtcaccatccttcaagtccatgggtgacctgatttttctggatgccagacaagaacttggaatatggaaagctgtcacactggccctctgcccttgcaaaaaggcagagggtccactgagctgtttaacacttaagctgtctgcagacagcaaaattaaaagagcgcactgtaacacacagctaactgggctttgggagtcacaggcacccatccctagacactactgtggggccagagcccagaagtgctcgtcctggctcctgcacctgctcatctgcatgctccccctcccayaaggagtttgagcagtggtggtggctgaactgatgagccatatgcctgttgcatgtcctgcaaccggggtgggtcagggaactctcccgtttcagcagtaagaagaggaaggtgaactgggaccaatggagtttgctggaaatgatagcccccagaaagtaccaatcccagtgctagggatgatgccagcattctagtgtaattcactctgctagtgtaattctgcaacacttttgtctttttgattttgaaaccaccgtgaaaggatacagcctagaacagtgctgtccaattgaaaca

SEQ ID NO: 145823 - DNA, 601 bp, Human
taggtgccctgcaggtatacctgttctggcccctttcccctgcagcctcagccaaaatgatcaaggtgttttcttcccaagccctgtttcttactcatacctctattaaactgtttcaccctctatatgaaactgtctccacctatctcctcttctaaagggataggatttgtatcttattcatctttgtcttcccaagatccaggtgctagaacatagtaggtgatcagtgtctctttgtggcaatccaggtgctggagtcaagtagcttacagctaaggtggatgtttataaagcataraagagctgaaggacaattgtgtactccatgatacaatgcacaatcatgggttgaattgagtattcttgtgtaagtcttaagggtcccatagaagagatccaggcgggttgaggtcagtgggtaagagcacgtggagatagcatttgtttttctgcccttcacatttgccccttcagggagcattctaacatcaagcttaattgactgcctctcttctaacaacttctcaaaatctattccacccttcccaactcctcttttaagatgcactttgcctattgcatatttccatttggatag

SEQ ID NO: 145824 - DNA, 601 bp, Human
ctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcagctttgcagacttggctctcagtgacgcttgccaggtgacctgactgcagcagtctgccagaggacaggggaagctggggtgggagtgctgtatgctctcggtccctaatcccccgcytcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgttcatctaaacaaacttcttggcgggcaaatttcaatatctaactgagaattccctttaccatcctgcaaggcctgcccaattttgctttaaaatgagcatttctcagaccttatggag

SEQ ID NO: 145825 - DNA, 601 bp, Human
cctagccaaagcaattactctgaccacgtttaagtcttgtctacacagccaaagctgggtcaggagtggcctgtggtcaggctcactctgactttcctcagctcaacacacatggagctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcakctttgcagacttggctctcagtgacgcttgccaggtgacctgactgcagcagtctgccagaggacaggggaagctggggtgggagtgctgtatgctctcggtccctaatcccccgcttcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgtt

SEQ ID NO: 145826 - DNA, 601 bp, Human
tgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttrttttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccctgaaaccgtgtaagccacttccttccagtaaatctctccatatatctgtgtatacacagatatatagatacaatgtgtgcctgcatgtatatatatgtaggga

SEQ ID NO: 145827 - DNA, 601 bp, Human
ctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtaytaacttggctaggctatggtcctcagttactcaagcagacactaatcttggtgtttctgtgaagctttcttgtagatgtgactaggatctataatcagtttattttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccct

SEQ ID NO: 145828 - DNA, 601 bp, Human
tccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttattttaagtaagagagattatcctagataacctgaagggggctgattcaatc

SEQ ID NO: 145829 - DNA, 601 bp, Human
ctgtttctagagaaaaagcttgccggggaagaaagcagacctagctccaacattttcacatccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattrtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctata

SEQ ID NO: 145830 - DNA, 601 bp, Human
tggctaatttgcttctattcaaagtataatttaaatttagatctatcatgcagtggtccttcccaattaagtaacatgaatctgtctcatgtgcaatgtagaaggtctgatttgatcttgaaaatgtttgggttttcaattacattatccaggactcaagactctcaaccttcagttctcacactacgcaccagagtgccctgcggtactgtaacaaactcacaggggtgcctgggatattctagaattttaagtaaaacacagcatggctattgaacactatgtgatttattaactcaargtagttcccagtgttaatgtagattgtgctattttccttttggtgacattgtatctttgcaaaggtgggcttttggaagttaccagaatagaaaacaaataccatgtaaacatccatttggaacaaagatgtgatttatttatttatttatttattgagacagagtcttgctctgttgcccaggctggagtgcagtggcaccatctcggctcactgcaacctccgcctcccgggttcaagcaattctcccgtctcagcctcctgagtagctgggactacaggcgcctgccaccacgcccg

SEQ ID NO: 145831 - DNA, 601 bp, Human
gataggtggaagcaggacctcagaaagtaactgtatttggagacagggcctttaaagtggtaaagggaagatgaggttgttaggggaggccttcttcaatctgactggtgtccttacaagatgaggagattaggacagagacacacggactgagagatgatgagcagcattcaccatgggactgaagacgcccaaggaaccaatgccctctacccgccatcgtacaaagaagaaagctggaagagtgaatgccagagaggctcgtttagggctgtctgtctgggatccatggacctctccygaaagcacgtcccattctcatcgccaccagccatgctctgaagttactgtcacggttgagttgtggatcagcagtggaacacaccagactggagtcatcatcccatcccctgccacctgaaacaccttgggaaagccaccttggtttctgtgccttggtttccaccttggaaatgctaggataacagcgatagctttctcatatgacccctgggagaggtagtgagatagcacatgctgagtggctacaatcacagcatacaatgtgttctaaactttaaggagataagaacaacaggga

SEQ ID NO: 145832 - DNA, 601 bp, Human
attcctctggcttgtgcaacagtttctgtataaaaatactttttttgcaaagagaaatcaagttatgttttgatgggattgttcactctttactcaagagtgttccaagcaccatagcagggctacagagatgatgggtcacatttccttccctcaagatgtttccagtctagtggaagacacagtgatatggtttggctgtgtccccacccaaatctcatcttgaattgtagttcccataatccccatgtgtcatgggaaagacctggtgggaggtaattgaatcatggggatgatttcycccatgctattcttgtgatagtgagtgagttctcacgagatctgacggttttacaatgggcttcccccttcgctcagctctcattcttctccttcctgccaccatgtgaagaaggatgtgtttgcttccccttccaccatgattgtgaatttcctgaggcctactcagccctgcacaaatgtgaatcaattgaacctctttcctttataaattatccagtctcgggtatgtccttatagcagtgtgagaacagactaatacacacagtaatgcaaataaatacccacagcaaagtttaat

SEQ ID NO: 145833 - DNA, 601 bp, Human
agacacagttcccccgatgctggacatctatggtttaggtcatctctaactttctttttcctatttttctgaatccaatattaaggttttaacaatttaaaaacatttaatttgggctaccttaatctttaacaccaaggctggatggttcctcttgactgaagaatgaatgggattagagggagggtcaggcgcctggatggctttaggttaagcaatgctcttctttcccttacagctactgtttccaaataaatactgtagatgccagagtatcactttgtggaagcctctgccatgyttgcagtctcagagcatatggatgtaaattgctagactaactccgtttcccagagcctcaggtatacccgcctccattacagcggtcctgaggcaggggtctctgggccattattgcttttgctgtcagtacctggtaagctcgcgtttgaatgtccctgagctaaaataaaattaacagaaagagcatttgctgcctgggctatggaaatggcaactcagtcctaaatccactcatatgctcatggctggcaatttaggagcagacgagaagacccaaattcaccagttctatttattt

SEQ ID NO: 145834 - DNA, 601 bp, Human
aaagcagctatggttgaaataaggaaacttgggaagattggtaaattcgctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggycccttctccatggctgcagctcatggggttcatgggactcttcctccccctgcctttacaggcctggggtggtcatggctccccagtgatgctcgctctgaggccctcagccctgtgatggttcctgtgtccccagcccgcctctgcaggtcatccctttcattaacatctcctcctgtgcccatctgggttggcttctctctcccgagggaccctgaccgaatcagagacgtaggaaaacatggcagcaaagaccccaattagttgctttccgttgtctggcaactgttcaccagcaga

SEQ ID NO: 145835 - DNA, 601 bp, Human
agccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataaaagcccttcattctgttatcaaatcgaattgggtcatgaaatttgaagaaatagcttgtttggttcgtgccttcccacatccaaaagcagctatggttgaaataaggaaacttgggaagattggtaaattcrctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggccccttctccatggctgcagctcatggggttcatgggactcttcctccc

SEQ ID NO: 145836 - DNA, 601 bp, Human
gaacaagcagggaaaaacaaggaaagcaaacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaaygctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagcca

SEQ ID NO: 145837 - DNA, 601 bp, Human
gccactgaaattgatctcttctgcggctttagagagcaccactaaaaatctggaagtctcagtctgcactcctgctgaatagggagaggaacatcaactacctagaaccagtttatgtggcttttgcaagagcaagtgtgtagttattagcaagcctccaggggcaatacgcggaaggaactggaacacggggaggagaacaagcagggaaaaacaaggaaagcaaacgggactggactctcgttagtctgtgatggattgatcttctgtcactgctttcccaaactcccagcagtttcawcgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggta

SEQ ID NO: 145838 - DNA, 601 bp, Human
gggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaatmaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaattg

SEQ ID NO: 145839 - DNA, 601 bp, Human
cgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaawcaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaatt

SEQ ID NO: 145840 - DNA, 601 bp, Human
tacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaaggagggatttgtcattcattcaacaaacacttaatgagcacctactctgtgccaggcactgcaggatacaggatgygacaggcacaaaccctccactaacaaagcccagactttttaggccgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctggg

SEQ ID NO: 145841 - DNA, 601 bp, Human
tgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggacaaartctatcacaaaaacttgagataagcctcagaataagatggtgtacgtgaaagtgctttgtaatcaagcacgatacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaagga

SEQ ID NO: 145842 - DNA, 601 bp, Human
atgctactgacatcacaaaatcacactggaaggcctggtaccattgggctcacatttctgctgggtaaacatggacctgaactggggagctgtgtagcaggtgtctccccaacaccccacaacaagccatgcccactccagtttgccacagaccacccccacccgccccagcatggggctatgtgtcattatgcttgcaggcttttgtgttgatgtgtttttgttgttctgtttgttttaataggaaaagcagaagaaaatgaaatttatctttgcatccttatcaaaatattgacaggtycatgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggaca

SEQ ID NO: 145843 - DNA, 601 bp, Human
ggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacacyccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgagatttacactctgaatcaacaactaccatggtgcaggg

SEQ ID NO: 145844 - DNA, 601 bp, Human
atgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcakgtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgaga

SEQ ID NO: 145845 - DNA, 601 bp, Human
caaacgtcttggcagcctctttaagggcagggacagagaaaatctggaagactgaggacaggtaagacaaggagctctgcagagcaggcacgtggacagacccatgggaggggcaggacatgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctygggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaaca

SEQ ID NO: 145846 - DNA, 601 bp, Human
gtggccgggctggggagattccttatgacacactgagggatccaagcttggttcacaattgagttagcttaacatacggctgcaagccaaaaatgcactgtcgctatcctgtaatcctctttagggttgaaagagtggtgaggggagaccctgtcaataagcagagccttgggcaacgcaactgctatggtccgagtgtttgtgtctccccagattcctatgtcgaaacctaatcaccaaggcggtgggattaggaggtgaggcctttgcaaggtgattgggtcataagtcagagccctcrggaatgggattagtgcccttataaagagagggcattaaccagtcacctctcatcctgtgaggccccagagagctgtcttgccccttctaccatgtgagggtatagctagaagacgtcatctacaaaccaaaaagtggtccctcatgagaccccaaatctgctagtgcattcatctttgacttctgagcctccagaactggaaggaataaatgtgtgttgtttataagccagccagtctacggtattgagtgacagcagcccaaacagatgaggcagcagctgacagtggactgtgtgtgg

SEQ ID NO: 145847 - DNA, 601 bp, Human
tgtgcttacaggggtgctgagtttaaacgagctatgcctctgtgtttgcaggggtgctgagtttaaatgtgctatacctctgtgctttgcaggggtgatgagttaaatggccatgcctctgtgcttgcaggggtgatgagttaaatgggctacacctctgtgcttgcggggtgctgagtttaaacgggctatgcctctgtgcttgcaaggaacaagtgtagagcaggtgaaccgttttcctcacacatggtcaacatgcttttctgtggagtgacaatattttgtcccccctgccagcccygtttttaatgaaggaattatgggggccaggatccagctgttagcttttcaaatctgcacacctctcagaaatgctcctcctggggacacagtccttcgattccctcttgcctgttgtcggctgggccactatgcaggcgtggctggggtgcctttcaaagtggcgttcactcccttttcccccaggtcattttatttttgtttctggacaaatccagcattttccttaagggtttagcgccatctggtgcatcagaggcgcactgcagctgcttccctcctgatactgagtggggtgtgc

SEQ ID NO: 145848 - DNA, 601 bp, Human
cctggggatacatcccagtaaacaagagagatgacaaatagcaagccaacaatccctgccttgtggagcttccccattagcagaacggcggctctcagaccagcggcaccggaagcgcttgtgctgtggctcccccactacccctctgggtctgaatccataggtctgggattgcgctcaaggactggcagttcaacaaattcctaggtgatgccgatgtcgctagcctgcagagcttcggagaactactgctcgcagaaggtctacatacactgtggtcaacaaagacagagagaccctwttttttttttttttttttttttgagacagggtctcactctgttgcccaggctggagtgctgtggcaagatcatagctcactctagcctggaaatcctgggctctcgagtagctgggactacaggcacatgcttctgtcctctgctgatctttaaaaaatattttttgtagagatggggtctcactttgttgcccaggctggtttcgaattcttagcttcaagtgatcctcccaccctggcctcccaaagtgtggggctgccggtgtgaaccaccacactcggtagggcagaatttttctc

SEQ ID NO: 145849 - DNA, 601 bp, Human
gagtggaatgtgtgccaagtgccacagacgagatcttacagagtcttgccccatggggccctaaatgcttcctaaaggggaagtgaattaaaataatatctatcaacctattttgagattaatgggggaaatggaacaacataaatattaagtagcagaattattaataggtaccatttattggttattttaaaagtgctttgtgttcaactattgttacaagttgacatatgggaaaaatctacacttgagctagaaaatatgctgatttgtatttttgataatgacattctctagtttktggttggcttaggtcagcagtgaccaaaattatccacatagatgggattctgaatgcggaatcatcactaataggatgtgagaggggtcaaagccgaccacagagcctaccttttgtgcaaagtatagttattctggcacaaagtagactattatttttgctagagtgaatgcagaaatattttcattcaagaaacatgtgttgggtgtctaagatgtgccaggcactgtcctggaccctggggatacatcccagtaaacaagagagatgacaaatagcaagccaacaatccctgccttg

SEQ ID NO: 145850 - DNA, 601 bp, Human
gagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttttaagagaaatcatcagagtgttgggatttaatggggtgtctagccaagggctccggggaatacaaggctacactgtaagcaatacaaggctactccactaagctccaaactccccaagccatgctttagaatgcaattcagaagggcatttgtttttatttatttatctatttttgagacggagttttgctctgtcacctaggctggagtgcaatgacacaatctcggctcactacaacctccacctcctgggttcaagcgattctcatgcctcagcctcctgagtagctgggattacagg

SEQ ID NO: 145851 - DNA, 601 bp, Human
atcaacgctcgcctctcttctcacaaacactgaaaccttccacctttgcagacagcagccttcctggctcagtcaagcaggtgggccagttgagcactgctgcgtgtgagcagcccgcctcctgctggtgagtaagaaaatggcatcacttttcaggggccttgagctagtcaacgttactgcttggcaacgggtgtcaccaaaacatgttttgttgttctcacattgtcttatgactatctctttttggagaatatgtatatatgtatatatttaaatgtattttgttatttttttttttgagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttt

SEQ ID NO: 145852 - DNA, 601 bp, Human
acctgtaatcccagcactttgggaggccgaggcgggtggatcacgaggtcagatcaaaccatcctggctaacacgatgaaaccccatctctactcaaaatacaaaaaaaaaaaaaaaaaattagccgggcgtggtggcaggcacctgtagtcccacctacttgggaggctgagatgggagaatgacgtgaacctgggaggcagagcttgcagtgagccgagatcgcgccactgcactccagcctgggcgacagagcaagactctgtgtcaaaaaaaaaaaaaaaaaaaagccgaattagcrcctaggagacacattgatatacattgaagctagaataacttaaggaactgcatatgtgttatctttcctgctttaagagaaactcatttgtgacacctgtgtagccaataattagacaagtctattctaatcctaaaaatccatttaagcctgttttccaaaaaagagcagttgtcattaatcatgaaaacagagttggcttaattcagctatgaatgctttcaggtgaatgacagcttttaaatgtcagctttctcatcaacgctcgcctctcttctcacaaacactgaaaccttccac

SEQ ID NO: 145853 - DNA, 601 bp, Human
ataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaatcatcaygatcatctctaaagagatgggaatatgaccctgtgggagtttgtacacatggaaaagaccactgaaggcctggattggccttaaatctcctttaaaaacacaagtatgggaggccgaggcaggaggaacacttgagtctaggagttcaaggccagactggtcaatataatgagaccctgtctctataaacacacacacacacacaaaactccactggtaaatcaaaatgtacttatataggttttaaaagctgaattaggctgggcacggtggctcacacctgtaatcccagcactttgg

SEQ ID NO: 145854 - DNA, 601 bp, Human
ctgggtaacttaccctctgttcccgccttagtcatcaagctctaaagcaatgcctgcttattgtgttgccaggaggggaaggttttgttgtgattcagcatcaccgcccgattgtgcaataaagtgtggctctcacggggcagtgtaactgttaggtaattgcatagaattctgtgcctgtctactgctcacccgtggcaggaggaattgcatgcatgcatgtgtgtacgcacgcgtggtggaggtgggggtggaacaggacaagtctctctcctaatatacttcatggctgaaaatagcratttcataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaat

SEQ ID NO: 145855 - DNA, 601 bp, Human
tcccttccccaacctgccgaaagtgctttcaagaaggacaccaggaggccacggctgccaaagctcatgccctttctttgtcattgtctccaactgtcccactgcacctaacatgtgggaaagggtcaccaagaaggcccttggagttcctgcccttctcagcatcacagctcttcctgtgcttcctatcctcacccagcggatccacggggagggaggggagtcccagacccagtgactgctgccactgctgccagccccagggacctggggggcaggagaagcagctctatgacacccygggagtgggcggtgcccaggccactggtttagacctttgactgccacttccgagaggggatttctaccaggaggagcacatctttgctttgcatccttcatgagtgtcttaatgctgatgtttaaatccttctggagtgatctcaagcagtggctgggtgcccacaggttcaagatcaccaaagcgattctaaaaatgatcccaaggcttgtgtccagactctggagattgggattcagtaggtctgtggcggggtacagaaattagaatccctaaaaatgccctaaggggttgcgaggg

SEQ ID NO: 145856 - DNA, 601 bp, Human
acttatctgggaggccttgtctgcaagaggagcactcaggggctgaagtttctggctcaggtgtgtgcacacctaaagcctttgttacatgttgccaagttaagagcattttcaactgggcgaatacaatgtttattctaacaaaggatgttatactcagcccaagagaaagattcagagctcaacttgaagaaacctcctgcctgtcaatagcacattactggagaggaattacaaactggaaaattgcaaatttatattaatatgctttgttctgtccaggaagaaagattaaagttayagcaaaagaagagaaataattacttttcaaaataccaattttctctgacttccgatcccccgagcacacaaggcagagtgggtataacttgcaggcccaccagaaagccactaggatttccccaaacggctctggatgtaacacctccagcagcaagcgtccttcaaatcaggacactgcaagtttaatacctaggagtgattacaaaagactacccgtgtaaacatttccacactagtgtgcactgagctactggatgggccagttcactcaggggagagggaggtagctaggagggtt

SEQ ID NO: 145857 - DNA, 601 bp, Human
ggaaaagtccagaaggagccaggagctgcaagaagaaactgtgagaaaagaaaaagaaaatgggtaacgtatggtaaatcacaggaaatactgattgtctaaaactgtaaacgatgcttaatttgctggttaaaaaaaaaaaatccaagtaggctgtgtgtggtggctcacgcctgtaatcctagcactttgcgaggccaaggcgggtggatcatctgaggtcaggagttcaagatcagcctggccaacacagcgaaaccgtctctactaaaaatacaaaaagtagctgggtgtggtgccyacactactcgaaaggctgaggcaggagaattgcttgaacctgggaggtggaggttgcagtgagccgagatggtgccagtacactccagcctgggcaacggagtgagactttgtctcaaaaaaaaaaaaaatcagagtagaactagatgccggacaagaatagcacagaagtgtgagaattggatgattctaatgtgctggcatgattcaggcagagggtccttagatttttttacattaatatatgtttacattctagggtaatcaatacaagagaaagcaatttgcttctaaacaagga

SEQ ID NO: 145858 - DNA, 601 bp, Human
acagtggtgggggcaccacagacaagctttgcctagggctggtcactgggtgaagccaatttcgtttctgttaatgagccatcatgggcacaaaggaaacacccttgagaactgccagggtgtcacgtgatttgtgaatactttgctagaataacgtggagtcagctgctcggaggcaacggtaggtcaatgagtgcttcctttgctaagatccactcacggcagaggcccagtgagggcgctgtggttagtgagggccatttcacaacttggtaactaggtatgcatcttcatggcacgycttccagtcaccacagagtcttgggtggtcctaaccgtcagtgacacgtggcaaacacccatccccccaccgacctgcaccccaacgccaccccggcctcatgttccacgctgttctttttcaggtctagggctctgtagctctgcagcaatggtttagattgcttgttggtggcaagttggtaagtcatacaaattggagaaaaatacaattttacttatcagaaaataatttcaaaatgccattttttagcaacatggcatactgcatgtgaagggcaatttctcccaggtccacaca

SEQ ID NO: 145859 - DNA, 601 bp, Human; identical to SEQ ID NO: 30522

SEQ ID NO: 145860 - DNA, 601 bp, Human; identical to SEQ ID NO: 30523

SEQ ID NO: 145861 - DNA, 601 bp, Human; identical to SEQ ID NO: 30524

SEQ ID NO: 145862 - DNA, 601 bp, Human; identical to SEQ ID NO: 30525

SEQ ID NO: 145863 - DNA, 601 bp, Human; identical to SEQ ID NO: 30526

SEQ ID NO: 145864 - DNA, 601 bp, Human; identical to SEQ ID NO: 30527

SEQ ID NO: 145865 - DNA, 601 bp, Human; identical to SEQ ID NO: 30528

SEQ ID NO: 145866 - DNA, 601 bp, Human; identical to SEQ ID NO: 30529

SEQ ID NO: 145867 - DNA, 601 bp, Human; identical to SEQ ID NO: 30530

SEQ ID NO: 145868 - DNA, 601 bp, Human; identical to SEQ ID NO: 30531

SEQ ID NO: 145869 - DNA, 601 bp, Human; identical to SEQ ID NO: 30532

SEQ ID NO: 145870 - DNA, 601 bp, Human; identical to SEQ ID NO: 30533

SEQ ID NO: 145871 - DNA, 601 bp, Human; identical to SEQ ID NO: 30534

SEQ ID NO: 145872 - DNA, 601 bp, Human; identical to SEQ ID NO: 30535

SEQ ID NO: 145873 - DNA, 601 bp, Human; identical to SEQ ID NO: 145605

SEQ ID NO: 145874 - DNA, 601 bp, Human; identical to SEQ ID NO: 145606

SEQ ID NO: 145875 - DNA, 601 bp, Human; identical to SEQ ID NO: 145607

SEQ ID NO: 145876 - DNA, 601 bp, Human; identical to SEQ ID NO: 145608

SEQ ID NO: 145877 - DNA, 601 bp, Human; identical to SEQ ID NO: 145609

SEQ ID NO: 145878 - DNA, 601 bp, Human; identical to SEQ ID NO: 145610

SEQ ID NO: 145879 - DNA, 601 bp, Human; identical to SEQ ID NO: 145611

SEQ ID NO: 145880 - DNA, 601 bp, Human; identical to SEQ ID NO: 145612

SEQ ID NO: 145881 - DNA, 601 bp, Human; identical to SEQ ID NO: 145613

SEQ ID NO: 145882 - DNA, 601 bp, Human; identical to SEQ ID NO: 145614

SEQ ID NO: 145883 - DNA, 601 bp, Human; identical to SEQ ID NO: 145615

SEQ ID NO: 145884 - DNA, 601 bp, Human; identical to SEQ ID NO: 145616

SEQ ID NO: 145885 - DNA, 601 bp, Human; identical to SEQ ID NO: 145617

SEQ ID NO: 145886 - DNA, 601 bp, Human; identical to SEQ ID NO: 145618

SEQ ID NO: 145887 - DNA, 601 bp, Human; identical to SEQ ID NO: 145619

SEQ ID NO: 145888 - DNA, 601 bp, Human; identical to SEQ ID NO: 145620

SEQ ID NO: 145889 - DNA, 601 bp, Human; identical to SEQ ID NO: 145621

SEQ ID NO: 145890 - DNA, 601 bp, Human; identical to SEQ ID NO: 145622

SEQ ID NO: 145891 - DNA, 601 bp, Human; identical to SEQ ID NO: 145623

SEQ ID NO: 145892 - DNA, 601 bp, Human; identical to SEQ ID NO: 145624

SEQ ID NO: 145893 - DNA, 601 bp, Human; identical to SEQ ID NO: 145625

SEQ ID NO: 145894 - DNA, 601 bp, Human; identical to SEQ ID NO: 145626

SEQ ID NO: 145895 - DNA, 601 bp, Human; identical to SEQ ID NO: 145627

SEQ ID NO: 145896 - DNA, 601 bp, Human; identical to SEQ ID NO: 145628

SEQ ID NO: 145897 - DNA, 601 bp, Human; identical to SEQ ID NO: 145629

SEQ ID NO: 145898 - DNA, 601 bp, Human; identical to SEQ ID NO: 145630

SEQ ID NO: 145899 - DNA, 601 bp, Human; identical to SEQ ID NO: 145631

SEQ ID NO: 145900 - DNA, 601 bp, Human; identical to SEQ ID NO: 145632

SEQ ID NO: 145901 - DNA, 601 bp, Human; identical to SEQ ID NO: 145633

SEQ ID NO: 145902 - DNA, 601 bp, Human; identical to SEQ ID NO: 145634

SEQ ID NO: 145903 - DNA, 601 bp, Human; identical to SEQ ID NO: 145635

SEQ ID NO: 145904 - DNA, 601 bp, Human; identical to SEQ ID NO: 145636

SEQ ID NO: 145905 - DNA, 601 bp, Human; identical to SEQ ID NO: 145637

SEQ ID NO: 145906 - DNA, 601 bp, Human; identical to SEQ ID NO: 145638

SEQ ID NO: 145907 - DNA, 601 bp, Human; identical to SEQ ID NO: 145639

SEQ ID NO: 145908 - DNA, 601 bp, Human; identical to SEQ ID NO: 145640

SEQ ID NO: 145909 - DNA, 601 bp, Human; identical to SEQ ID NO: 145641

SEQ ID NO: 145910 - DNA, 601 bp, Human; identical to SEQ ID NO: 145642

SEQ ID NO: 145911 - DNA, 601 bp, Human; identical to SEQ ID NO: 145643

SEQ ID NO: 145912 - DNA, 601 bp, Human; identical to SEQ ID NO: 145644

SEQ ID NO: 145913 - DNA, 601 bp, Human; identical to SEQ ID NO: 145645

SEQ ID NO: 145914 - DNA, 601 bp, Human; identical to SEQ ID NO: 145646

SEQ ID NO: 145915 - DNA, 601 bp, Human; identical to SEQ ID NO: 145647

SEQ ID NO: 145916 - DNA, 601 bp, Human; identical to SEQ ID NO: 145648

SEQ ID NO: 145917 - DNA, 601 bp, Human; identical to SEQ ID NO: 145649

SEQ ID NO: 145918 - DNA, 601 bp, Human; identical to SEQ ID NO: 145650

SEQ ID NO: 145919 - DNA, 601 bp, Human; identical to SEQ ID NO: 145651

SEQ ID NO: 145920 - DNA, 601 bp, Human; identical to SEQ ID NO: 145652

SEQ ID NO: 145921 - DNA, 601 bp, Human; identical to SEQ ID NO: 145653

SEQ ID NO: 145922 - DNA, 601 bp, Human; identical to SEQ ID NO: 145654

SEQ ID NO: 145923 - DNA, 601 bp, Human; identical to SEQ ID NO: 145655

SEQ ID NO: 145924 - DNA, 601 bp, Human; identical to SEQ ID NO: 145656

SEQ ID NO: 145925 - DNA, 601 bp, Human; identical to SEQ ID NO: 145657

SEQ ID NO: 145926 - DNA, 601 bp, Human; identical to SEQ ID NO: 145658

SEQ ID NO: 145927 - DNA, 601 bp, Human; identical to SEQ ID NO: 145659

SEQ ID NO: 145928 - DNA, 601 bp, Human; identical to SEQ ID NO: 145660

SEQ ID NO: 145929 - DNA, 601 bp, Human; identical to SEQ ID NO: 145661

SEQ ID NO: 145930 - DNA, 601 bp, Human; identical to SEQ ID NO: 145662

SEQ ID NO: 145931 - DNA, 601 bp, Human; identical to SEQ ID NO: 145663

SEQ ID NO: 145932 - DNA, 601 bp, Human; identical to SEQ ID NO: 145664

SEQ ID NO: 145933 - DNA, 601 bp, Human; identical to SEQ ID NO: 145665

SEQ ID NO: 145934 - DNA, 601 bp, Human; identical to SEQ ID NO: 145666

SEQ ID NO: 145935 - DNA, 601 bp, Human; identical to SEQ ID NO: 145667

SEQ ID NO: 145936 - DNA, 601 bp, Human; identical to SEQ ID NO: 145668

SEQ ID NO: 145937 - DNA, 601 bp, Human; identical to SEQ ID NO: 145669

SEQ ID NO: 145938 - DNA, 601 bp, Human; identical to SEQ ID NO: 145670

SEQ ID NO: 145939 - DNA, 601 bp, Human; identical to SEQ ID NO: 145671

SEQ ID NO: 145940 - DNA, 601 bp, Human; identical to SEQ ID NO: 145672

SEQ ID NO: 145941 - DNA, 601 bp, Human; identical to SEQ ID NO: 145673

SEQ ID NO: 145942 - DNA, 601 bp, Human; identical to SEQ ID NO: 145674

SEQ ID NO: 145943 - DNA, 601 bp, Human; identical to SEQ ID NO: 145675

SEQ ID NO: 145944 - DNA, 601 bp, Human; identical to SEQ ID NO: 145676

SEQ ID NO: 145945 - DNA, 601 bp, Human; identical to SEQ ID NO: 145677

SEQ ID NO: 145946 - DNA, 601 bp, Human; identical to SEQ ID NO: 145678

SEQ ID NO: 145947 - DNA, 601 bp, Human; identical to SEQ ID NO: 145679

SEQ ID NO: 145948 - DNA, 601 bp, Human; identical to SEQ ID NO: 145680

SEQ ID NO: 145949 - DNA, 601 bp, Human; identical to SEQ ID NO: 145681

SEQ ID NO: 145950 - DNA, 601 bp, Human; identical to SEQ ID NO: 145682

SEQ ID NO: 145951 - DNA, 601 bp, Human; identical to SEQ ID NO: 145683

SEQ ID NO: 145952 - DNA, 601 bp, Human; identical to SEQ ID NO: 145684

SEQ ID NO: 145953 - DNA, 601 bp, Human; identical to SEQ ID NO: 145685

SEQ ID NO: 145954 - DNA, 601 bp, Human; identical to SEQ ID NO: 145686

SEQ ID NO: 145955 - DNA, 601 bp, Human; identical to SEQ ID NO: 145687

SEQ ID NO: 145956 - DNA, 601 bp, Human; identical to SEQ ID NO: 145688

SEQ ID NO: 145957 - DNA, 601 bp, Human; identical to SEQ ID NO: 145689

SEQ ID NO: 145958 - DNA, 601 bp, Human; identical to SEQ ID NO: 145690

SEQ ID NO: 145959 - DNA, 601 bp, Human; identical to SEQ ID NO: 145691

SEQ ID NO: 145960 - DNA, 601 bp, Human; identical to SEQ ID NO: 145692

SEQ ID NO: 145961 - DNA, 601 bp, Human; identical to SEQ ID NO: 145693

SEQ ID NO: 145962 - DNA, 601 bp, Human; identical to SEQ ID NO: 145694

SEQ ID NO: 145963 - DNA, 601 bp, Human; identical to SEQ ID NO: 145695

SEQ ID NO: 145964 - DNA, 601 bp, Human; identical to SEQ ID NO: 145696

SEQ ID NO: 145965 - DNA, 601 bp, Human; identical to SEQ ID NO: 145697

SEQ ID NO: 145966 - DNA, 601 bp, Human; identical to SEQ ID NO: 145698

SEQ ID NO: 145967 - DNA, 601 bp, Human; identical to SEQ ID NO: 145699

SEQ ID NO: 145968 - DNA, 601 bp, Human; identical to SEQ ID NO: 145700

SEQ ID NO: 145969 - DNA, 601 bp, Human; identical to SEQ ID NO: 145701

SEQ ID NO: 145970 - DNA, 601 bp, Human; identical to SEQ ID NO: 145702

SEQ ID NO: 145971 - DNA, 601 bp, Human; identical to SEQ ID NO: 145703

SEQ ID NO: 145972 - DNA, 601 bp, Human; identical to SEQ ID NO: 145704

SEQ ID NO: 145973 - DNA, 601 bp, Human; identical to SEQ ID NO: 145705

SEQ ID NO: 145974 - DNA, 601 bp, Human; identical to SEQ ID NO: 145706

SEQ ID NO: 145975 - DNA, 601 bp, Human; identical to SEQ ID NO: 145707

SEQ ID NO: 145976 - DNA, 601 bp, Human; identical to SEQ ID NO: 145708

SEQ ID NO: 145977 - DNA, 601 bp, Human; identical to SEQ ID NO: 145709

SEQ ID NO: 145978 - DNA, 601 bp, Human; identical to SEQ ID NO: 145710

SEQ ID NO: 145979 - DNA, 601 bp, Human; identical to SEQ ID NO: 145711

SEQ ID NO: 145980 - DNA, 601 bp, Human; identical to SEQ ID NO: 145712

SEQ ID NO: 145981 - DNA, 601 bp, Human; identical to SEQ ID NO: 145713

SEQ ID NO: 145982 - DNA, 601 bp, Human; identical to SEQ ID NO: 145714

SEQ ID NO: 145983 - DNA, 601 bp, Human; identical to SEQ ID NO: 145715

SEQ ID NO: 145984 - DNA, 601 bp, Human; identical to SEQ ID NO: 145716

SEQ ID NO: 145985 - DNA, 601 bp, Human; identical to SEQ ID NO: 145717

SEQ ID NO: 145986 - DNA, 601 bp, Human; identical to SEQ ID NO: 145718

SEQ ID NO: 145987 - DNA, 601 bp, Human; identical to SEQ ID NO: 145719

SEQ ID NO: 145988 - DNA, 601 bp, Human; identical to SEQ ID NO: 145720

SEQ ID NO: 145989 - DNA, 601 bp, Human; identical to SEQ ID NO: 145721

SEQ ID NO: 145990 - DNA, 601 bp, Human; identical to SEQ ID NO: 145722

SEQ ID NO: 145991 - DNA, 601 bp, Human; identical to SEQ ID NO: 145723

SEQ ID NO: 145992 - DNA, 601 bp, Human; identical to SEQ ID NO: 145724

SEQ ID NO: 145993 - DNA, 601 bp, Human; identical to SEQ ID NO: 145725

SEQ ID NO: 145994 - DNA, 601 bp, Human; identical to SEQ ID NO: 145726

SEQ ID NO: 145995 - DNA, 601 bp, Human; identical to SEQ ID NO: 145727

SEQ ID NO: 145996 - DNA, 601 bp, Human; identical to SEQ ID NO: 145728

SEQ ID NO: 145997 - DNA, 601 bp, Human; identical to SEQ ID NO: 145729

SEQ ID NO: 145998 - DNA, 601 bp, Human; identical to SEQ ID NO: 145730

SEQ ID NO: 145999 - DNA, 601 bp, Human; identical to SEQ ID NO: 145731

SEQ ID NO: 146000 - DNA, 601 bp, Human; identical to SEQ ID NO: 145732

SEQ ID NO: 146001 - DNA, 601 bp, Human; identical to SEQ ID NO: 145733

SEQ ID NO: 146002 - DNA, 601 bp, Human; identical to SEQ ID NO: 145734

SEQ ID NO: 146003 - DNA, 601 bp, Human; identical to SEQ ID NO: 145735

SEQ ID NO: 146004 - DNA, 601 bp, Human; identical to SEQ ID NO: 145736

SEQ ID NO: 146005 - DNA, 601 bp, Human; identical to SEQ ID NO: 145737

SEQ ID NO: 146006 - DNA, 601 bp, Human; identical to SEQ ID NO: 145738

SEQ ID NO: 146007 - DNA, 601 bp, Human; identical to SEQ ID NO: 145739

SEQ ID NO: 146008 - DNA, 601 bp, Human; identical to SEQ ID NO: 145740

SEQ ID NO: 146009 - DNA, 601 bp, Human; identical to SEQ ID NO: 145741

SEQ ID NO: 146010 - DNA, 601 bp, Human; identical to SEQ ID NO: 145742

SEQ ID NO: 146011 - DNA, 601 bp, Human; identical to SEQ ID NO: 145743

SEQ ID NO: 146012 - DNA, 601 bp, Human; identical to SEQ ID NO: 145744

SEQ ID NO: 146013 - DNA, 601 bp, Human; identical to SEQ ID NO: 145745

SEQ ID NO: 146014 - DNA, 601 bp, Human; identical to SEQ ID NO: 145746

SEQ ID NO: 146015 - DNA, 601 bp, Human; identical to SEQ ID NO: 145747

SEQ ID NO: 146016 - DNA, 601 bp, Human; identical to SEQ ID NO: 145748

SEQ ID NO: 146017 - DNA, 601 bp, Human; identical to SEQ ID NO: 145749

SEQ ID NO: 146018 - DNA, 601 bp, Human; identical to SEQ ID NO: 145750

SEQ ID NO: 146019 - DNA, 601 bp, Human; identical to SEQ ID NO: 145751

SEQ ID NO: 146020 - DNA, 601 bp, Human; identical to SEQ ID NO: 145752

SEQ ID NO: 146021 - DNA, 601 bp, Human; identical to SEQ ID NO: 145753

SEQ ID NO: 146022 - DNA, 601 bp, Human; identical to SEQ ID NO: 145754

SEQ ID NO: 146023 - DNA, 601 bp, Human; identical to SEQ ID NO: 145755

SEQ ID NO: 146024 - DNA, 601 bp, Human; identical to SEQ ID NO: 145756

SEQ ID NO: 146025 - DNA, 601 bp, Human; identical to SEQ ID NO: 145757

SEQ ID NO: 146026 - DNA, 601 bp, Human; identical to SEQ ID NO: 145758

SEQ ID NO: 146027 - DNA, 601 bp, Human; identical to SEQ ID NO: 145759

SEQ ID NO: 146028 - DNA, 601 bp, Human; identical to SEQ ID NO: 145760

SEQ ID NO: 146029 - DNA, 601 bp, Human; identical to SEQ ID NO: 145761

SEQ ID NO: 146030 - DNA, 601 bp, Human; identical to SEQ ID NO: 145762

SEQ ID NO: 146031 - DNA, 601 bp, Human; identical to SEQ ID NO: 145763

SEQ ID NO: 146032 - DNA, 601 bp, Human; identical to SEQ ID NO: 145764

SEQ ID NO: 146033 - DNA, 601 bp, Human; identical to SEQ ID NO: 145765

SEQ ID NO: 146034 - DNA, 601 bp, Human; identical to SEQ ID NO: 145766

SEQ ID NO: 146035 - DNA, 601 bp, Human; identical to SEQ ID NO: 145767

SEQ ID NO: 146036 - DNA, 601 bp, Human; identical to SEQ ID NO: 145768

SEQ ID NO: 146037 - DNA, 601 bp, Human; identical to SEQ ID NO: 145769

SEQ ID NO: 146038 - DNA, 601 bp, Human; identical to SEQ ID NO: 145770

SEQ ID NO: 146039 - DNA, 601 bp, Human; identical to SEQ ID NO: 145771

SEQ ID NO: 146040 - DNA, 601 bp, Human; identical to SEQ ID NO: 145772

SEQ ID NO: 146041 - DNA, 601 bp, Human; identical to SEQ ID NO: 145773

SEQ ID NO: 146042 - DNA, 601 bp, Human; identical to SEQ ID NO: 145774

SEQ ID NO: 146043 - DNA, 601 bp, Human; identical to SEQ ID NO: 145775

SEQ ID NO: 146044 - DNA, 601 bp, Human; identical to SEQ ID NO: 145776

SEQ ID NO: 146045 - DNA, 601 bp, Human; identical to SEQ ID NO: 145777

SEQ ID NO: 146046 - DNA, 601 bp, Human; identical to SEQ ID NO: 145778

SEQ ID NO: 146047 - DNA, 601 bp, Human; identical to SEQ ID NO: 145779

SEQ ID NO: 146048 - DNA, 601 bp, Human; identical to SEQ ID NO: 145780

SEQ ID NO: 146049 - DNA, 601 bp, Human; identical to SEQ ID NO: 145781

SEQ ID NO: 146050 - DNA, 601 bp, Human; identical to SEQ ID NO: 145782

SEQ ID NO: 146051 - DNA, 601 bp, Human; identical to SEQ ID NO: 145783

SEQ ID NO: 146052 - DNA, 601 bp, Human; identical to SEQ ID NO: 145784

SEQ ID NO: 146053 - DNA, 601 bp, Human; identical to SEQ ID NO: 145785

SEQ ID NO: 146054 - DNA, 601 bp, Human; identical to SEQ ID NO: 145786

SEQ ID NO: 146055 - DNA, 601 bp, Human; identical to SEQ ID NO: 145787

SEQ ID NO: 146056 - DNA, 601 bp, Human; identical to SEQ ID NO: 145788

SEQ ID NO: 146057 - DNA, 601 bp, Human; identical to SEQ ID NO: 145789

SEQ ID NO: 146058 - DNA, 601 bp, Human; identical to SEQ ID NO: 145790

SEQ ID NO: 146059 - DNA, 601 bp, Human; identical to SEQ ID NO: 145791

SEQ ID NO: 146060 - DNA, 601 bp, Human; identical to SEQ ID NO: 145792

SEQ ID NO: 146061 - DNA, 601 bp, Human; identical to SEQ ID NO: 145793

SEQ ID NO: 146062 - DNA, 601 bp, Human; identical to SEQ ID NO: 145794

SEQ ID NO: 146063 - DNA, 601 bp, Human; identical to SEQ ID NO: 145795

SEQ ID NO: 146064 - DNA, 601 bp, Human; identical to SEQ ID NO: 145796

SEQ ID NO: 146065 - DNA, 601 bp, Human; identical to SEQ ID NO: 145797

SEQ ID NO: 146066 - DNA, 601 bp, Human; identical to SEQ ID NO: 145798

SEQ ID NO: 146067 - DNA, 601 bp, Human; identical to SEQ ID NO: 145799

SEQ ID NO: 146068 - DNA, 601 bp, Human; identical to SEQ ID NO: 145800

SEQ ID NO: 146069 - DNA, 601 bp, Human; identical to SEQ ID NO: 145801

SEQ ID NO: 146070 - DNA, 601 bp, Human; identical to SEQ ID NO: 145802

SEQ ID NO: 146071 - DNA, 601 bp, Human; identical to SEQ ID NO: 145803

SEQ ID NO: 146072 - DNA, 601 bp, Human; identical to SEQ ID NO: 145804

SEQ ID NO: 146073 - DNA, 601 bp, Human; identical to SEQ ID NO: 145805

SEQ ID NO: 146074 - DNA, 601 bp, Human; identical to SEQ ID NO: 145806

SEQ ID NO: 146075 - DNA, 601 bp, Human; identical to SEQ ID NO: 145807

SEQ ID NO: 146076 - DNA, 601 bp, Human; identical to SEQ ID NO: 145808

SEQ ID NO: 146077 - DNA, 601 bp, Human; identical to SEQ ID NO: 145809

SEQ ID NO: 146078 - DNA, 601 bp, Human; identical to SEQ ID NO: 145810

SEQ ID NO: 146079 - DNA, 601 bp, Human; identical to SEQ ID NO: 145811

SEQ ID NO: 146080 - DNA, 601 bp, Human; identical to SEQ ID NO: 145812

SEQ ID NO: 146081 - DNA, 601 bp, Human; identical to SEQ ID NO: 145813

SEQ ID NO: 146082 - DNA, 601 bp, Human; identical to SEQ ID NO: 145814

SEQ ID NO: 146083 - DNA, 601 bp, Human; identical to SEQ ID NO: 145815

SEQ ID NO: 146084 - DNA, 601 bp, Human; identical to SEQ ID NO: 145816

SEQ ID NO: 146085 - DNA, 601 bp, Human; identical to SEQ ID NO: 145817

SEQ ID NO: 146086 - DNA, 601 bp, Human; identical to SEQ ID NO: 145818

SEQ ID NO: 146087 - DNA, 601 bp, Human; identical to SEQ ID NO: 145819

SEQ ID NO: 146088 - DNA, 601 bp, Human; identical to SEQ ID NO: 145820

SEQ ID NO: 146089 - DNA, 601 bp, Human; identical to SEQ ID NO: 145821

SEQ ID NO: 146090 - DNA, 601 bp, Human; identical to SEQ ID NO: 145822

SEQ ID NO: 146091 - DNA, 601 bp, Human; identical to SEQ ID NO: 145823

SEQ ID NO: 146092 - DNA, 601 bp, Human; identical to SEQ ID NO: 145824

SEQ ID NO: 146093 - DNA, 601 bp, Human; identical to SEQ ID NO: 145825

SEQ ID NO: 146094 - DNA, 601 bp, Human; identical to SEQ ID NO: 145826

SEQ ID NO: 146095 - DNA, 601 bp, Human; identical to SEQ ID NO: 145827

SEQ ID NO: 146096 - DNA, 601 bp, Human; identical to SEQ ID NO: 145828

SEQ ID NO: 146097 - DNA, 601 bp, Human; identical to SEQ ID NO: 145829

SEQ ID NO: 146098 - DNA, 601 bp, Human; identical to SEQ ID NO: 145830

SEQ ID NO: 146099 - DNA, 601 bp, Human; identical to SEQ ID NO: 145831

SEQ ID NO: 146100 - DNA, 601 bp, Human; identical to SEQ ID NO: 145832

SEQ ID NO: 146101 - DNA, 601 bp, Human; identical to SEQ ID NO: 145833

SEQ ID NO: 146102 - DNA, 601 bp, Human; identical to SEQ ID NO: 145834

SEQ ID NO: 146103 - DNA, 601 bp, Human; identical to SEQ ID NO: 145835

SEQ ID NO: 146104 - DNA, 601 bp, Human; identical to SEQ ID NO: 145836

SEQ ID NO: 146105 - DNA, 601 bp, Human; identical to SEQ ID NO: 145837

SEQ ID NO: 146106 - DNA, 601 bp, Human; identical to SEQ ID NO: 145838

SEQ ID NO: 146107 - DNA, 601 bp, Human; identical to SEQ ID NO: 145839

SEQ ID NO: 146108 - DNA, 601 bp, Human; identical to SEQ ID NO: 145840

SEQ ID NO: 146109 - DNA, 601 bp, Human; identical to SEQ ID NO: 145841

SEQ ID NO: 146110 - DNA, 601 bp, Human; identical to SEQ ID NO: 145842

SEQ ID NO: 146111 - DNA, 601 bp, Human; identical to SEQ ID NO: 145843

SEQ ID NO: 146112 - DNA, 601 bp, Human; identical to SEQ ID NO: 145844

SEQ ID NO: 146113 - DNA, 601 bp, Human; identical to SEQ ID NO: 145845

SEQ ID NO: 146114 - DNA, 601 bp, Human; identical to SEQ ID NO: 145846

SEQ ID NO: 146115 - DNA, 601 bp, Human; identical to SEQ ID NO: 145847

SEQ ID NO: 146116 - DNA, 601 bp, Human; identical to SEQ ID NO: 145848

SEQ ID NO: 146117 - DNA, 601 bp, Human; identical to SEQ ID NO: 145849

SEQ ID NO: 146118 - DNA, 601 bp, Human; identical to SEQ ID NO: 145850

SEQ ID NO: 146119 - DNA, 601 bp, Human; identical to SEQ ID NO: 145851

SEQ ID NO: 146120 - DNA, 601 bp, Human; identical to SEQ ID NO: 145852

SEQ ID NO: 146121 - DNA, 601 bp, Human; identical to SEQ ID NO: 145853

SEQ ID NO: 146122 - DNA, 601 bp, Human; identical to SEQ ID NO: 145854

SEQ ID NO: 146123 - DNA, 601 bp, Human; identical to SEQ ID NO: 145855

SEQ ID NO: 146124 - DNA, 601 bp, Human; identical to SEQ ID NO: 145856

SEQ ID NO: 146125 - DNA, 601 bp, Human; identical to SEQ ID NO: 145857

SEQ ID NO: 146126 - DNA, 601 bp, Human; identical to SEQ ID NO: 145858

SEQ ID NO: 146127 - DNA, 601 bp, Human; identical to SEQ ID NO: 30522

SEQ ID NO: 146128 - DNA, 601 bp, Human; identical to SEQ ID NO: 30523

SEQ ID NO: 146129 - DNA, 601 bp, Human; identical to SEQ ID NO: 30524

SEQ ID NO: 146130 - DNA, 601 bp, Human; identical to SEQ ID NO: 30525

SEQ ID NO: 146131 - DNA, 601 bp, Human; identical to SEQ ID NO: 30526

SEQ ID NO: 146132 - DNA, 601 bp, Human; identical to SEQ ID NO: 30527

SEQ ID NO: 146133 - DNA, 601 bp, Human; identical to SEQ ID NO: 30528

SEQ ID NO: 146134 - DNA, 601 bp, Human; identical to SEQ ID NO: 30529

SEQ ID NO: 146135 - DNA, 601 bp, Human; identical to SEQ ID NO: 30530

SEQ ID NO: 146136 - DNA, 601 bp, Human; identical to SEQ ID NO: 30531

SEQ ID NO: 146137 - DNA, 601 bp, Human; identical to SEQ ID NO: 30532

SEQ ID NO: 146138 - DNA, 601 bp, Human; identical to SEQ ID NO: 30533

SEQ ID NO: 146139 - DNA, 601 bp, Human; identical to SEQ ID NO: 30534

SEQ ID NO: 146140 - DNA, 601 bp, Human; identical to SEQ ID NO: 30535

SEQ ID NO: 146141 - DNA, 601 bp, Human; identical to SEQ ID NO: 145605

SEQ ID NO: 146142 - DNA, 601 bp, Human; identical to SEQ ID NO: 145606

SEQ ID NO: 146143 - DNA, 601 bp, Human; identical to SEQ ID NO: 145607

SEQ ID NO: 146144 - DNA, 601 bp, Human; identical to SEQ ID NO: 145608

SEQ ID NO: 146145 - DNA, 601 bp, Human; identical to SEQ ID NO: 145609

SEQ ID NO: 146146 - DNA, 601 bp, Human; identical to SEQ ID NO: 145610

SEQ ID NO: 146147 - DNA, 601 bp, Human; identical to SEQ ID NO: 145611

SEQ ID NO: 146148 - DNA, 601 bp, Human; identical to SEQ ID NO: 145612

SEQ ID NO: 146149 - DNA, 601 bp, Human; identical to SEQ ID NO: 145613

SEQ ID NO: 146150 - DNA, 601 bp, Human; identical to SEQ ID NO: 145614

SEQ ID NO: 146151 - DNA, 601 bp, Human; identical to SEQ ID NO: 145615

SEQ ID NO: 146152 - DNA, 601 bp, Human; identical to SEQ ID NO: 145616

SEQ ID NO: 146153 - DNA, 601 bp, Human; identical to SEQ ID NO: 145617

SEQ ID NO: 146154 - DNA, 601 bp, Human; identical to SEQ ID NO: 145618

SEQ ID NO: 146155 - DNA, 601 bp, Human; identical to SEQ ID NO: 145619

SEQ ID NO: 146156 - DNA, 601 bp, Human; identical to SEQ ID NO: 145620

SEQ ID NO: 146157 - DNA, 601 bp, Human; identical to SEQ ID NO: 145621

SEQ ID NO: 146158 - DNA, 601 bp, Human; identical to SEQ ID NO: 145622

SEQ ID NO: 146159 - DNA, 601 bp, Human; identical to SEQ ID NO: 145623

SEQ ID NO: 146160 - DNA, 601 bp, Human; identical to SEQ ID NO: 145624

SEQ ID NO: 146161 - DNA, 601 bp, Human; identical to SEQ ID NO: 145625

SEQ ID NO: 146162 - DNA, 601 bp, Human; identical to SEQ ID NO: 145626

SEQ ID NO: 146163 - DNA, 601 bp, Human; identical to SEQ ID NO: 145627

SEQ ID NO: 146164 - DNA, 601 bp, Human; identical to SEQ ID NO: 145628

SEQ ID NO: 146165 - DNA, 601 bp, Human; identical to SEQ ID NO: 145629

SEQ ID NO: 146166 - DNA, 601 bp, Human; identical to SEQ ID NO: 145630

SEQ ID NO: 146167 - DNA, 601 bp, Human; identical to SEQ ID NO: 145631

SEQ ID NO: 146168 - DNA, 601 bp, Human; identical to SEQ ID NO: 145632

SEQ ID NO: 146169 - DNA, 601 bp, Human; identical to SEQ ID NO: 145633

SEQ ID NO: 146170 - DNA, 601 bp, Human; identical to SEQ ID NO: 145634

SEQ ID NO: 146171 - DNA, 601 bp, Human; identical to SEQ ID NO: 145635

SEQ ID NO: 146172 - DNA, 601 bp, Human; identical to SEQ ID NO: 145636

SEQ ID NO: 146173 - DNA, 601 bp, Human; identical to SEQ ID NO: 145637

SEQ ID NO: 146174 - DNA, 601 bp, Human; identical to SEQ ID NO: 145638

SEQ ID NO: 146175 - DNA, 601 bp, Human; identical to SEQ ID NO: 145639

SEQ ID NO: 146176 - DNA, 601 bp, Human; identical to SEQ ID NO: 145640

SEQ ID NO: 146177 - DNA, 601 bp, Human; identical to SEQ ID NO: 145641

SEQ ID NO: 146178 - DNA, 601 bp, Human; identical to SEQ ID NO: 145642

SEQ ID NO: 146179 - DNA, 601 bp, Human; identical to SEQ ID NO: 145643

SEQ ID NO: 146180 - DNA, 601 bp, Human; identical to SEQ ID NO: 145644

SEQ ID NO: 146181 - DNA, 601 bp, Human; identical to SEQ ID NO: 145645

SEQ ID NO: 146182 - DNA, 601 bp, Human; identical to SEQ ID NO: 145646

SEQ ID NO: 146183 - DNA, 601 bp, Human; identical to SEQ ID NO: 145647

SEQ ID NO: 146184 - DNA, 601 bp, Human; identical to SEQ ID NO: 145648

SEQ ID NO: 146185 - DNA, 601 bp, Human; identical to SEQ ID NO: 145649

SEQ ID NO: 146186 - DNA, 601 bp, Human; identical to SEQ ID NO: 145650

SEQ ID NO: 146187 - DNA, 601 bp, Human; identical to SEQ ID NO: 145651

SEQ ID NO: 146188 - DNA, 601 bp, Human; identical to SEQ ID NO: 145652

SEQ ID NO: 146189 - DNA, 601 bp, Human; identical to SEQ ID NO: 145653

SEQ ID NO: 146190 - DNA, 601 bp, Human; identical to SEQ ID NO: 145654

SEQ ID NO: 146191 - DNA, 601 bp, Human; identical to SEQ ID NO: 145655

SEQ ID NO: 146192 - DNA, 601 bp, Human; identical to SEQ ID NO: 145656

SEQ ID NO: 146193 - DNA, 601 bp, Human; identical to SEQ ID NO: 145657

SEQ ID NO: 146194 - DNA, 601 bp, Human; identical to SEQ ID NO: 145658

SEQ ID NO: 146195 - DNA, 601 bp, Human; identical to SEQ ID NO: 145659

SEQ ID NO: 146196 - DNA, 601 bp, Human; identical to SEQ ID NO: 145660

SEQ ID NO: 146197 - DNA, 601 bp, Human; identical to SEQ ID NO: 145661

SEQ ID NO: 146198 - DNA, 601 bp, Human; identical to SEQ ID NO: 145662

SEQ ID NO: 146199 - DNA, 601 bp, Human; identical to SEQ ID NO: 145663

SEQ ID NO: 146200 - DNA, 601 bp, Human; identical to SEQ ID NO: 145664

SEQ ID NO: 146201 - DNA, 601 bp, Human; identical to SEQ ID NO: 145665

SEQ ID NO: 146202 - DNA, 601 bp, Human; identical to SEQ ID NO: 145666

SEQ ID NO: 146203 - DNA, 601 bp, Human; identical to SEQ ID NO: 145667

SEQ ID NO: 146204 - DNA, 601 bp, Human; identical to SEQ ID NO: 145668

SEQ ID NO: 146205 - DNA, 601 bp, Human; identical to SEQ ID NO: 145669

SEQ ID NO: 146206 - DNA, 601 bp, Human; identical to SEQ ID NO: 145670

SEQ ID NO: 146207 - DNA, 601 bp, Human; identical to SEQ ID NO: 145671

SEQ ID NO: 146208 - DNA, 601 bp, Human; identical to SEQ ID NO: 145672

SEQ ID NO: 146209 - DNA, 601 bp, Human; identical to SEQ ID NO: 145673

SEQ ID NO: 146210 - DNA, 601 bp, Human; identical to SEQ ID NO: 145674

SEQ ID NO: 146211 - DNA, 601 bp, Human; identical to SEQ ID NO: 145675

SEQ ID NO: 146212 - DNA, 601 bp, Human; identical to SEQ ID NO: 145676

SEQ ID NO: 146213 - DNA, 601 bp, Human; identical to SEQ ID NO: 145677

SEQ ID NO: 146214 - DNA, 601 bp, Human; identical to SEQ ID NO: 145678

SEQ ID NO: 146215 - DNA, 601 bp, Human; identical to SEQ ID NO: 145679

SEQ ID NO: 146216 - DNA, 601 bp, Human; identical to SEQ ID NO: 145680

SEQ ID NO: 146217 - DNA, 601 bp, Human; identical to SEQ ID NO: 145681

SEQ ID NO: 146218 - DNA, 601 bp, Human; identical to SEQ ID NO: 145682

SEQ ID NO: 146219 - DNA, 601 bp, Human; identical to SEQ ID NO: 145683

SEQ ID NO: 146220 - DNA, 601 bp, Human; identical to SEQ ID NO: 145684

SEQ ID NO: 146221 - DNA, 601 bp, Human; identical to SEQ ID NO: 145685

SEQ ID NO: 146222 - DNA, 601 bp, Human; identical to SEQ ID NO: 145686

SEQ ID NO: 146223 - DNA, 601 bp, Human; identical to SEQ ID NO: 145687

SEQ ID NO: 146224 - DNA, 601 bp, Human; identical to SEQ ID NO: 145688

SEQ ID NO: 146225 - DNA, 601 bp, Human; identical to SEQ ID NO: 145689

SEQ ID NO: 146226 - DNA, 601 bp, Human; identical to SEQ ID NO: 145690

SEQ ID NO: 146227 - DNA, 601 bp, Human; identical to SEQ ID NO: 145691

SEQ ID NO: 146228 - DNA, 601 bp, Human; identical to SEQ ID NO: 145692

SEQ ID NO: 146229 - DNA, 601 bp, Human; identical to SEQ ID NO: 145693

SEQ ID NO: 146230 - DNA, 601 bp, Human; identical to SEQ ID NO: 145694

SEQ ID NO: 146231 - DNA, 601 bp, Human; identical to SEQ ID NO: 145695

SEQ ID NO: 146232 - DNA, 601 bp, Human; identical to SEQ ID NO: 145696

SEQ ID NO: 146233 - DNA, 601 bp, Human; identical to SEQ ID NO: 145697

SEQ ID NO: 146234 - DNA, 601 bp, Human; identical to SEQ ID NO: 145698

SEQ ID NO: 146235 - DNA, 601 bp, Human; identical to SEQ ID NO: 145699

SEQ ID NO: 146236 - DNA, 601 bp, Human; identical to SEQ ID NO: 145700

SEQ ID NO: 146237 - DNA, 601 bp, Human; identical to SEQ ID NO: 145701

SEQ ID NO: 146238 - DNA, 601 bp, Human; identical to SEQ ID NO: 145702

SEQ ID NO: 146239 - DNA, 601 bp, Human; identical to SEQ ID NO: 145703

SEQ ID NO: 146240 - DNA, 601 bp, Human; identical to SEQ ID NO: 145704

SEQ ID NO: 146241 - DNA, 601 bp, Human; identical to SEQ ID NO: 145705

SEQ ID NO: 146242 - DNA, 601 bp, Human; identical to SEQ ID NO: 145706

SEQ ID NO: 146243 - DNA, 601 bp, Human; identical to SEQ ID NO: 145707

SEQ ID NO: 146244 - DNA, 601 bp, Human; identical to SEQ ID NO: 145708

SEQ ID NO: 146245 - DNA, 601 bp, Human; identical to SEQ ID NO: 145709

SEQ ID NO: 146246 - DNA, 601 bp, Human; identical to SEQ ID NO: 145710

SEQ ID NO: 146247 - DNA, 601 bp, Human; identical to SEQ ID NO: 145711

SEQ ID NO: 146248 - DNA, 601 bp, Human; identical to SEQ ID NO: 145712

SEQ ID NO: 146249 - DNA, 601 bp, Human; identical to SEQ ID NO: 145713

SEQ ID NO: 146250 - DNA, 601 bp, Human; identical to SEQ ID NO: 145714

SEQ ID NO: 146251 - DNA, 601 bp, Human; identical to SEQ ID NO: 145715

SEQ ID NO: 146252 - DNA, 601 bp, Human; identical to SEQ ID NO: 145716

SEQ ID NO: 146253 - DNA, 601 bp, Human; identical to SEQ ID NO: 145717

SEQ ID NO: 146254 - DNA, 601 bp, Human; identical to SEQ ID NO: 145718

SEQ ID NO: 146255 - DNA, 601 bp, Human; identical to SEQ ID NO: 145719

SEQ ID NO: 146256 - DNA, 601 bp, Human; identical to SEQ ID NO: 145720

SEQ ID NO: 146257 - DNA, 601 bp, Human; identical to SEQ ID NO: 145721

SEQ ID NO: 146258 - DNA, 601 bp, Human; identical to SEQ ID NO: 145722

SEQ ID NO: 146259 - DNA, 601 bp, Human; identical to SEQ ID NO: 145723

SEQ ID NO: 146260 - DNA, 601 bp, Human; identical to SEQ ID NO: 145724

SEQ ID NO: 146261 - DNA, 601 bp, Human; identical to SEQ ID NO: 145725

SEQ ID NO: 146262 - DNA, 601 bp, Human; identical to SEQ ID NO: 145726

SEQ ID NO: 146263 - DNA, 601 bp, Human; identical to SEQ ID NO: 145727

SEQ ID NO: 146264 - DNA, 601 bp, Human; identical to SEQ ID NO: 145728

SEQ ID NO: 146265 - DNA, 601 bp, Human; identical to SEQ ID NO: 145729

SEQ ID NO: 146266 - DNA, 601 bp, Human; identical to SEQ ID NO: 145730

SEQ ID NO: 146267 - DNA, 601 bp, Human; identical to SEQ ID NO: 145731

SEQ ID NO: 146268 - DNA, 601 bp, Human; identical to SEQ ID NO: 145732

SEQ ID NO: 146269 - DNA, 601 bp, Human; identical to SEQ ID NO: 145733

SEQ ID NO: 146270 - DNA, 601 bp, Human; identical to SEQ ID NO: 145734

SEQ ID NO: 146271 - DNA, 601 bp, Human; identical to SEQ ID NO: 145735

SEQ ID NO: 146272 - DNA, 601 bp, Human; identical to SEQ ID NO: 145736

SEQ ID NO: 146273 - DNA, 601 bp, Human; identical to SEQ ID NO: 145737

SEQ ID NO: 146274 - DNA, 601 bp, Human; identical to SEQ ID NO: 145738

SEQ ID NO: 146275 - DNA, 601 bp, Human; identical to SEQ ID NO: 145739

SEQ ID NO: 146276 - DNA, 601 bp, Human; identical to SEQ ID NO: 145740

SEQ ID NO: 146277 - DNA, 601 bp, Human; identical to SEQ ID NO: 145741

SEQ ID NO: 146278 - DNA, 601 bp, Human; identical to SEQ ID NO: 145742

SEQ ID NO: 146279 - DNA, 601 bp, Human; identical to SEQ ID NO: 145743

SEQ ID NO: 146280 - DNA, 601 bp, Human; identical to SEQ ID NO: 145744

SEQ ID NO: 146281 - DNA, 601 bp, Human; identical to SEQ ID NO: 145745

SEQ ID NO: 146282 - DNA, 601 bp, Human; identical to SEQ ID NO: 145746

SEQ ID NO: 146283 - DNA, 601 bp, Human; identical to SEQ ID NO: 145747

SEQ ID NO: 146284 - DNA, 601 bp, Human; identical to SEQ ID NO: 145748

SEQ ID NO: 146285 - DNA, 601 bp, Human; identical to SEQ ID NO: 145749

SEQ ID NO: 146286 - DNA, 601 bp, Human; identical to SEQ ID NO: 145750

SEQ ID NO: 146287 - DNA, 601 bp, Human; identical to SEQ ID NO: 145751

SEQ ID NO: 146288 - DNA, 601 bp, Human; identical to SEQ ID NO: 145752

SEQ ID NO: 146289 - DNA, 601 bp, Human; identical to SEQ ID NO: 145753

SEQ ID NO: 146290 - DNA, 601 bp, Human; identical to SEQ ID NO: 145754

SEQ ID NO: 146291 - DNA, 601 bp, Human; identical to SEQ ID NO: 145755

SEQ ID NO: 146292 - DNA, 601 bp, Human; identical to SEQ ID NO: 145756

SEQ ID NO: 146293 - DNA, 601 bp, Human; identical to SEQ ID NO: 145757

SEQ ID NO: 146294 - DNA, 601 bp, Human; identical to SEQ ID NO: 145758

SEQ ID NO: 146295 - DNA, 601 bp, Human; identical to SEQ ID NO: 145759

SEQ ID NO: 146296 - DNA, 601 bp, Human; identical to SEQ ID NO: 145760

SEQ ID NO: 146297 - DNA, 601 bp, Human; identical to SEQ ID NO: 145761

SEQ ID NO: 146298 - DNA, 601 bp, Human; identical to SEQ ID NO: 145762

SEQ ID NO: 146299 - DNA, 601 bp, Human; identical to SEQ ID NO: 145763

SEQ ID NO: 146300 - DNA, 601 bp, Human; identical to SEQ ID NO: 145764

SEQ ID NO: 146301 - DNA, 601 bp, Human; identical to SEQ ID NO: 145765

SEQ ID NO: 146302 - DNA, 601 bp, Human; identical to SEQ ID NO: 145766

SEQ ID NO: 146303 - DNA, 601 bp, Human; identical to SEQ ID NO: 145767

SEQ ID NO: 146304 - DNA, 601 bp, Human; identical to SEQ ID NO: 145768

SEQ ID NO: 146305 - DNA, 601 bp, Human; identical to SEQ ID NO: 145769

SEQ ID NO: 146306 - DNA, 601 bp, Human; identical to SEQ ID NO: 145770

SEQ ID NO: 146307 - DNA, 601 bp, Human; identical to SEQ ID NO: 145771

SEQ ID NO: 146308 - DNA, 601 bp, Human; identical to SEQ ID NO: 145772

SEQ ID NO: 146309 - DNA, 601 bp, Human; identical to SEQ ID NO: 145773

SEQ ID NO: 146310 - DNA, 601 bp, Human; identical to SEQ ID NO: 145774

SEQ ID NO: 146311 - DNA, 601 bp, Human; identical to SEQ ID NO: 145775

SEQ ID NO: 146312 - DNA, 601 bp, Human; identical to SEQ ID NO: 145776

SEQ ID NO: 146313 - DNA, 601 bp, Human; identical to SEQ ID NO: 145777

SEQ ID NO: 146314 - DNA, 601 bp, Human; identical to SEQ ID NO: 145778

SEQ ID NO: 146315 - DNA, 601 bp, Human; identical to SEQ ID NO: 145779

SEQ ID NO: 146316 - DNA, 601 bp, Human; identical to SEQ ID NO: 145780

SEQ ID NO: 146317 - DNA, 601 bp, Human; identical to SEQ ID NO: 145781

SEQ ID NO: 146318 - DNA, 601 bp, Human; identical to SEQ ID NO: 145782

SEQ ID NO: 146319 - DNA, 601 bp, Human; identical to SEQ ID NO: 145783

SEQ ID NO: 146320 - DNA, 601 bp, Human; identical to SEQ ID NO: 145784

SEQ ID NO: 146321 - DNA, 601 bp, Human; identical to SEQ ID NO: 145785

SEQ ID NO: 146322 - DNA, 601 bp, Human; identical to SEQ ID NO: 145786

SEQ ID NO: 146323 - DNA, 601 bp, Human; identical to SEQ ID NO: 145787

SEQ ID NO: 146324 - DNA, 601 bp, Human; identical to SEQ ID NO: 145788

SEQ ID NO: 146325 - DNA, 601 bp, Human; identical to SEQ ID NO: 145789

SEQ ID NO: 146326 - DNA, 601 bp, Human; identical to SEQ ID NO: 145790

SEQ ID NO: 146327 - DNA, 601 bp, Human; identical to SEQ ID NO: 145791

SEQ ID NO: 146328 - DNA, 601 bp, Human; identical to SEQ ID NO: 145792

SEQ ID NO: 146329 - DNA, 601 bp, Human; identical to SEQ ID NO: 145793

SEQ ID NO: 146330 - DNA, 601 bp, Human; identical to SEQ ID NO: 145794

SEQ ID NO: 146331 - DNA, 601 bp, Human; identical to SEQ ID NO: 145795

SEQ ID NO: 146332 - DNA, 601 bp, Human; identical to SEQ ID NO: 145796

SEQ ID NO: 146333 - DNA, 601 bp, Human; identical to SEQ ID NO: 145797

SEQ ID NO: 146334 - DNA, 601 bp, Human; identical to SEQ ID NO: 145798

SEQ ID NO: 146335 - DNA, 601 bp, Human; identical to SEQ ID NO: 145799

SEQ ID NO: 146336 - DNA, 601 bp, Human; identical to SEQ ID NO: 145800

SEQ ID NO: 146337 - DNA, 601 bp, Human; identical to SEQ ID NO: 145801

SEQ ID NO: 146338 - DNA, 601 bp, Human; identical to SEQ ID NO: 145802

SEQ ID NO: 146339 - DNA, 601 bp, Human; identical to SEQ ID NO: 145803

SEQ ID NO: 146340 - DNA, 601 bp, Human; identical to SEQ ID NO: 145804

SEQ ID NO: 146341 - DNA, 601 bp, Human; identical to SEQ ID NO: 145805

SEQ ID NO: 146342 - DNA, 601 bp, Human; identical to SEQ ID NO: 145806

SEQ ID NO: 146343 - DNA, 601 bp, Human; identical to SEQ ID NO: 145807

SEQ ID NO: 146344 - DNA, 601 bp, Human; identical to SEQ ID NO: 145808

SEQ ID NO: 146345 - DNA, 601 bp, Human; identical to SEQ ID NO: 145809

SEQ ID NO: 146346 - DNA, 601 bp, Human; identical to SEQ ID NO: 145810

SEQ ID NO: 146347 - DNA, 601 bp, Human; identical to SEQ ID NO: 145811

SEQ ID NO: 146348 - DNA, 601 bp, Human; identical to SEQ ID NO: 145812

SEQ ID NO: 146349 - DNA, 601 bp, Human; identical to SEQ ID NO: 145813

SEQ ID NO: 146350 - DNA, 601 bp, Human; identical to SEQ ID NO: 145814

SEQ ID NO: 146351 - DNA, 601 bp, Human; identical to SEQ ID NO: 145815

SEQ ID NO: 146352 - DNA, 601 bp, Human; identical to SEQ ID NO: 145816

SEQ ID NO: 146353 - DNA, 601 bp, Human; identical to SEQ ID NO: 145817

SEQ ID NO: 146354 - DNA, 601 bp, Human; identical to SEQ ID NO: 145818

SEQ ID NO: 146355 - DNA, 601 bp, Human; identical to SEQ ID NO: 145819

SEQ ID NO: 146356 - DNA, 601 bp, Human; identical to SEQ ID NO: 145820

SEQ ID NO: 146357 - DNA, 601 bp, Human; identical to SEQ ID NO: 145821

SEQ ID NO: 146358 - DNA, 601 bp, Human; identical to SEQ ID NO: 145822

SEQ ID NO: 146359 - DNA, 601 bp, Human; identical to SEQ ID NO: 145823

SEQ ID NO: 146360 - DNA, 601 bp, Human; identical to SEQ ID NO: 145824

SEQ ID NO: 146361 - DNA, 601 bp, Human; identical to SEQ ID NO: 145825

SEQ ID NO: 146362 - DNA, 601 bp, Human; identical to SEQ ID NO: 145826

SEQ ID NO: 146363 - DNA, 601 bp, Human; identical to SEQ ID NO: 145827

SEQ ID NO: 146364 - DNA, 601 bp, Human; identical to SEQ ID NO: 145828

SEQ ID NO: 146365 - DNA, 601 bp, Human; identical to SEQ ID NO: 145829

SEQ ID NO: 146366 - DNA, 601 bp, Human; identical to SEQ ID NO: 145830

SEQ ID NO: 146367 - DNA, 601 bp, Human; identical to SEQ ID NO: 145831

SEQ ID NO: 146368 - DNA, 601 bp, Human; identical to SEQ ID NO: 145832

SEQ ID NO: 146369 - DNA, 601 bp, Human; identical to SEQ ID NO: 145833

SEQ ID NO: 146370 - DNA, 601 bp, Human; identical to SEQ ID NO: 145834

SEQ ID NO: 146371 - DNA, 601 bp, Human; identical to SEQ ID NO: 145835

SEQ ID NO: 146372 - DNA, 601 bp, Human; identical to SEQ ID NO: 145836

SEQ ID NO: 146373 - DNA, 601 bp, Human; identical to SEQ ID NO: 145837

SEQ ID NO: 146374 - DNA, 601 bp, Human; identical to SEQ ID NO: 145838

SEQ ID NO: 146375 - DNA, 601 bp, Human; identical to SEQ ID NO: 145839

SEQ ID NO: 146376 - DNA, 601 bp, Human; identical to SEQ ID NO: 145840

SEQ ID NO: 146377 - DNA, 601 bp, Human; identical to SEQ ID NO: 145841

SEQ ID NO: 146378 - DNA, 601 bp, Human; identical to SEQ ID NO: 145842

SEQ ID NO: 146379 - DNA, 601 bp, Human; identical to SEQ ID NO: 145843

SEQ ID NO: 146380 - DNA, 601 bp, Human; identical to SEQ ID NO: 145844

SEQ ID NO: 146381 - DNA, 601 bp, Human; identical to SEQ ID NO: 145845

SEQ ID NO: 146382 - DNA, 601 bp, Human; identical to SEQ ID NO: 145846

SEQ ID NO: 146383 - DNA, 601 bp, Human; identical to SEQ ID NO: 145847

SEQ ID NO: 146384 - DNA, 601 bp, Human; identical to SEQ ID NO: 145848

SEQ ID NO: 146385 - DNA, 601 bp, Human; identical to SEQ ID NO: 145849

SEQ ID NO: 146386 - DNA, 601 bp, Human; identical to SEQ ID NO: 145850

SEQ ID NO: 146387 - DNA, 601 bp, Human; identical to SEQ ID NO: 145851

SEQ ID NO: 146388 - DNA, 601 bp, Human; identical to SEQ ID NO: 145852

SEQ ID NO: 146389 - DNA, 601 bp, Human; identical to SEQ ID NO: 145853

SEQ ID NO: 146390 - DNA, 601 bp, Human; identical to SEQ ID NO: 145854

SEQ ID NO: 146391 - DNA, 601 bp, Human; identical to SEQ ID NO: 145855

SEQ ID NO: 146392 - DNA, 601 bp, Human; identical to SEQ ID NO: 145856

SEQ ID NO: 146393 - DNA, 601 bp, Human; identical to SEQ ID NO: 145857

SEQ ID NO: 146394 - DNA, 601 bp, Human; identical to SEQ ID NO: 145858

SEQ ID NO: 146395 - DNA, 601 bp, Human; identical to SEQ ID NO: 30522

SEQ ID NO: 146396 - DNA, 601 bp, Human; identical to SEQ ID NO: 30523

SEQ ID NO: 146397 - DNA, 601 bp, Human; identical to SEQ ID NO: 30524

SEQ ID NO: 146398 - DNA, 601 bp, Human; identical to SEQ ID NO: 30525

SEQ ID NO: 146399 - DNA, 601 bp, Human; identical to SEQ ID NO: 30526

SEQ ID NO: 146400 - DNA, 601 bp, Human; identical to SEQ ID NO: 30527

SEQ ID NO: 146401 - DNA, 601 bp, Human; identical to SEQ ID NO: 30528

SEQ ID NO: 146402 - DNA, 601 bp, Human; identical to SEQ ID NO: 30529

SEQ ID NO: 146403 - DNA, 601 bp, Human; identical to SEQ ID NO: 30530

SEQ ID NO: 146404 - DNA, 601 bp, Human; identical to SEQ ID NO: 30531

SEQ ID NO: 146405 - DNA, 601 bp, Human; identical to SEQ ID NO: 30532

SEQ ID NO: 146406 - DNA, 601 bp, Human; identical to SEQ ID NO: 30533

SEQ ID NO: 146407 - DNA, 601 bp, Human; identical to SEQ ID NO: 30534

SEQ ID NO: 146408 - DNA, 601 bp, Human; identical to SEQ ID NO: 30535

SEQ ID NO: 146409 - DNA, 601 bp, Human; identical to SEQ ID NO: 115440

SEQ ID NO: 146410 - DNA, 601 bp, Human; identical to SEQ ID NO: 115441

SEQ ID NO: 146411 - DNA, 601 bp, Human
ctctctattttgcttcatccatttcagttttcttcttcctctctgtccttccttcccactctgtccagaggaatgtatgcattgcagtggagaaaactatgacggcaaaatttccaagaccatgtctggactggaatgccaggcctgggactctcagagcccacacgctcatggatacattccttccaagtaagtctcactgggaaaaacattccatgtttaattaaggctctgcagctctatcagacatttgctgtcatttagatattttagcattcctcaagaagtgaacgcctgatgwttttaatttcaaagctaacctcctcccacaatattgcaagtgaaatacgcattcttgctgctcaaaatatggtccacgggtcagcagcagggatgttttctgagagtttgttagaaatccagaatgtcacaccctctgaatctgatttgaataataaccagatcctcagctgatgtgcacacacattcaaacactaatgtcagtaatgaatacattaacatctgtcttcagaaatgcacacacacatgttgctggtgtattttccaaatattttccttttctctttactccttgtctttc

SEQ ID NO: 146412 - DNA, 601 bp, Human
gctctatcagacatttgctgtcatttagatattttagcattcctcaagaagtgaacgcctgatgtttttaatttcaaagctaacctcctcccacaatattgcaagtgaaatacgcattcttgctgctcaaaatatggtccacgggtcagcagcagggatgttttctgagagtttgttagaaatccagaatgtcacaccctctgaatctgatttgaataataaccagatcctcagctgatgtgcacacacattcaaacactaatgtcagtaatgaatacattaacatctgtcttcagaaatrcacacacacatgttgctggtgtattttccaaatattttccttttctctttactccttgtctttcttttccctttgtaccaatgagattcaagtctcctaacctttgacctatgagcagacgtcatggatttttgaatccctgatgttttatgtatatttacatcaatgtgtttttctggaatgaggattcgtaacttccatcagattctctaaggggaccacgaatttaaaataagaataagcttcttgctctagaaagtcatgatggttcctagaataaggtttcgtgagtattctatt

SEQ ID NO: 146413 - DNA, 601 bp, Human
aaaaaaaagaaagtccttggaatacagggccaaccttgtttccttgttgccatctctgaacacagccttcatctgattacctcctccatgcccgactgtgcctagcacacagcaggtgctcaatgtttgctcttgaaaaagagtcttatccatgaatgtaaatgttcagtgctactaaaatctttcttgtccattcagatttccaaacaagaacctgaagaagaattactgtcgtaaccccgatagggagctgcggccttggtgtttcaccaccgaccccaacaagcgctgggaactttgygacatcccccgctgcagtgagtatgatgcacacccagattccaggatttggacctgccctgttcttgaaatcaaaagaaaacatgtgtcagtgcctgagtgcagcctctgaaaagtgacctacaagtcctatgggatgttattggtctttattttattgctggtttaaaacagttatggttattggttactgtgggtgattgatcagagcatccatttatcatgtttttctttctttgcaactgaaacttctgcctcaggagttcactgaaatgtaggctttaggtgttgttcatcctat

SEQ ID NO: 146414 - DNA, 601 bp, Human
cagcctctgaaaagtgacctacaagtcctatgggatgttattggtctttattttattgctggtttaaaacagttatggttattggttactgtgggtgattgatcagagcatccatttatcatgtttttctttctttgcaactgaaacttctgcctcaggagttcactgaaatgtaggctttaggtgttgttcatcctattctctctgtgctaaagggaaatcagacccatgctctctgacacatggatttcattttcaaccagagttctaatagttgttttgtaaacaaagagtgtctttstttacaatgttcaggtctgtgggtgtccagtttttccaccttggggagcagagggtgagtggtgggggtggggaagagttcaagaggagaagatgaaatggcagacctagtagaaatgatgtggagtaaacaattttatcatattttcctctctgagaatttgaagcaaaggattacacactaagagaaatacaggcatgaaaggttaaaaaggattcagtgagggttggcctcccctcctttcctctgacatgtgtcctttgaaagcggaagttcctcaggcattctccctttttatga

SEQ ID NO: 146415 - DNA, 601 bp, Human
ttctggatgcacacacttttccttggaggtgttttttgccttctttccatggactctttccctgttgtttggcttttatggcatgttgggtgccattcagtcatgtctactcagtgaataatttattcttcaggaaagagagtggacctttggtgtatgtgagaattcggggtgtgaggtgacacgtgttgatacttaccaggtaggaagaactgagcaaagagaacatagaaagaagcacctacccaagggtctttctctgaaggagttccttgtgaaagggtctcacaggcatagatgstactaaattgatttcatctgaaaacatgaaacaattctcaagtgccaaattccaagagaggctgagcaaaagccaagacaggccagaacaccctgcagccatcctccttaacatccatctgtgcattctctattttaaaattattcattgtagggctgggcacggtggctcacgcctgtaatcccagcacttccggaggccgaggtgggcggatcacgaggtcaggagttcaagaccaacctggccaatatgatgaaaccccacctctactaaaaatacaaaaaaattagccagttgtgg

SEQ ID NO: 146416 - DNA, 601 bp, Human
tggcttttatggcatgttgggtgccattcagtcatgtctactcagtgaataatttattcttcaggaaagagagtggacctttggtgtatgtgagaattcggggtgtgaggtgacacgtgttgatacttaccaggtaggaagaactgagcaaagagaacatagaaagaagcacctacccaagggtctttctctgaaggagttccttgtgaaagggtctcacaggcatagatgctactaaattgatttcatctgaaaacatgaaacaattctcaagtgccaaattccaagagaggctgagcaraagccaagacaggccagaacaccctgcagccatcctccttaacatccatctgtgcattctctattttaaaattattcattgtagggctgggcacggtggctcacgcctgtaatcccagcacttccggaggccgaggtgggcggatcacgaggtcaggagttcaagaccaacctggccaatatgatgaaaccccacctctactaaaaatacaaaaaaattagccagttgtggtgacacgcacctgtagtctgagctactcgggaggctgaggcaggagaatgacttgaacccaggaggcag

SEQ ID NO: 146417 - DNA, 601 bp, Human
aactgagcaaagagaacatagaaagaagcacctacccaagggtctttctctgaaggagttccttgtgaaagggtctcacaggcatagatgctactaaattgatttcatctgaaaacatgaaacaattctcaagtgccaaattccaagagaggctgagcaaaagccaagacaggccagaacaccctgcagccatcctccttaacatccatctgtgcattctctattttaaaattattcattgtagggctgggcacggtggctcacgcctgtaatcccagcacttccggaggccgaggtgggyggatcacgaggtcaggagttcaagaccaacctggccaatatgatgaaaccccacctctactaaaaatacaaaaaaattagccagttgtggtgacacgcacctgtagtctgagctactcgggaggctgaggcaggagaatgacttgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctacc

SEQ ID NO: 146418 - DNA, 601 bp, Human
acctacccaagggtctttctctgaaggagttccttgtgaaagggtctcacaggcatagatgctactaaattgatttcatctgaaaacatgaaacaattctcaagtgccaaattccaagagaggctgagcaaaagccaagacaggccagaacaccctgcagccatcctccttaacatccatctgtgcattctctattttaaaattattcattgtagggctgggcacggtggctcacgcctgtaatcccagcacttccggaggccgaggtgggcggatcacgaggtcaggagttcaagaccarcctggccaatatgatgaaaccccacctctactaaaaatacaaaaaaattagccagttgtggtgacacgcacctgtagtctgagctactcgggaggctgaggcaggagaatgacttgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctaccagtgtctgaagggaacaggtgaaaactat

SEQ ID NO: 146419 - DNA, 601 bp, Human
aggctgaggcaggagaatgacttgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttyccctgcaagtaagtcccctccggtctcattctgctgctatggaatgtgaaatcccattgactttgccttagttttagttactgtaggaacgcaggataaagtattctggaagaaaaactgatctagtcataagtaaaggaaatgaactttagcacgttttttcccgtaacggttgttctcaaagcgtggttccctagacttttttctttttggaaagctaaactcacaatcacttctttttcagaaatttggatgaaaactactgccgcaatcctgacggaaaaagggccccatggtgcc

SEQ ID NO: 146420 - DNA, 601 bp, Human
tgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaagtaagtcccctccrgtctcattctgctgctatggaatgtgaaatcccattgactttgccttagttttagttactgtaggaacgcaggataaagtattctggaagaaaaactgatctagtcataagtaaaggaaatgaactttagcacgttttttcccgtaacggttgttctcaaagcgtggttccctagacttttttctttttggaaagctaaactcacaatcacttctttttcagaaatttggatgaaaactactgccgcaatcctgacggaaaaagggccccatggtgccatacaaccaacagccaagtgcg

SEQ ID NO: 146421 - DNA, 601 bp, Human
tatacatttttgacttttcacattccaccttcaaatgatatcattctacttgacatatgaatccttacatcattgcagttctacttcctccctcccaaaatgctatactattactctttgtaatagaagcttacttctactatgtcacagatctcacaatacattgacactatttttgccctaatagttgtgttttaaagtgatcaagaataaaactattttaaatattttctttatttatttattttaccatttctggtgcttctcatctactggggtagatctcaatttccatctggtrtcagtttctttctgtgaaaaacaacttttagcattttttgtagcacaggtctgctactgctgaagtctttcagattttgagtgtctgaaaaagtattttgccttcagtttttaaaagtaattttgctgaatgtagatactgggttgagagtttcatcacttgcaacactttaatgatgatgttccattatcttctgttttaaatagtttgactagtaatctgatctttgttcctatgttttcaataggtcatttttctctgactacctttaagattttctcatctttgtttttcaacagt

SEQ ID NO: 146422 - DNA, 601 bp, Human
tacttctactatgtcacagatctcacaatacattgacactatttttgccctaatagttgtgttttaaagtgatcaagaataaaactattttaaatattttctttatttatttattttaccatttctggtgcttctcatctactggggtagatctcaatttccatctggtgtcagtttctttctgtgaaaaacaacttttagcattttttgtagcacaggtctgctactgctgaagtctttcagattttgagtgtctgaaaaagtattttgccttcagtttttaaaagtaattttgctgaaygtagatactgggttgagagtttcatcacttgcaacactttaatgatgatgttccattatcttctgttttaaatagtttgactagtaatctgatctttgttcctatgttttcaataggtcatttttctctgactacctttaagattttctcatctttgtttttcaacagttcgactatgatgtgtttattattaatttctttgtgtttaatctgcttgaggtattctgagttcctagatttgtagattgttgatttttttcttttctcttttttcttttcttttctttttttttttttttt

SEQ ID NO: 146423 - DNA, 601 bp, Human
aatacattgacactatttttgccctaatagttgtgttttaaagtgatcaagaataaaactattttaaatattttctttatttatttattttaccatttctggtgcttctcatctactggggtagatctcaatttccatctggtgtcagtttctttctgtgaaaaacaacttttagcattttttgtagcacaggtctgctactgctgaagtctttcagattttgagtgtctgaaaaagtattttgccttcagtttttaaaagtaattttgctgaatgtagatactgggttgagagtttcatyacttgcaacactttaatgatgatgttccattatcttctgttttaaatagtttgactagtaatctgatctttgttcctatgttttcaataggtcatttttctctgactacctttaagattttctcatctttgtttttcaacagttcgactatgatgtgtttattattaatttctttgtgtttaatctgcttgaggtattctgagttcctagatttgtagattgttgatttttttcttttctcttttttcttttcttttcttttttttttttttttttttttgagatggagcctcactctgt

SEQ ID NO: 146424 - DNA, 601 bp, Human
atctgtctgctaatacagaaaagagaacagtcataattctcagaggctaccgtactgtttttgtcataaattgcttcatgcttcttttttttcagtaattgttaagcttgatttcttttattttaatttcagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgcgtatgtctytgatttttactgtaagaggggcatcagccaactgaaatttctgttaaaagagccatgcttcatgcttcaagccaacttcctaggaccaaatttctcttagacccagaatgtgtagaaaaatgtctcaagaatcttgcttttgaagaaagggcctgcgagaagagaaattttaggctggctatttttcctgagtagttttatggatgcaggaggacatctggaggtgatgaggtcacattaattgaaagctcaggagtacatatgagcaaatgcttagaaacagtaccattccacaatgcc

SEQ ID NO: 146425 - DNA, 601 bp, Human
agtgcaatatttctaccatagaaatctatcattttaacctccaacccctgaaatgaaggttgaatttgctatttttgtcttgggtcacaagtaaatatactttatatatataagtatgaatatatatacacacatatatatgtatacatatgtgtgcatatataaatacacacatatatgagatatacaagtatacatatatagtgtgtatatatatgtacacatatatgtgtgtatatatatgtacacatatatgtgtgtatattagaatatatataacataaatatgtatatatatatattctgacctgtataaacacagtggatcctgagcaccagtggcctgaaaggatatgggttgctgggacatgaagaacaaaagcaggatacgcagatgctgaacagcgaaagaggccattagatgaacagaaaaccaggtctaacaaggacagcttttcttccataaatgagtacacaatatatggaaaaaactatttttacatattggagaacagataaactgagataatttagaaagggaatcaaatgagatcaacccaataactaccttggctttgttcctggagacttcctgggctga

SEQ ID NO: 146426 - DNA, 601 bp, Human
tgaatatatatacacacatatatatgtatacatatgtgtgcatatataaatacacacatatatgagatatacaagtatacatatatagtgtgtatatatatgtacacatatatgtgtgtatatatatgtacacatatatgtgtgtatattagaatatatataacataaatatgtatatatatatattctgacctgtataaacacagtggatcctgagcaccagtggcctgaaaggatatgggttgctgggacatgaagaacaaaagcaggatacgcagatgctgaacagcgaaagaggccrttagatgaacagaaaaccaggtctaacaaggacagcttttcttccataaatgagtacacaatatatggaaaaaactatttttacatattggagaacagataaactgagataatttagaaagggaatcaaatgagatcaacccaataactaccttggctttgttcctggagacttcctgggctgaagaacaaggagatggagcccaagccgaccacagcagtcttgctgaactgaggaaggagactggagttgggattactaaaacagctgagattttctaggctaggtaataacatgaaa

SEQ ID NO: 146427 - DNA, 601 bp, Human
tcttgggcattcagtagtcaccacataaagccaaactttgggagtaggattagtgtattcctataataaaggccactccagaaacagcatagtaaagctgaaaagcaagtctaaaaaaatcaacacgatctccaagtaaattaactgattgccagaagaaaattcaaccctttagaggcaaacaacaaaatcaagttgctcagttatgtggcatccacaatgtgtgacctaaatttataactttaccagacatacaaaaagcatttactgtgatccataaccaggagaaaaagcactcaawacaaataaaccccaaaatgaagaaattggcaagaagatttgaaatatatatatatcataattgtgttcaaggatttaaataaaacatgaacatggaagaaacaaatggataatatcaaaaaagaaaaattataaaataaccaaatagaaattaaataactaaaaaagtgcatgtttaatgaaaaatgtactggctacccttaccatcaggttagacattacagaagaaaaagttaactagaaaataattcaatagaagtgatacaaactgcagcacacacatacaaagactgaaaagata

SEQ ID NO: 146428 - DNA, 601 bp, Human
tcctataataaaggccactccagaaacagcatagtaaagctgaaaagcaagtctaaaaaaatcaacacgatctccaagtaaattaactgattgccagaagaaaattcaaccctttagaggcaaacaacaaaatcaagttgctcagttatgtggcatccacaatgtgtgacctaaatttataactttaccagacatacaaaaagcatttactgtgatccataaccaggagaaaaagcactcaaaacaaataaaccccaaaatgaagaaattggcaagaagatttgaaatatatatatatcayaattgtgttcaaggatttaaataaaacatgaacatggaagaaacaaatggataatatcaaaaaagaaaaattataaaataaccaaatagaaattaaataactaaaaaagtgcatgtttaatgaaaaatgtactggctacccttaccatcaggttagacattacagaagaaaaagttaactagaaaataattcaatagaagtgatacaaactgcagcacacacatacaaagactgaaaagataaagaaacagagcctcaagaatatctatgaaaatatcaaaagatttcatatatgtgtaa

SEQ ID NO: 146429 - DNA, 601 bp, Human
aattgtaaagagctagtccaaaaaccaagtgtggaaaatgacatatcatgaaaataagaatcagaagaaagctggagtggtaatgttaatcccaaagtaatctacaagaaataataccacgatgaaaaagttatttcttaagtaaaaaaagtttattcatcaagacttaacaatgctaaatgggttgcaccctcataagagcccttctgatatatgaagcaaacactgacagaactgaagagacaaacagataagcccacaattagagtgggagatatcctaatgtctctctccgtatggwtatacatcttcccaaacaaaatataatagaaaaaatacacaaaaaaatcagaaagaatatatatgttttaaaggaaattgtcaacctatttaacactatgccaaactgcagaatacacattcaagtatgcatggagcattccccaacatataccatatgtgtgggcctacagcaagtcttaatagattgaaaagaattaaaatgatacagagtctgtttttgagcaaaacagaattaaatgagatataaataacaaaaaaattgggaaattatcaaatatctgaaaatgaaacaacacat

SEQ ID NO: 146430 - DNA, 601 bp, Human
attatcaaatatctgaaaatgaaacaacacatttccaaatacttcataagtcaaagaaggaatttagaaaagttttgaactgaataatagtaaaaatacaacatatcaaagttcgtatgatgcagcgaatgtttttagggttttataactttaaatgctttcagtagaaaatagaaacatgtaaaaatcaatgacttaagatggcatttctcaaagtatgctctggagaaacctgaagtctcttgagatcccttcagagacagtctatgaggttaaaacacctttaaatttaaaaaaaaaagattttatttgctatttcacttttatttcctgataagtgtacagtggagttttccagaggctacataatgtttgatcacattatctctctgatggctaataaaatgtgtgattgtctattatgtttaaaaacattctcagttttggatgcaataaatattcatagtatatattacaaaatgaaagctctttagggtccccaatactttttaagagttaaaggggtcttaagaccaaaaactttgagaactgttgatttaagataacttaaacatctagaaaaggagaagcaaataagatc

SEQ ID NO: 146431 - DNA, 601 bp, Human
gaaaatattggaaaggcatcagggggctaagctagaatataattggccttagtatggaaagtacaagcagcacaggccaggaaacctccacacatgtgagggttctcaggcctcttccctttagtgacatttctttaaagtttccattattggggactgtctctagtttctagtgtttgtatgctaggttccagtaatcaaagatgccctttatgaaatttaagtcagatttttcgagaaaaaatttggatgggccatcaggtcaccatgggacttcccttagcctcatgcattctctgckatggtttactttggggcctatgaatagggaagactgagatataggaaaaaccaaagtgtctgtgttcccccactctcacacccatgcagcataacacttctcacaccagatgtggggggatttctcctcacaccccaagcgagtctccagcagataccagctgggtgtcctacaatgtaactcagtgctgacactctatctggagacagtgtcagatcccataagttaaggctcagtcccacaagaccgccccactgcagatgccaatcccaagttccaggcggtgacctgtacttctgc

SEQ ID NO: 146432 - DNA, 601 bp, Human
aatgcatggaaataaatgtttctgaatcaacagcaaacaggcttcatcgggtaggagagcgctgagccctccagggacaatgcacatcaatgatgtcccactgtcctttggtgctggggctctaaggcctccactgggtcaggctcctgaagggagacccattctccaaagacccccgagggtcaccactccctgtccaggggtgtggcctcatagctccttttgaacaggggcacaggaaggacggctttagagcattcaaaaaataactttgccaaaataataataataataatagaaaggaagaagaggctgagcatggtggctcacacctgtaatccctacactttgggaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaa

SEQ ID NO: 146433 - DNA, 601 bp, Human
gtcaggctcctgaagggagacccattctccaaagacccccgagggtcaccactccctgtccaggggtgtggcctcatagctccttttgaacaggggcacaggaaggacggctttagagcattcaaaaaataactttgccaaaataataataataataatagaaaggaagaagaggctgagcatggtggctcacacctgtaatccctacactttgggaggctgagacaagcagatcacctgaggtcaggagttcgagactagcctggccaaaatggtgaaacctcatctctactgaaaatasaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgt

SEQ ID NO: 146434 - DNA, 601 bp, Human
ggcctcatagctccttttgaacaggggcacaggaaggacggctttagagcattcaaaaaataactttgccaaaataataataataataatagaaaggaagaagaggctgagcatggtggctcacacctgtaatccctacactttgggaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggakaatcgcttgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaa

SEQ ID NO: 146435 - DNA, 601 bp, Human
atggtggctcacacctgtaatccctacactttgggaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaaraaggaaggaaaaagaaacactcctttatgtcttctaaggatagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcaga

SEQ ID NO: 146436 - DNA, 601 bp, Human
gaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccat

SEQ ID NO: 146437 - DNA, 601 bp, Human
acctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgygtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcat

SEQ ID NO: 146438 - DNA, 601 bp, Human
cagggcagtgatgaagatcatgggagccacactgcccagcttcgcatttgggcttctcctagggacaccaagagggaggaaggaggggttaggatggtatgaaagattctacttggccaatattattgtaatgcggcattgtgatctctggatttagcatgagttgatagctgactttttctgcagaagcatcttggtggcacctctaactcaaagtccctcgatggagtcagttccagttctccacttctggccccatctggtacacaccactgcctctcactgcccgggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaagaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacac

SEQ ID NO: 146439 - DNA, 601 bp, Human
tttcatgcagaaggatatggtttattcaggtttgactcgtgcttgagaaagctagagcctctggtggtgaatgattttaataactatttcctttccaccaacatatacagtacaaataataataagcaaaaataaatagaaacattcagttttgttttgaatagtaggagcagggtaccatcatttctgtagttactcttttagtacaacgatgcatgtctactgtatgtaaggcatactagcagaaattgagctcagcactagagaagatgattgcattctatgccttgcttcttttttwaaaaaaaggcttccatagatagattctcagaacagcccatggcaaatgtaaagttatttggaaaacccaggttccagattcactagagcatagaatctctggttggttgggaaggaatttcctcttacagttgttactaataattgtatgaacaattatttaaaatattaacatttacatttgtgaagaccttgaagggctggagacaacagagaagcatttttgaataccctctgcagcccctgcactgttgtaggcattggtggatggtaccaaagatgggacactgtccctacctcc

SEQ ID NO: 146440 - DNA, 601 bp, Human
acaaaattatctccagtctatcacaggcacagattctttttctttggacactttcgtgaatcattgaattcaatgcagaggctactcatccattcgcaaacaaaaaaattctaggtcatgatccccataaatgaagagtgatcagtccaatcccagggaacctggacattttgggtattgtttcagtggaacatgcctttcataagttccattttcttgggtatctcttaggaagcaagcataggaaacaggcccatccgtctgcctgttttgcttcctcatctcacttctacacgagggygcctgtgctcaattgctgttttcccctaaagagactcttttccataagtttgtgaaatgccatcgacaaacctgatcgcattgcatttcactctgctgttgagtcgatttttctttattttatcatttagtaactccttgctctacagagctttcaccttccacatatttcagattcattctttcctaaactatgtggtggtctacgtcctcactgacttatcaacatgctaccatcatgcacttcctatctctattcctcttctttaaatttggttccaaatggctcacaccattattc

SEQ ID NO: 146441 - DNA, 601 bp, Human
ttggataagagagaagggaagggtttctagaaagaaactgcagaggaaagacacagtacagatgattttgtgggcctgaataaactgcagaacagagctgttcactaccataggctgtatcagtctctgcccaaacagcccaagaacattccttaactgcctgtttcaagcaaatcatgaattttgcttcttgccactcagaagtcactaattctgagtggccaagggtgtcagggagacagcaccaatttcatggcacagaggttacctgaaggggctggaccatattttcctcttgacrtcctcatcttttctaggtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcaggtactcgttcacctgtggtcttcaccccacgctggtgaagatatttgctttatgtctgggttttatgggccatggccactgcatggcagtggggaggaactgtctatcacatgaaaggctcaagggctttggggacagcatca

SEQ ID NO: 146442 - DNA, 601 bp, Human
tatgtccaggatggtgttgcctaggttgtcttccaggatttttgtacttttggattttacatttaagtctttaatccatcttgagttgatttctgtatatggtgtaaggaaaggggtccagtttccatcttctacatatggctagccagttaccccagcaccatttattgaatagggagttattttcccattgcttgtttttgtcagctttgttaaaaatcagatgtctgtaggtgtgtggccttatttctgggctctctattctgttccactggtctacgtgtcttttttttttttttttaccagtaccatgctgtttttgttactgtagccctgaagtatagtttgaagccaggtaatgtgatgtctccagctttgttctttttgtttaggattgccttggctattctggctcctttttggttatatataaatttttgaagtagttttttaatagtgctgtgaagaatatcattggcagtttgataggaatagcaatgaatctgtaaattactttgggcagtatggccattttaatgatattgattcttccaatccatgagcatgggatgtttttccattcatttgtgtcatctctgat

SEQ ID NO: 146443 - DNA, 601 bp, Human
catcttctacatatggctagccagttaccccagcaccatttattgaatagggagttattttcccattgcttgtttttgtcagctttgttaaaaatcagatgtctgtaggtgtgtggccttatttctgggctctctattctgttccactggtctacgtgtcttttttttttttttttaccagtaccatgctgtttttgttactgtagccctgaagtatagtttgaagccaggtaatgtgatgtctccagctttgttctttttgtttaggattgccttggctattctggctcctttttggttmtatataaatttttgaagtagttttttaatagtgctgtgaagaatatcattggcagtttgataggaatagcaatgaatctgtaaattactttgggcagtatggccattttaatgatattgattcttccaatccatgagcatgggatgtttttccattcatttgtgtcatctctgatttctttgagcagtgttttgtaattcttattgtagagatctttacctctctggttagctgtattcttacatattttattctttttgtggcatttgtgaatgggactgtgttcctgatttgcctctg

SEQ ID NO: 146444 - DNA, 601 bp, Human
tttggtccaatgctgagttcaggtcctgaatatctttgttaattttgtgcctcgatgatctgtctaatactgtcagtggagtactgaagtctcccactattattttgtgggcgtctaagtctctttgtaggtctctaagaactttatgaagctgggtgctcttgtgttgggttcacatgtatttaggatagtagatcttctttttgaattgaaccctttaccattatgtaatgcccttctttgtcttttttggtctttgttggtttaaagtctgttttgtctgaaattaggatggcaaccyttgcttttttgtctgatttccatttgcttggtaggttctcctccatccctttattctgagcctatgggtgtcattacatgtgagatgggtctcttgaaggtagcataccagtgggtcttgctttttatccagcttgccactctgtgcctcttaagttgggcatttagcccatttacattcaaggttagtattgctatgtgtgaatttgatgccctcattgtgttgttatgctggcttgtttgtgtgatggttttatagtgtcattggtctgcgtatttaagtatatttttgtattggctg

SEQ ID NO: 146445 - DNA, 601 bp, Human
ggttgtttggaggacatatggcactccggcctttatgttcctttaactgcagtgtaggttgaatacagccaatagacttgttctttggatgtttttacagggccaaagccttgtgcagggtctttatttgtagttgatttcttgtctttggtttcatagtgtggtatgttagcaaggtatttttggtgttgaagctttggggtgtgatccattttttatttgtatatttccctacacctaaaacaagcaaaaaaacagtaaaggtctttgagtctcttaatccataatttcagcattcctragtatgcttccctgggtaagtggggttttcacccagccctcaagttaagagtgttagattatttttcatgtgaaattagccagactggctttcttaacacaatgtaaaacaataacaacaaaagttataattagactagtcttcttcccaaatacccacatgtctaatgtaagtgggatggtgttaaacaggggacctacaactgggggagaggcggacaggtcccatggccccaggtctaggatggcatttggtattggttgatgggtgtggatgagaacaagagagggaacacttgtg

SEQ ID NO: 146446 - DNA, 601 bp, Human
ttcctgagtatgcttccctgggtaagtggggttttcacccagccctcaagttaagagtgttagattatttttcatgtgaaattagccagactggctttcttaacacaatgtaaaacaataacaacaaaagttataattagactagtcttcttcccaaatacccacatgtctaatgtaagtgggatggtgttaaacaggggacctacaactgggggagaggcggacaggtcccatggccccaggtctaggatggcatttggtattggttgatgggtgtggatgagaacaagagagggaacayttgtgcaggatatggtatcagcacctgtaatacattttagggattctttcttctctttgcagtatgccctgacaataattatatccatcagcctagtccccttggccattgaaacactaagactgtcttaggatccctgctgcagtttctcagaggtgctaggagggcattaggagtctgaagccctggaagtgtgttctgactttgccactagctagatagacctggactaggcacattacctctttgtaccactcagctctaacccctcattcaaaaacccagcattttcaagtggtg

SEQ ID NO: 146447 - DNA, 601 bp, Human
aactcttgttgattgtttcctcagctgaaatgtgggctgcagggctattgggggagaaacaataagaaagtgcaccaagcaccaagcacatgctaagaagtccatcatggcagctcctgataataatatggaatagagttgtatctaacatgactctttcttgcaagtgacagaaaatgcaacttaagttggattaagcaaaaaagagaaattattagtgaactgaaaattctgcaggctcacatcatggccccagaccctgtccattattcttgggcacaaatgtgatattctcgtggcygcagatgctgtggtggctctggctctgccaggaaaagaaataaggaaggccactctccccattacacaaacaatagtcttccagctctgagaggtcgaacttgtgtcaccagcctgcccctaaacccgtcactgattaactccaacctgcatcagctgttccatgctggaggtggacgcaggaccacactcataccaagatgggggcaaagtgtagttccctcaacaggattataggatatagtgtgataggctgctgggcagccaaaaagcaaacagatcctctacaattcctcaactg

SEQ ID NO: 146448 - DNA, 601 bp, Human
gtgacagaaaatgcaacttaagttggattaagcaaaaaagagaaattattagtgaactgaaaattctgcaggctcacatcatggccccagaccctgtccattattcttgggcacaaatgtgatattctcgtggctgcagatgctgtggtggctctggctctgccaggaaaagaaataaggaaggccactctccccattacacaaacaatagtcttccagctctgagaggtcgaacttgtgtcaccagcctgcccctaaacccgtcactgattaactccaacctgcatcagctgttccatgmtggaggtggacgcaggaccacactcataccaagatgggggcaaagtgtagttccctcaacaggattataggatatagtgtgataggctgctgggcagccaaaaagcaaacagatcctctacaattcctcaactgatgaaagcacgaagctaaaatcataaagatctgtgtgtgagttctggctctcccatcttccttgtgagattgagcagttagttaatctcttttagcctcagctttctcacctgtaccaacatataaggtcattgtgaggattaagattatgcctcatgatcatcat

SEQ ID NO: 146449 - DNA, 601 bp, Human
tttcctcattcccaaaggaaacctcatgttcattaagcagtagctccccttaacatattagttatgaagatcatagcattatacaaaactcatgacacaatgatgagtgaaaaaatcaagatgtgaaattttgtgttatgatgtaattagtaaaagaagcatattaaaacatctgaaaaaagagtatataaaaatagcaattgcatttttcagactctacattttaaacattattctttatagttttaaaagcaaaaagtaaagaaacaacaaccaaccccaaaccaacacgacaaagccsagattgttaattccagggctcaggaacacagaatcatatatgatgtttacactctgcagggtcagagactccagcggcattgggagctgcctcgtgttctgcagcctcacagacaggaggtccagtgccgctgctctgttctggaatatcctcctgaatgtgttttgggtgcagttgccatttctttcatctttttaaacacaggtacttttggagctggccttctcaaggaagcccagctccctgtgattgagaataaagtgtgcaatcgctatgagtttctgaatggaagagtccaat

SEQ ID NO: 146450 - DNA, 601 bp, Human
cccccaccattttccacaacagctcctctatagtcacaaagttggctatttccctaatacaatgattcctttacttttactttagggttcttacttatatataaaaattactcaggccactgaattaaaaactggagataataaaaactaagagaaacagtgcaaatcactaaataaaagggatatatatgtgtatttctcaattcaacaaaggtccaataactaaaatagatttgcttctggggattctaaacaaaaagttgacccccatcccccatctttctctttcccactactcaaytttcatcttcctcagtctccaaaacctttttaagaagatactggagcctccctaagagaactgagttatgtgtgagaaacaagacacaaggacacggaagtgtcactggctggtacatactattttggtaaaaataatttttttagggctctcgaattatcaaattattactgcttttcatacctgaaccagccagatgccatcttttgtgtcttccacaagctcatagaagtgcatttcaccactgaaattggtactagaaaccgattcggatgcttcttcttccttgagagcagaata

SEQ ID NO: 146451 - DNA, 601 bp, Human
tccaccttatttttcaactccaactgacacagaaataaactaaaatttaaatagataatgtatagactacactcatactctcacattctctcccattgctgaacttaaaaattactgaattagattatccggaaggtaaaaggacaaatgcaataggaaggatacaataaagaaaggccatggatgaacaatgtaaatctctggaagaattcccaaacctcaaccctttagcacagtggactacagtaccattttatcctttttagatgtatatgtatttatttgaggccacgtgcaacacaaaaatatacctatttacaatcatactgctagtcagtgacagtaccagacctgtaacagcgacagtaccagacctgcaactaatgtctctgaactcatagcttttcctaccatattttgcagtctttactctcagaaagaaatatgaagaaactgttttaattttcatgccctgaatcaaactttgcccactccagtgtgaaatgacaagagtaccagtcaagaaatcagaagacctgggtttcatcctggttcaatactaccaactagttccatgaccttgggcaagctacttcacctc

SEQ ID NO: 146452 - DNA, 601 bp, Human
ggagtctctactttcaaaatcataagccaacctagtatatacatgcaaactatataaaaccattaagagtaaggacaagtgattgacaaaaaacagtggtcttttaatttttttgtattcttacatagaatttataaaattttttaccaatacaaaatataagataaagtggcttgctatgtgcttcacctccatagcagtatcaagaaagaaatacgtaatttagaatctcctcgaacaaaacttttgtctaggagcaaagataaacaagtttaaaatcagctattaactcttgtcagcsaaacaggaaatatattgatgtaatacttcagtaaatattgacccaaagctttattttaaatcatatgatgcttctcactgctacctcaattccagtgactttaaattccatatgatgtaacacagccagtagggaacaaatatgtccttctttgaactatgacaaaagtcaaaacggagaaacagaaatgttaggaggaggataaatccataaaacccataaattatgctaacttctccacttcagaagcctatccactgtgccatctgcctctctgaccaagggtcttttgaaagaaaa

SEQ ID NO: 146453 - DNA, 601 bp, Human
aacagtggcataaatggtaccctgctaagcaactgcatattaatgttcttgacctcagtcagacataaagatgtttaattcagtgcattttaaaatgcccattatttagaggtgaggtttattactgatcaaaccatgtggcataccccttttaatactgttaatctccatacaacgacatccaggtttagttaagtaacataactccctggaacaatgagagtattgtgctatgatattttctgcattctcagtatttcattataatagggagtctctactttcaaaatcataagccaayctagtatatacatgcaaactatataaaaccattaagagtaaggacaagtgattgacaaaaaacagtggtcttttaatttttttgtattcttacatagaatttataaaattttttaccaatacaaaatataagataaagtggcttgctatgtgcttcacctccatagcagtatcaagaaagaaatacgtaatttagaatctcctcgaacaaaacttttgtctaggagcaaagataaacaagtttaaaatcagctattaactcttgtcagccaaacaggaaatatattgatgtaatacttca

SEQ ID NO: 146454 - DNA, 601 bp, Human
ttctagcatttggttttgaagagtttaaggatccctgactgacagagctacacaaaaatgaaaaatcttgtaggcattgcatgaaagcattttatattactttatagttatatttatgcaattaaaaatgtgtccaatgtcctacatagttatataattcaactgaaggtttagcataaattaaatttggtggagtttaaattaaccaaccactataaaaatgctaatattttcacaaaataactcatctggttgagtcacacagcacaacaaaatattctcagcctaatatatatatatacatatgccttatatatatatatatataatatatatacacacacacactatgtcataccagtaagagtccccaatttatagctcatatcctagaaggatgcatgatgattctgagtggcattcatatggctggtctcattaaaaggggagacattttcctcagcagctcaggaaggaacactgtatgtggggaacattttcaaagactacaaaaaaactggacaaagtacagcttgagttccaggtgtggaacagacctggcaatacaggctagaagtgaagcaatctttccattcccttt

SEQ ID NO: 146455 - DNA, 601 bp, Human
agacaagtttaacttatttttcagattccttaggaagattaagaagtatctgtgcaatcatactaccatactctctactctttgccctcttttaaaaataactcacttttcaggcattatcccatttcttgatcaaggttgcaaataacccaaacatttcaggtctgtgtgcagaatgacactgctccaaggagtttagaggttgcctcgccagtgtaaatatttagttcctaagtctggaggcatctttcagtgaagatcttgttcactgcacaggtatctttgagacatgtgataagarctccaatgttaggaaaagaaggaggaatgagaggggttcttcccaggtacctcttggttatagcagagatagtagaagtgagtgaaaagagttgggaacatacctggggcaggtacaagacaatgttcaatgccagggccttatttattcagcaacgtgttctagcatttggttttgaagagtttaaggatccctgactgacagagctacacaaaaatgaaaaatcttgtaggcattgcatgaaagcattttatattactttatagttatatttatgcaattaaaaatgtgtccaatgtc

SEQ ID NO: 146456 - DNA, 601 bp, Human
tgccgggcgtggtggtgcacacctgtaatcctagctacttgggaggctgaggcagcagaatcgcttgaacctgggaagcagaggttgcagtgagccgagattatgccactgcactccagcctgggtaacagagcaagactccatctcaaaaaaaagagagaaaaaaaagttgtacctagaaaattaggaagatcaagcaaagcaggcgcctattgcctcttgttctttattttattttatttttattgctaccactcaagagtcaatctggtagttcttttggtcaaataatcaaagacamgtttaacttatttttcagattccttaggaagattaagaagtatctgtgcaatcatactaccatactctctactctttgccctcttttaaaaataactcacttttcaggcattatcccatttcttgatcaaggttgcaaataacccaaacatttcaggtctgtgtgcagaatgacactgctccaaggagtttagaggttgcctcgccagtgtaaatatttagttcctaagtctggaggcatctttcagtgaagatcttgttcactgcacaggtatctttgagacatgtgataagagctcca

SEQ ID NO: 146457 - DNA, 601 bp, Human
agcacttttggaggctgaggctggtggatcatttgaggtcaggagttcaagaccagcctggccaacatggcgaaaccccgcctctattaaaaaaaacaaaaatttgccgggcgtggtggtgcacacctgtaatcctagctacttgggaggctgaggcagcagaatcgcttgaacctgggaagcagaggttgcagtgagccgagattatgccactgcactccagcctgggtaacagagcaagactccatctcaaaaaaaagagagaaaaaaaagttgtacctagaaaattaggaagatcaarcaaagcaggcgcctattgcctcttgttctttattttattttatttttattgctaccactcaagagtcaatctggtagttcttttggtcaaataatcaaagacaagtttaacttatttttcagattccttaggaagattaagaagtatctgtgcaatcatactaccatactctctactctttgccctcttttaaaaataactcacttttcaggcattatcccatttcttgatcaaggttgcaaataacccaaacatttcaggtctgtgtgcagaatgacactgctccaaggagtttagagg

SEQ ID NO: 146458 - DNA, 601 bp, Human
tagaaggccaggtacagtggctcatgcctttaatcccagcacttttggaggctgaggctggtggatcatttgaggtcaggagttcaagaccagcctggccaacatggcgaaaccccgcctctattaaaaaaaacaaaaatttgccgggcgtggtggtgcacacctgtaatcctagctacttgggaggctgaggcagcagaatcgcttgaacctgggaagcagaggttgcagtgagccgagattatgccactgcactccagcctgggtaacagagcaagactccatctcaaaaaaaagagagaaaaaaaagttgtacctagaaaattaggaagatcaagcaaagcaggcgcctattgcctcttgttctttattttattttatttttattgctaccactcaagagtcaatctggtagttcttttggtcaaataatcaaagacaagtttaacttatttttcagattccttaggaagattaagaagtatctgtgcaatcatactaccatactctctactctttgccctcttttaaaaataactcacttttcaggcattatcccatttcttgatcaaggttgcaaataacccaaacatttcaggtc

SEQ ID NO: 146459 - DNA, 601 bp, Human
tcagacagctgaagtaaccaggaagaaggcaatctggggacatgcacttaataggtgaaagctcttttgaaggatgctcacacgtttccctacccagtaagtccctagctttacatttttctctggtccaaaagtactttataagttttacctagaaggccaggtacagtggctcatgcctttaatcccagcacttttggaggctgaggctggtggatcatttgaggtcaggagttcaagaccagcctggccaacatggcgaaaccccgcctctattaaaaaaaacaaaaatttgccgggygtggtggtgcacacctgtaatcctagctacttgggaggctgaggcagcagaatcgcttgaacctgggaagcagaggttgcagtgagccgagattatgccactgcactccagcctgggtaacagagcaagactccatctcaaaaaaaagagagaaaaaaaagttgtacctagaaaattaggaagatcaagcaaagcaggcgcctattgcctcttgttctttattttattttatttttattgctaccactcaagagtcaatctggtagttcttttggtcaaataatcaaagacaagtttaac

SEQ ID NO: 146460 - DNA, 601 bp, Human
aatttattcaaatactcagacagctgaagtaaccaggaagaaggcaatctggggacatgcacttaataggtgaaagctcttttgaaggatgctcacacgtttccctacccagtaagtccctagctttacatttttctctggtccaaaagtactttataagttttacctagaaggccaggtacagtggctcatgcctttaatcccagcacttttggaggctgaggctggtggatcatttgaggtcaggagttcaagaccagcctggccaacatggcgaaaccccgcctctattaaaaaaaasaaaaatttgccgggcgtggtggtgcacacctgtaatcctagctacttgggaggctgaggcagcagaatcgcttgaacctgggaagcagaggttgcagtgagccgagattatgccactgcactccagcctgggtaacagagcaagactccatctcaaaaaaaagagagaaaaaaaagttgtacctagaaaattaggaagatcaagcaaagcaggcgcctattgcctcttgttctttattttattttatttttattgctaccactcaagagtcaatctggtagttcttttggtcaaataatc

SEQ ID NO: 146461 - DNA, 601 bp, Human
gcttaatgaatacatatacacaatttagggcattaagcaaatggttttgatattacatttttttttaagggacagggtctcactctgttccccaggctgaagtgcaatggctcaatcatggctcactgcagcctcaaatacctggcctcagggttccttctgcctcggcctcccaagtgttggaattacaggcatgaaccactgcacccaaccatggttttgatagtactttttaatgaaaataagtggtcttattgaggcagatacaatttattcaaatactcagacagctgaagtaacsaggaagaaggcaatctggggacatgcacttaataggtgaaagctcttttgaaggatgctcacacgtttccctacccagtaagtccctagctttacatttttctctggtccaaaagtactttataagttttacctagaaggccaggtacagtggctcatgcctttaatcccagcacttttggaggctgaggctggtggatcatttgaggtcaggagttcaagaccagcctggccaacatggcgaaaccccgcctctattaaaaaaaacaaaaatttgccgggcgtggtggtgcacacctgt

SEQ ID NO: 146462 - DNA, 601 bp, Human
ttaatgtaatgaattttacattattgaacttgtacttcaaatttgcaagagctttcaaacacaattaggattaggaaaagcaaaagattcttaagaaaagaaaaagaggccaggtgtggtggctcacgcctgtaatcccaacatgttgggaggccgaggcagatgcatcacttgagtcgaagagttcaagaccagcctggccaacatggcaaaaccccgtctctactagaaatacaaaaattagccaggcatggtggcaggcacctatagtcccagctgctcagaaggctgaggcatgagwatcacttgaacctgtgaggtggaggttgcagtgagtagaggttgcaccactgcaatacagcctgggtgacagagcaagaccttcaaaatatgtcaagacttctcttataagtgtcagcctttctaatcattaccaccttttccctttatctcctaatcttcctgcctttaatgaaggcagaatttcaatgcagataccagtaaaaaccaaaaaacattaaaaacaagaccataaaaataactaaatgggaagttaaaggaaagccaaaaatgtctaaagtcatcatgaaaccatctgttt

SEQ ID NO: 146463 - DNA, 601 bp, Human
ttcattctttaatgtaatgaattttacattattgaacttgtacttcaaatttgcaagagctttcaaacacaattaggattaggaaaagcaaaagattcttaagaaaagaaaaagaggccaggtgtggtggctcacgcctgtaatcccaacatgttgggaggccgaggcagatgcatcacttgagtcgaagagttcaagaccagcctggccaacatggcaaaaccccgtctctactagaaatacaaaaattagccaggcatggtggcaggcacctatagtcccagctgctcagaaggctgargcatgagtatcacttgaacctgtgaggtggaggttgcagtgagtagaggttgcaccactgcaatacagcctgggtgacagagcaagaccttcaaaatatgtcaagacttctcttataagtgtcagcctttctaatcattaccaccttttccctttatctcctaatcttcctgcctttaatgaaggcagaatttcaatgcagataccagtaaaaaccaaaaaacattaaaaacaagaccataaaaataactaaatgggaagttaaaggaaagccaaaaatgtctaaagtcatcatgaaacc

SEQ ID NO: 146464 - DNA, 601 bp, Human
actgaaaacaggctgggtgcagtggctcacacctgtaatcccagcactttgggaggccaaggtgggcagatcacaaagtcaggagattgagaccatcctggccaacatggtgaaaccccatctctaccaaaaatataaaaattagctgggcatggcaacgcgtgcctgtaatcccagctacttgggaggctgaggcaggagaaccgcttgaacccgggaggcagagggtgcagtgagccgagatcacgccactgcactccagcctgggcgacagagcaaaacttcgtctcaaaaaaaaaaraaaaaaaaaaaaagaaagaacaatgaaaacagctgttgtatcccagtaaagagactgtaagtgaaaatattttccttttgtttttattttttaatttttagttattttatttttataataagagatagggtctttccctgtcacctaggctggagtgcactgatgcaatcacagttcattgcagtcttgaactcctgggctcaagcgattctcctgcctcagcctccttgagtagctaggaccacatatgcacgccaccatgctaggctaagttttaaaagaattttttgtagagttggg

SEQ ID NO: 146465 - DNA, 601 bp, Human
cttcccttaaaaaagtaggtaatgagagaaaagaaatattaaaaactgaaaacaggctgggtgcagtggctcacacctgtaatcccagcactttgggaggccaaggtgggcagatcacaaagtcaggagattgagaccatcctggccaacatggtgaaaccccatctctaccaaaaatataaaaattagctgggcatggcaacgcgtgcctgtaatcccagctacttgggaggctgaggcaggagaaccgcttgaacccgggaggcagagggtgcagtgagccgagatcacgccactgcamtccagcctgggcgacagagcaaaacttcgtctcaaaaaaaaaaaaaaaaaaaaaaaagaaagaacaatgaaaacagctgttgtatcccagtaaagagactgtaagtgaaaatattttccttttgtttttattttttaatttttagttattttatttttataataagagatagggtctttccctgtcacctaggctggagtgcactgatgcaatcacagttcattgcagtcttgaactcctgggctcaagcgattctcctgcctcagcctccttgagtagctaggaccacatatgcacgcc

SEQ ID NO: 146466 - DNA, 601 bp, Human
gttccctgcagacagtggttcagttggaaggtgacaataaactggtgacaactttcaaaaacatcaagtctgtgaccgaactcaacggcgacataatcaccaatgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaycctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccagttatgcagtcagccttggtgcctggctgccagccacatcctataccctatttgggggtgaatggtgcagtgtttctcctgcaggtatgtccccctgactcttctttgcccccagaatatgctttagggagtcacagacaacagaaca

SEQ ID NO: 146467 - DNA, 601 bp, Human
ctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccagttatgcagtcagccttggtgcctggctgccagccacatcctataccctatttgggggtgaatggtgcagtgtttctcctgcaggtatgtccccctgactcttctttgcccccagaatatgctttagggagtcacagacaacagaacactgccycagggcgctgtcatcactctattcaaatggaaaaattcttaaactagagagagtgtgagcatcaaccacccaatgtgcagtttccacctccgccccagcacattcccaggagagcaggggagcaggagatgagctgtcctgcagtaagtcctggccaacgccctttgataggttccatctcacctaatcctcctgtctccttcgagggaggctggatgagggattcaatagacaggttgacctgtccaagtcatcagctaataaatgttaaatccagggctcaaacccatcaagcagcaa

SEQ ID NO: 146468 - DNA, 601 bp, Human
atgtgttgaatcacactaagcaatagagggagagttcattagaattctcttcaggctgagcaaccacaagcgatgctttcagggtccagtggactgtaaaaagggcaattcaggctgggtgcagtggcacatgtctgtaataccaacactttgggaggccaaagcaggaagactgcttgagcccaggaatccaagaccagcctgggcaacacagtgagattccatctccacggaagggaaaaaaaaaaaaaaagacaaattagccatacagtggtgcgtgcctatagtcccagctactcaraaagctgaggcaggaggactgcttgagcccaggatttcaaggctgcaatgagccaggatcttaccactgcacttcagcctgggtggcaaagcaagatcctatctcaaaaaaaataaaaaataaaaaagtgggaggggggcaacttaaacctggaactcagaaagaaaaaaaaagcaaaaaccaacccaccaacgaaccaaaaaacctccactctccctaaggacaacacctaagtcagtcagctgaattgcaagtaacaatatattagaatttaaaagcccattctgcattaagtttgaa

SEQ ID NO: 146469 - DNA, 601 bp, Human
tgttgtttgttacagcatcacctcctatcctggccacttgtttatacctgtgtcacagtacttatcggagagtaccatgaatatattagtttgcaagtcaaattctactgacactatattatttatctttctcttctcagtgctcagcatgtaactgacactcaaatatgtgttgaatcacactaagcaatagagggagagttcattagaattctcttcaggctgagcaaccacaagcgatgctttcagggtccagtggactgtaaaaagggcaattcaggctgggtgcagtggcacatgyctgtaataccaacactttgggaggccaaagcaggaagactgcttgagcccaggaatccaagaccagcctgggcaacacagtgagattccatctccacggaagggaaaaaaaaaaaaaaagacaaattagccatacagtggtgcgtgcctatagtcccagctactcagaaagctgaggcaggaggactgcttgagcccaggatttcaaggctgcaatgagccaggatcttaccactgcacttcagcctgggtggcaaagcaagatcctatctcaaaaaaaataaaaaataaaaaagtggga

SEQ ID NO: 146470 - DNA, 601 bp, Human
agcaacgcaaaattatcttaatggacgtagaaggcttgtttgtttcaaagtttttcataaaaatatttcttaccctattcagctaatcttttgagaggacacagaggaaacaagaaaatctcagacagagatcttaggtgcagtggctcacacctgtaatcccagaactttgggaggccaagccgggaggatcagctgagcccaggagttcaagaccagactgggcaacatagtgagaccccatctctactaaaaaaaaaagaaaagaaaagaaaattgcagccagagaaagcatttggtsgtatgctccatattgcaacatggaaaaatgcactggttctaagagcagttgttaatatttgaaatcaatcctagctactatagatctgctcatgagagcaagtttaaataaataggttgacatctttgtgcagtcatttagagcaagttctacatattcagcaagatcaaaactatattttgcagaaattcagagagagtatttattagtatttatctgtcttgctagagagccaaaggaacagtattcagagtgaatgatgacaaaaagtttgttttacatggagggtagcattattgc

SEQ ID NO: 146471 - DNA, 601 bp, Human
caatgttctcttggggatatgcttagtagagaaggaagatgatgtattgagttattgaatttgtactgatccacattgaaaacaaaattccatttatgataacaaaacttccctgttgtaagttgcacttaaatattgtgagcttaaatatttcaaaataatgatctccattgagtatagctatgtgtgtggctattaaaaagtagacctcctcttttctatcccttgaatgaaactatttttttttttaaatctgaagtggattcaaggactaacgcttttttttttttttttttttttttagacacagtcttgctctgtcgaccaggctggagtgcagtagtgcgatctcagctcactgcaacctctgcctcctgggttcaagtgattctcctgcctcagcctcccgagtagctgggattacaggtgggcaccaccatgcccagctaatgtttgtatttttagtaaggacaaggtttcaccctgttggccaggctggtctcaaactcctgacctcaagtgatcctcctgcctcgccctctcaaagtgctgggattacaggtgtgagccaccgtgcctggcctaacaatttggttttaag

SEQ ID NO: 146472 - DNA, 601 bp, Human
atatccttctgggaatttctaaacttccaggcaggctagagacatagcccccaaaacagggaaaaaagtgtttttctcctgagggctttcccatagaaatgagaaatgtttagtattttttagaacaataaggtaaacatttaatgtaaagatattcataagtcactaccagacttttatacctccaaaataatttctaaaaacaataaaataggaaaaccttcatgtaaattagctggagcaattatttgaatcagctggtatactttatcagctggtccttatcaaatgggtcacatcyaagtaaatttctgtttaaatcaatagaagaaagtaaggggaagactttaccaagatatggaaagaattctgttgtcacatgatttgtgttacacatcgcttaggtatatgaaactttggcagaaatgtatacagtcttcacattcagtatctatttactatataatgatgatggctaagatgtactgagtactagatagtatgctaataatttagatattattcatgtataaattaatccacataaccctatgaaataggcattattattatagctcttacatggatgaggaatctgtac

SEQ ID NO: 146473 - DNA, 601 bp, Human
taccatgtaccaactgcagagtaaagccagccatatcaccccaagagaatctctctaaaacaaatcatctcaatagtcttcacttccattgctgtgagaagaaaatggcttttgtctttttttttttttttttgagacggagtctccctctgttgcccaggctggagtgcagtggtgcgatctcagctcactgcaacctccacctcccaagttcaagtgattatcctgcctcagcctcctgagtagctggggttacaggcgcccaccaccatgcctggctaatttttttttttttttttttggtatttttagtagagacagggtttcacaatgttggccaggctggtcttgaactcctgacctcaaatgatccacctgcctcagcctcccaaagtgctggcattacaggtgtgagccaccacgcccagccttcttttgtcttttttttttttgtatgagaatgccattaatgccatgcagcaaaacttattccaaagaatggcagtttctcattgtgtgatgagactaagagaaaggtaataaagtagactggttaagtgccctggccaaggttacagagcaacgataaaaggataatctt

SEQ ID NO: 146474 - DNA, 601 bp, Human
aagacttcaaacatcagcaacatcaaaagagttgagtggcctttcagggacccaattaagtgttatgatgaccataggaccacatcagacaaagatgataaaggagggaggaataaacctctccctaacttagaggatccctgtggaggtaaccatgacagaggaaaatgggagtaacaaagacagcaattattgttatcagaggctggctacaagtgccccagatgtaccataccatgtaccaactgcagagtaaagccagccatatcaccccaagagaatctctctaaaacaaatcatytcaatagtcttcacttccattgctgtgagaagaaaatggcttttgtctttttttttttttttttgagacggagtctccctctgttgcccaggctggagtgcagtggtgcgatctcagctcactgcaacctccacctcccaagttcaagtgattatcctgcctcagcctcctgagtagctggggttacaggcgcccaccaccatgcctggctaatttttttttttttttttttggtatttttagtagagacagggtttcacaatgttggccaggctggtcttgaactcctgacctcaaatg

SEQ ID NO: 146475 - DNA, 601 bp, Human
aactcatttttctcctccagtctctggtccattgtttctcaaagggtggttccatgaccttgttaaaaatgctgtttcggccgggagcggtggctcacgcctgtaatcccggcactttgggaggtcgaagtgggcggatcacgaggtcaggagatcaagaccatcctggctaacacagtgaaaccccgtctgtactaaaaaatacaaaaaaaaccccaaaaaacaaaaaacaaaaaacatagctgggcgtggcggcacgcgcctgtagtcccagctactccggagggtgaggcgggagaayggcgtgaacctgggaggcggagcttgcagtgagccgagatcgtgccactgcagtccagcctgggcgacagagcaagaccctgtctcaaaaaaaataaaataaataaataaaaataaataaacaaacaaataaaaataaataaataataaaagataaaaatataaaaagccactagctttcacatagatgagcttttgcatggaaataaattaaataacaaataaaaaatgtaaaaaacccctctagtctggcttttacaatctaatacattgtgaccagagtgccagtcctaaaatacaa

SEQ ID NO: 146476 - DNA, 601 bp, Human
tattgatgttattgctcctcttggatgtgagagattctcagactttccttgtttttgatgaccttgacagttttgaggagaactggtcaggtattttgtaggatatccataaactggtatttaatgtttttcttattattagactggagttatgggttttttgggaggaagaccacagagatagtatcatttttatcacatcaatatcaaggatacatgctatcaacatgaccgatcgatgctgatgttaaccttcatcacctggttgagggtactctgtcagtttcttccattgtgaagktactcttttcctctcctttctacactgtcccctttggaagggagttactaaatctggcacaacttaaggggtggtgaattatgctctacttccttgagggataaataactatatgaattacttggaattatacactggagatttatctcttctccccatttgttttattcaatcatttatatcagtccagctttttttaatcaaatgactgtgctctgatacctaaatttttatcaccaagatgaaagtattttaacactaagaaatctgcttagaaatatttatttgagatgcttacat

SEQ ID NO: 146477 - DNA, 601 bp, Human
tcactgcaaagatgacagaatgcattatattcagggttaccttgtatatggacattattctcataattttatgggttccttctagttagaaccaaataacttattcactcatctccttcaaaatagctcatatgcaagttgacacttcttaatgatactgagataatcctctaatgatattatcccaaatcctcattaccaatctagggatggaaaatctaaaacatttcaattcatatcaattcaccaagaaataaattgttttatcaggtgttattctattctagtcttttttttttawaaataaacatttattttagaatagtttttttcttttttttgagacagggtcttgcttcattgcccaggctggactgcagtgttgcaatcactgctcattgcagccttgagcttccaggctcaattgatcctcccacttcagcctcctgagtagctggactataggcacttaccacctcgtgtggctaattttttaaaaacattttttatagagatggggccttactatgttgtccaggctggtctcaagtgatcctcccaccttggcttcccaaagtactgagattacaggcgtgagcac

SEQ ID NO: 146478 - DNA, 601 bp, Human
ttcactgcaaagatgacagaatgcattatattcagggttaccttgtatatggacattattctcataattttatgggttccttctagttagaaccaaataacttattcactcatctccttcaaaatagctcatatgcaagttgacacttcttaatgatactgagataatcctctaatgatattatcccaaatcctcattaccaatctagggatggaaaatctaaaacatttcaattcatatcaattcaccaagaaataaattgttttatcaggtgttattctattctagtcttttttttttwaaaataaacatttattttagaatagtttttttcttttttttgagacagggtcttgcttcattgcccaggctggactgcagtgttgcaatcactgctcattgcagccttgagcttccaggctcaattgatcctcccacttcagcctcctgagtagctggactataggcacttaccacctcgtgtggctaattttttaaaaacattttttatagagatggggccttactatgttgtccaggctggtctcaagtgatcctcccaccttggcttcccaaagtactgagattacaggcgtgagca

SEQ ID NO: 146479 - DNA, 601 bp, Human
tttcactgcaaagatgacagaatgcattatattcagggttaccttgtatatggacattattctcataattttatgggttccttctagttagaaccaaataacttattcactcatctccttcaaaatagctcatatgcaagttgacacttcttaatgatactgagataatcctctaatgatattatcccaaatcctcattaccaatctagggatggaaaatctaaaacatttcaattcatatcaattcaccaagaaataaattgttttatcaggtgttattctattctagtcttttttttttaaaaataaacatttattttagaatagtttttttcttttttttgagacagggtcttgcttcattgcccaggctggactgcagtgttgcaatcactgctcattgcagccttgagcttccaggctcaattgatcctcccacttcagcctcctgagtagctggactataggcacttaccacctcgtgtggctaattttttaaaaacattttttatagagatggggccttactatgttgtccaggctggtctcaagtgatcctcccaccttggcttcccaaagtactgagattacaggcgtgagc

SEQ ID NO: 146480 - DNA, 601 bp, Human
cgcctggagtttagatgtatggaaatgcctggatgcccagacaaaagtttgctacagaggcagggccctcataaagcgcctcagctagggcagtaagtaagggaaatgtggggttggagcccccacacagagtccctactggggcactgcctagtggagctgcgagaagaggtccactctcctccagaccctagaatggtagatccaccaacttgcaccgtgcacctggaaaagccgcagacacttaacgccagctggtgaaagcaggcaggagggaggctgtaccctgcaaagccacagrggcggagctgcccaagaccatgagaacccgcctcttgcatcaccgtgacctgtttgtgagacctggagtcaaaggagctcattttggagccttaaaatttgactgctccgctggattttggacttgcatgggccctgtaacccctttgttttggccaatttctcccatttggaatggctgtatttactcaatacgtgtacccccaccgtatctaggaaataactagtttgcttttgattttacaggctcataggcggatgggacttgccaaggcaaggcaaagtctcagatgagactttt

SEQ ID NO: 146481 - DNA, 601 bp, Human
aggacccagaggcccaggaggaaaaagtggtttcacgggctgggcccaggttccccatgctgtgtgcagccacttggtgccatgtcccagctgctccagccgtggctaaaaggggccaatgtacagctcgggctgtggcttcagagggtggaggacccaagccttagcagcttccatgtggtgttgagcatgcgggtgcacagaagtcaagaattgaggtttgggaacctccgcctggagtttagatgtatggaaatgcctggatgcccagacaaaagtttgctacagaggcagggccctmataaagcgcctcagctagggcagtaagtaagggaaatgtggggttggagcccccacacagagtccctactggggcactgcctagtggagctgcgagaagaggtccactctcctccagaccctagaatggtagatccaccaacttgcaccgtgcacctggaaaagccgcagacacttaacgccagctggtgaaagcaggcaggagggaggctgtaccctgcaaagccacagaggcggagctgcccaagaccatgagaacccgcctcttgcatcaccgtgacctgtttgtgagacctggagt

SEQ ID NO: 146482 - DNA, 601 bp, Human
tggaaaatttgcagcctatgtgatagaaaagaaaaaccaattttctggggagaaattcaagccagctgcagaaatttgcataagtagcaaggagcctaatgttaatccccaagaccatggagaatgtgtcacaaggccacatcagagaacttccctgcagcccctcccatcaaggacccagaggcccaggaggaaaaagtggtttcacgggctgggcccaggttccccatgctgtgtgcagccacttggtgccatgtcccagctgctccagccgtggctaaaaggggccaatgtacagctygggctgtggcttcagagggtggaggacccaagccttagcagcttccatgtggtgttgagcatgcgggtgcacagaagtcaagaattgaggtttgggaacctccgcctggagtttagatgtatggaaatgcctggatgcccagacaaaagtttgctacagaggcagggccctcataaagcgcctcagctagggcagtaagtaagggaaatgtggggttggagcccccacacagagtccctactggggcactgcctagtggagctgcgagaagaggtccactctcctccagaccctagaatg

SEQ ID NO: 146483 - DNA, 601 bp, Human
ctatgatactttaaagaatgaaagagtgtgctaactgaagagcacatttaaatgagctggttcataaaatgtgctacaacagtccttggcattagtaagccatgtgttagctattattattatcaatgacaattaattctttattgtctcccatctagcattctgactggttttccccgcttctattcttgcctccttctccattctcttcatagaaggaaagggtcttttaaaactgtaagttagatgtcaatccctggctttcctctgcacttaaaaaaatcgagttctttccatggtstacaaggcccctcaatcactatgccctaggcacaaaagcctcttaactctttctccaatacactaatacctcttctcacctgcaccaagcagcctgagtactcttaaccttattcttcacagcctcaggtcctggtgtcagtggcacctcccttgagaggttcttgggaacactgagtccacaatgggttctgaatgcactattgcttcttcctcattttctcttgccgccgccatgtaagaagaggctttcacctcccgccatgattctgaggcctctccaaccatgtggaactgtaag

SEQ ID NO: 146484 - DNA, 601 bp, Human
gattctcctgcctcagcatcctgagtagctgggattacatgtgcccgcccccatgtccggctaattttttgtatttttagtacagacggggtttcactatgttgcccaggctggtctcaaacccctgacctcaagcaatccacctgcctcggtctcccaaagtgctgggattacaggcatgagccacagtgcctggcccgttggtgtattttacatgtgctccaagataattcttcttccaatgtggcccagggaagccaaaagattggacactcctgttaaagtagtttgtaacaatcawctatgagtattttggaatgagtacactggttctgagagacttgattcgttttaaatggaaatagtcaacatcattttttatataataaacagatccacactacatgcccgtacctcaccggccagttgaaggaggaagaaagagaaatcagggtaagagaacagagagtgagaaggaatggggaagacaaaaagcagaaagagaaaagaaacacgggggacacacacaggagagacacagggacggagtgaaggggaaaaaaagactgagaaaaaacacagaaaggcccacatacaactc

SEQ ID NO: 146485 - DNA, 601 bp, Human
aatttttattttactttattttatttttgagacggagtcccaatctgttgtccaggctggagtgcagtggtgcaatctcggctcactgcaacctccacgtcccaggttcaagtgattctcctgcctcagcatcctgagtagctgggattacatgtgcccgcccccatgtccggctaattttttgtatttttagtacagacggggtttcactatgttgcccaggctggtctcaaacccctgacctcaagcaatccacctgcctcggtctcccaaagtgctgggattacaggcatgagccacrgtgcctggcccgttggtgtattttacatgtgctccaagataattcttcttccaatgtggcccagggaagccaaaagattggacactcctgttaaagtagtttgtaacaatcatctatgagtattttggaatgagtacactggttctgagagacttgattcgttttaaatggaaatagtcaacatcattttttatataataaacagatccacactacatgcccgtacctcaccggccagttgaaggaggaagaaagagaaatcagggtaagagaacagagagtgagaaggaatggggaaga

SEQ ID NO: 146486 - DNA, 601 bp, Human
ttactgctaaccagattttttagagaaaaagagcctgagttttaagactcaaaggtcaagtcacttccaatcttgagaggaggattaggtggacaggctttaaaggaggggctggagtactatttataagttctaccctctgggtcagccaggtctttgttcatttaaaagctccctggtgatttatacgaaggatgagcacaaaggaacattcctttcctatgggaagcctcctgcttagaggagatcgggctctggtaccctctaatttggaaccaggcaaacataaggaagcactttsgtatgtaaaataagaatatcttaaaagtaagcttcagaacaaaaccaatagtttgcaaagtattaagcgttaggaaaggtaaaaaaggaagtaaatattccataaatattatggaagaatgggtgacacttggctcaacacaggttacgcaaatcctcttgtgtcttacagaatagttgtgacctggtgtgatttaggtgcagtctggtgctggagctgggggcagacttgaggtatagaaggcagtgaaggaggtgggtggtagaatgggaagggaaggattggggatcagaagagatc

SEQ ID NO: 146487 - DNA, 601 bp, Human
tcaatacagcattagagaaatacaaagagagctccatccaacgacgttgggattgaggccattgaaggcccctctaagttctgtaattttaggggtgaaaaggaagcccttagttcatggtagaaatgcagcaatttgggaacatctttataaaatggaaatccataatagtctattagtaaggagaaataaaagttattaaggtagatgtcttaaaataataacaatgagaaaagctggtcctcaaaagaggaaacttcaagttgacttctgaggagccaaaacaaaaacaaaaacacamaaaaaaaaccgaggaaacatttggctaaaaatgctagaaatgaaagacaagctttgatgattggtcatcatctggctaaaaacatatttgttttaacagcttactgctaaccagattttttagagaaaaagagcctgagttttaagactcaaaggtcaagtcacttccaatcttgagaggaggattaggtggacaggctttaaaggaggggctggagtactatttataagttctaccctctgggtcagccaggtctttgttcatttaaaagctccctggtgatttatacgaaggatgagc

SEQ ID NO: 146488 - DNA, 601 bp, Human
acaaagctgcagttggagcagactgaacttccagaaaaagcactactgtgactggcagaggtcagaaaagcaaagcctggggccaggacttactcttcaatctatgtattaaatgataaaaaagaaagatgttttaaattagtcttctatctggcatttagtgaatagtaaatttaagctccccttatttcaagggagagaagtagctaaaaatacatggttgatttccacaacatgaatgtcttttctctgtaaataaccaggttaaggacttaattgcttttcttttttttttttttttggagacagagtttcgctcttgttgccccgactggagtgaatggcacgatctcggctcaccacaacctccgcctcccgggttcaagtgattctcctgcctcagcctcctgagtatttgggattacaggcatgcgccaccatgcccggctaattttgtatttttagtagcgatggggtttctccatgttggtcaggctggtctcgaactcccaacctgaggtgatctgcctgcctcggcctcccaaaatgctgggattacaggcgttgagccaccgtgcccggccctaattgcttatctttt

SEQ ID NO: 146489 - DNA, 601 bp, Human
gctatacgagaaaagtctcggctgggcgtcgtggctcacgcctgtaattgcagcacttttggaggccgaggcgggcggatcacgaggtcaagagatcaagaccatcttggccaacatggtgaaaccccgtttctactaaaaatacaagaattagctgggcgtggtggtgtgcgcctgtagtcccagctaatcaggaggctgaggcaggagaatcgcttgaacagaggaggcggaggttgcagtgagcagtgagccaagatcatgtactgcactccagcctggcgacagagcaagattccgyctcaaaaaaaaaaaaaaaaaaaaagaaaagtctcaaaatataacaaagggttattcagcagagtgcctgcaatgtgatgaggagtctatctttctgtgcactcaacctgcttgtgggcatccctgcatgaatgtactgtcgctttcagatcacattggctgtgtcattctcccctcagggtgtgcaattcctaacaaactctccttctatgctcaatacatctccagacagtgccgttcctctccacccgtgtgatctgccttcctctggttcatattttcaaactccactttttttttt

SEQ ID NO: 146490 - DNA, 601 bp, Human
tgctacccagttctggggtcctgaagctacaggactttcgagggagttggaagttcttcagggtgggggcagcaggggcatgccaacctgccctttcctactgtgtggtctttgctacagaccctgtccttcaacttccaggcagctccaaaagcctcagataccctttcccattgtttgaatagcttgcagtgaagaaccctaaacaacacagctgactggaatcatcatgtgtgtaataacactatattttaccctctggagagattctgtctaggttttgctgctatacgagaaaagyctcggctgggcgtcgtggctcacgcctgtaattgcagcacttttggaggccgaggcgggcggatcacgaggtcaagagatcaagaccatcttggccaacatggtgaaaccccgtttctactaaaaatacaagaattagctgggcgtggtggtgtgcgcctgtagtcccagctaatcaggaggctgaggcaggagaatcgcttgaacagaggaggcggaggttgcagtgagcagtgagccaagatcatgtactgcactccagcctggcgacagagcaagattccgtctcaaaaaaaaaaaa

SEQ ID NO: 146491 - DNA, 601 bp, Human; identical to SEQ ID NO: 25383

SEQ ID NO: 146492 - DNA, 601 bp, Human; identical to SEQ ID NO: 25384

SEQ ID NO: 146493 - DNA, 601 bp, Human; identical to SEQ ID NO: 25385

SEQ ID NO: 146494 - DNA, 601 bp, Human
taaaaacctcaatcattaacaaagtataatctccaaatctactaaacatactatgcactttctgtcctttctgtgcctttgcccatgctggtggtacccttaccctaaagcagccttctttaccttatctttcaacttaaacatgctttaggacccagctcaaaataacctttcttctacacatgattcaggcagaactcgccttgttttctcttggcacctctacttttcctctacccttgtaagtttttatcaatagtatttatttgtacgtctcctccagcagactgtaatagattcygttagggagaaggatcatatctcattcatcttttcacctctgatacttggaatggtatctggaattcagtaggtgctcaaaaaatgcttactgaatttgaatttgttggaaagacagtgtatgaatataaaactacagaaccaaacagaatcccaaaaaatgaggtaagcaggtgagattagataataaaaattagttaacagtagattatatactactttaaatatcaagtaactccagaaacactatacattttacattacctcacatgtgatacacacaagcctatatgttcccatt

SEQ ID NO: 146495 - DNA, 601 bp, Human
tttgatatgcctagctgtgtggcaggtgctagaagaagaataatggacttttaaaaacctcaatcattaacaaagtataatctccaaatctactaaacatactatgcactttctgtcctttctgtgcctttgcccatgctggtggtacccttaccctaaagcagccttctttaccttatctttcaacttaaacatgctttaggacccagctcaaaataacctttcttctacacatgattcaggcagaactcgccttgttttctcttggcacctctacttttcctctacccttgtaagtttwtatcaatagtatttatttgtacgtctcctccagcagactgtaatagattccgttagggagaaggatcatatctcattcatcttttcacctctgatacttggaatggtatctggaattcagtaggtgctcaaaaaatgcttactgaatttgaatttgttggaaagacagtgtatgaatataaaactacagaaccaaacagaatcccaaaaaatgaggtaagcaggtgagattagataataaaaattagttaacagtagattatatactactttaaatatcaagtaactccagaaacactat

SEQ ID NO: 146496 - DNA, 601 bp, Human
ccaaaaccagctccaccacttacagtgtaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataataatcaaaagcattatataacataagtagtaattataggtataaaaaagctaaaaattttgcagtaaacactgctaataatatgcaatttagagtcaaatatttaatcgtttgatatgcctagctgtgtggcaggtgctagaagaagaataatggacttttaaaaacctcaatcattaacaaagtataatctccaaatctactaaacatactatgcactttctgtcctttctgtgcctttgcccatgctggtggtacccttaccctaaagcagccttctttaccttatctttcaacttaaacatgctttaggacccagctcaaaataacctttcttctacac

SEQ ID NO: 146497 - DNA, 601 bp, Human
gaagttagaaatgtaaaatgtggagccagactgtctggagccaaaaccagctccaccacttacagtgtaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataatmatcaaaagcattatataacataagtagtaattataggtataaaaaagctaaaaattttgcagtaaacactgctaataatatgcaatttagagtcaaatatttaatcgtttgatatgcctagctgtgtggcaggtgctagaagaagaataatggacttttaaaaacctcaatcattaacaaagtataatctccaaatctactaaacatactatgcactttctgtcctttctgtgcctttgcccatgctggtggtacccttaccctaaagcagccttctttaccttatctttcaacttaaac

SEQ ID NO: 146498 - DNA, 601 bp, Human
ttaactcttgagaagcactatacagtagaagttagaaatgtaaaatgtggagccagactgtctggagccaaaaccagctccaccacttacagtgtaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaayatttaaagacttcaaaaactaataataatcaaaagcattatataacataagtagtaattataggtataaaaaagctaaaaattttgcagtaaacactgctaataatatgcaatttagagtcaaatatttaatcgtttgatatgcctagctgtgtggcaggtgctagaagaagaataatggacttttaaaaacctcaatcattaacaaagtataatctccaaatctactaaacatactatgcactttctgtcctttctgtgcctttgcccatgctggtggtacccttaccctaaagcagcc

SEQ ID NO: 146499 - DNA, 601 bp, Human
aaatacacagacccaaatttataggatcttaaaatgttaatctttcaatattaatgcttacctataataaattatataagaaagcatgtctccagtgaatacacttaactttaaaaatatgtaagaaaaattggggatacatgaataaaactaaaggatgttaagttttcaataatacttttttaaagaggcaataaaacaaaatttaactcttgagaagcactatacagtagaagttagaaatgtaaaatgtggagccagactgtctggagccaaaaccagctccaccacttacagtgtracctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataataatcaaaagcattatataacataagtagtaattataggtataaaaaagctaaaaattttgcagtaaaca

SEQ ID NO: 146500 - DNA, 601 bp, Human
aaaatacacagacccaaatttataggatcttaaaatgttaatctttcaatattaatgcttacctataataaattatataagaaagcatgtctccagtgaatacacttaactttaaaaatatgtaagaaaaattggggatacatgaataaaactaaaggatgttaagttttcaataatacttttttaaagaggcaataaaacaaaatttaactcttgagaagcactatacagtagaagttagaaatgtaaaatgtggagccagactgtctggagccaaaaccagctccaccacttacagtgkaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataataatcaaaagcattatataacataagtagtaattataggtataaaaaagctaaaaattttgcagtaaac

SEQ ID NO: 146501 - DNA, 601 bp, Human
aaacaaggctgcttactgcctcaaaatacacagacccaaatttataggatcttaaaatgttaatctttcaatattaatgcttacctataataaattatataagaaagcatgtctccagtgaatacacttaactttaaaaatatgtaagaaaaattggggatacatgaataaaactaaaggatgttaagttttcaataatacttttttaaagaggcaataaaacaaaatttaactcttgagaagcactatacagtagaagttagaaatgtaaaatgtggagccagactgtctggagccaaamccagctccaccacttacagtgtaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataataatcaaaagcattatataacataagtagtaattataggtataaaaa

SEQ ID NO: 146502 - DNA, 601 bp, Human
ttggccaaatatactcttatactctcacatactcttatatactattacaaagccaatgaaggttaaaagttgtaattaaaacagcaaaaacttgtttggaaaaaaaaaatggtatcctaacctatattacagaacaagaacagaaaaaatacctctaacaaatgaaattcttctaaaaataaaactatgaccatacttggtttttaactgtggatgtttttctagacagaaaacggttgatatttccaaagttaagattactcacgtgtatataagcttgagtaccagtaacaagattgcygaacttctctaaaactatcatttctagtaagaaaacccataaagatgatttcaaacaaaatcccaacatgagcctggggaaacattcatgcaccgagtagtaccacttgaggagcctgtgccagatgctgaggatgcacagaggaaaacaaaaacaaaaaaacagtcctatacccaaaaagtgagcgaatgggctccttaataagtagcttcctccagtaatctgactttccgtagctggagcaggctgaggagcagcactgcctctcagagagatgagggggaaagcaaagggcagact

SEQ ID NO: 146503 - DNA, 601 bp, Human
cgaggcgggcagatcacttaaggtcaggagtttgagaccagcctggccaacatagcgaaaccctgtctctactaaaaatctaaaaattaaccgagcatgatggcacatgcctataatcctagttacttgggaagctgaggcatgagaatcatttgaacccaggagagggaggttgcagtgagccgagatggcactactgccccctccagcctgggcaacagggtgagactgtctcaaaataaataataaataaataaataaataaaagtaaacagacttaaattatttttcagttgttgtyaatttggccaaatatactcttatactctcacatactcttatatactattacaaagccaatgaaggttaaaagttgtaattaaaacagcaaaaacttgtttggaaaaaaaaaatggtatcctaacctatattacagaacaagaacagaaaaaatacctctaacaaatgaaattcttctaaaaataaaactatgaccatacttggtttttaactgtggatgtttttctagacagaaaacggttgatatttccaaagttaagattactcacgtgtatataagcttgagtaccagtaacaagat

SEQ ID NO: 146504 - DNA, 601 bp, Human
tttaagcaagcaagtgacaagatcagacatgtgatttgaaaagatcactccaactgcagactagaaaatggaaagaagggaaaactaaaagcaggaaactggttactactgtgcaatttgatctccttctttttttttttttttgagatggagtttcactcttctcacccaggctggagtacaaaggcaagatctcggctcactgcaacgtctacctcccaggttcaagtgattctcctgcctcagtctcccaggtagctgggattacaggtgtccaccaccacaccgggctaattttttrtatttttagtagagatgggtttcaccatgttggccaggctggtctcaaactcctgacctcaggtgatccacccaccttggcctcccaaagtgctgggattacaggcgtgagccactgtgcctggcctgatcagtttttaagcagtagtctggtctaggctgtagcagtgggggatgaaagggatcagataagtctgagagacactgaggtctctggagtaagttaccgactatctgggataagagagaaggaaggaagcaccaaacgatgagtcccaggtttcaagtaagagtagttctt

SEQ ID NO: 146505 - DNA, 601 bp, Human
catctttcatgctttttattcaaggtgatatcttttgactaataaatcaagtagaactactaagctgacaaatatatacagaaagagatattctggttgaaggaatttatatttaatcatgggagtccaagataataggtaccaaccaactaggtaggagaacgtgacattgatcctaggggctacagaatacaggggtatgggagggagatagttggcatgctccagtatggaatacaaggaactaaatactatgaacaagctgctgaatagtattatgcattcaacagaatataagttmttcttttataaagaaataactgtgattagtgaagaaagaaaaaggaattcttactatttaatataagaaaaagcagtttttcccccacaggaagtattatcgcccctgttttaaataacttgccaatatcatgctattcttaaataaatggcagagaaaagattcagtgtagtctttcagaaatgacaaatacagatgtgacattaaagtctctttaaaaaagcaaaacagcgtcgcaaactagctgttttcaaaaatatgtaagtataatctattagtctaataaggtctcttttagca

SEQ ID NO: 146506 - DNA, 601 bp, Human
agagcaagtccatttttaaccaatttgtatttttcatgtttcatttaaatctgtcttagcctgtatttttttcattcaactgtatccaaatgatagcatttcaacattaacatccagcataccttcaactattttttttttacattcttctctctgtaatttccagtttcattaaatatttttggaagcacaatgaacaaaactcccaataacagaggaagcaccaaaaaacatcattagtacatggataagcacaggtttaggatttgatttcaatacccttttttttttttttttttttgagacagagtttcactcttattgcccaggctggagtggaatgttgtgatagctcaccgcaacctccacctcccaggttcaagcatttctcctgcctcagcctcccaaatagcccggattacaggcatgtgccaccacgcccaactaattttgtatttttagtagagatggggtttctccatgttggtcaggctggtctcgaactcctggccccaggtgatccgccagcctcggcctcccaaagtgctgggattcgtgtagtatctgttcttatcagttcaatacccttcttaaaaatgca

SEQ ID NO: 146507 - DNA, 601 bp, Human
acaaccttgttatgtttgtaatccattatgaaaaatctactcattcttgggatctcatcagcacaaggtgagttccaaaatttctctccttgctaataaatagtcctttgattcacatcagctgcatttattaaacacctaagtagcttcctttcatctgtcctaaagctctttcaaaaactcttcattttaatattccccgattcagagagcaagtccatttttaaccaatttgtatttttcatgtttcatttaaatctgtcttagcctgtatttttttcattcaactgtatccaaatgrtagcatttcaacattaacatccagcataccttcaactattttttttttacattcttctctctgtaatttccagtttcattaaatatttttggaagcacaatgaacaaaactcccaataacagaggaagcaccaaaaaacatcattagtacatggataagcacaggtttaggatttgatttcaatacccttttttttttttttttttttgagacagagtttcactcttattgcccaggctggagtggaatgttgtgatagctcaccgcaacctccacctcccaggttcaagcatttctcct

SEQ ID NO: 146508 - DNA, 601 bp, Human
agccatattgaatacaagaataaccaccatgagggacagcataaaacagcagctgaaagatgatgacttagcaatcacttactttacaagctaaattgaggtttcccaaattttccagagttcctcaactgggggcggttctgcctccattcagggacatctggcaacatttttgataatcaagactggaggaagtgctactggcacttgtaggaagaggccagagctgctgttaaacatcctataatgtacagggtagcccaccacaacaaagaattatcaaattcaaaatgtcagtagkgaccctattgagaaatcctgctttacaataaaactgaaaagccccgctagtcacacaaaattctgagataatctgtaatacatataatgcaatacaatgtaaataactatagctagaaatgtcaagtgcatacatacatcccattgctactctcccacactgtttccccgtccatcctgtcattctactcttctatttaataattgttgctctgtttacacttcctttaagtcgccttcccattccaaaatctccaattctcctgagaaataaaaagaaatgggaagcattgccttatct

SEQ ID NO: 146509 - DNA, 601 bp, Human
tttgcagagaaaaatttcccattaaagttatttattttacagttgacaaaatgagaagcttgttctaaatttcgtgcttgaaggtctaagatctaaaccaaaattagggtttacttacaaagtattcttcggaaggaccaagaactggtctcttaacataattctaatataaaactaacaaatataaaatgtgaacaccagttgtggtaataagaaacttcaccccttaaaatacaatgttagagcaccctctgctgactaacatctcagtctgaagaaagagactctattttgagttagrccagcactttccatttcccatgtaatttttaaaagctaaagatgcaaagataaagctctaatcagacataacctccttgtaagctctctacaaatcgacaacaacaaatgtattgagtattcattataagtataccactgttcttaaatttttttaattctaatttggacaaattgatataagcaattagagagaacagataagatgggagaaaaatttttaaacaaaatgttagcaggtgtggtaaaaagagccctgaactgatactctcaaaatctgggtcctaacttatttgaacaa

SEQ ID NO: 146510 - DNA, 601 bp, Human
tgatttcatttttattgttgtattattattagttattgcttttttcccccaaatattttcaatccatggttggttgaatccatggatgcagaacccatggatacagaacaccaactcttatccagaactgtattttctgtgtaaataagaggacccaactagctaaagactcagtgtattgccctatagaaaatgactgcataagaacagtattaggtctatttttacactttgttctttttcttctttacattgctctagtcttccatattcaattctcgaaatgaatatattttaatayttctttgctttttgttttttattcattactccatttatgtgtgtgtgtatgtttgtgcatgtgtgcacattggcacatggtgtagcaataatggatattctcagaagggacatgattctagtataaatatctgtactcagatagcaaactaatacaagtattctaaaatcagcactgaaagaattttccccatactggagaactactgcccaagttcatgtcactaaaataaatgcctcctattcggaaagttgctgcattctgattcactggaaacgggattacatttcattgtaactg

SEQ ID NO: 146511 - DNA, 601 bp, Human
taatgtttgtatttttagtagagatggggtttctgttggccaggctagtcttgaacttctgacctcatgatctgtccgcctcggcctcccaaagtgctgggattacagtcatgggccactgcacccagcgctagcctgtcaaaatcttaaaatttttttttaaatttcattggtcccagatggtaaatgacgacaactcctttgtcttggcatattaagaattaggagataaatttaaacatatgcttccttaaaattatatttaaatttaaattagctgggcgtggtggcatgcacctgyagtcccagctacttgggaggctgaagtgggagaattgcttgaacccgggaggcggaggttgcagtgagccaagatagtgcgactgcactccagcctgggcgacagagggagactccatctccataaaaaaaataaataaagtattaacataaaaacattctaaatattataaaaatgaataatcatcctgttatgattttttaaaaataaaaatgaaccagaaaaacgaaggagtaagataaccatttacttatttctattgtcaaattccataattaacatgcggttcaatacaaattt

SEQ ID NO: 146512 - DNA, 601 bp, Human
gagacagcagtactctagactttaatgacaatagtgaaattgatcatttaagtgaaatctcaaactctgagtctttagatgatatcttaaattttccatagctcaagaactaatagaagaacaatatatttctaaagacaaaaaggaacacatggtaatcttaacagcttagtcatcaacagaaaaaacttcattacatgatattttatgacaaaaacctggaccatttctttttactaaaagaacatgtgacaatattatttcatcttttatgctatttacacaaatttatttgatagtrggcaaatgcaaaagttctatttatataaaaagaagactgaaggaattagatcacatagaaatgaaaaaaagtactgggctgctcagtctaattggtgttgattcacataaaaaagaaaatatttcataatgaaatcatgagctggcaaagggtttatagatttcttcaagtattattaacactattagatgcaagaagggccagaagtaataaactagaacctctcagaggtatatttgaatgtataaaaattaatgagcaattagttgcattcaggggatgttgaccattttagatacc

SEQ ID NO: 146513 - DNA, 601 bp, Human
ctcttgagcccgagaggcagaggctgcagtgagccaagactgtgccactgcactccagcctggacgacagagtgagaccttttctcaagaaaaaaaaaaaaaaaagaatttaggatgaacgcccggtcggtaaaaataaagcagtgggggtacttttagtcttatatgcattatatctcttaataatatcccttaaatttctctctaatcaatcctttcatatccagaaactaatactgaagaaaattctggaaccaggaaaaactctcgcctcagtcaaaacctaaaattaaaaaaaaatatacatacacacacacacacatatacacacatatatagtactatagacaagttatagatttaatccaattctgatccttctctctaaagtattaaaattgaacaagctctaaataataccttatacttttacaaaacagaccttttaacgtcttcaatttattttttagaatatctctcttaggtatctgcaacagggttaaagatgaatgtaggcacttaattaaagttttattcacttggatttcattaaaaagacttaacatttcaaaagtgacaccatattgctttccaaattcta

SEQ ID NO: 146514 - DNA, 601 bp, Human
ctctcttgagcccgagaggcagaggctgcagtgagccaagactgtgccactgcactccagcctggacgacagagtgagaccttttctcaagaaaaaaaaaaaaaaaagaatttaggatgaacgcccggtcggtaaaaataaagcagtgggggtacttttagtcttatatgcattatatctcttaataatatcccttaaatttctctctaatcaatcctttcatatccagaaactaatactgaagaaaattctggaaccaggaaaaactctcgcctcagtcaaaacctaaaattaaaaaaawatatacatacacacacacacacatatacacacatatatagtactatagacaagttatagatttaatccaattctgatccttctctctaaagtattaaaattgaacaagctctaaataataccttatacttttacaaaacagaccttttaacgtcttcaatttattttttagaatatctctcttaggtatctgcaacagggttaaagatgaatgtaggcacttaattaaagttttattcacttggatttcattaaaaagacttaacatttcaaaagtgacaccatattgctttccaaattc

SEQ ID NO: 146515 - DNA, 601 bp, Human
ttatctcaaaatgagtaactctgaccaagattcaaatatcagttaatattatttatgcttgtgctactctgggcacgatgcttatgggatagccctgcactgcaaggagcagtacacatttgcttatatatataaacatagatatatgtttatatatataattgtatatataatttatgcttgcttacttgtatagaattatggaaaagtcatcagtttctagagatcatgtatttatttggtaggaatttaggatgggctgggtactgtaactcaagcctgtaatcccaacactttgggrggccaaggtgggtggatcacttgacttgaagtcaggagttcgagaccagttccagtacctgagactgacatggtgaaactctgtctctacccaaaaatacaaaaaaaaaaaaaattagctgggcatgatggcacacacctgcagccctagctactcaggaggctgaggcgggagactctcttgagcccgagaggcagaggctgcagtgagccaagactgtgccactgcactccagcctggacgacagagtgagaccttttctcaagaaaaaaaaaaaaaaaagaatttaggatgaacgcc

SEQ ID NO: 146516 - DNA, 601 bp, Human
attaatataagtgtttccaatcacaaaaaccaaatggtgtttgtgaattgggggaggggaacagagcagaagcaaggtggctaagggaatgagggaccagcacttcataaaataatgagacaaaattaggtcacactaaattcagtctggtcttaaaaactacaggaatgaacatttttcaaaacagaggtagatcaaatctttggaattctatctcctaacccttctcttaattcattcaaaatagccttagaattactcaacagtattaggttgtcccctctgtacttccatatccacrtctacatgcaagatttttgttttttctagccgacttttaaaaattaacaccaactttcaaaactttaaattttattttttatagaggcagggtctcactacattgcccaggctggtcttgaaatcctgggctcacctcggcctcccaaagtgctgggattacaggcgtgagccaccaaggctggcccaaaaactcgtaaattttaaaaagtgtattcagcactaataaagaaaagcagttcatatattaaaagtttaagtgtttctgccaagagttaggaaaaaattgaaaagtatctta

SEQ ID NO: 146517 - DNA, 601 bp, Human
gagagaggccaaggcaggtggatcacttgacttgaggtcaggagttcaagaccagttcaagcacctgagaccaacatggtgaaatcattgctatttgagaatgaatcactgttcgtgatcaactaatataagagaccgacatggtggaatcattgctatttgagaatgaattactgttcgtaatcaattaatataagtgtttccaatcacaaaaaccaaatggtgtttgtgaattgggggaggggaacagagcagaagcaaggtggctaagggaatgagggaccagcacttcataaaatawtgagacaaaattaggtcacactaaattcagtctggtcttaaaaactacaggaatgaacatttttcaaaacagaggtagatcaaatctttggaattctatctcctaacccttctcttaattcattcaaaatagccttagaattactcaacagtattaggttgtcccctctgtacttccatatccacatctacatgcaagatttttgttttttctagccgacttttaaaaattaacaccaactttcaaaactttaaattttattttttatagaggcagggtctcactacattgcccaggctg

SEQ ID NO: 146518 - DNA, 601 bp, Human
tgcttttcctcaagacaaccatatttggcatgcaacagaggagctttatgtgtacttcccattccatcatacaggatactaaaaagacatgtacttaagagtcaaaattaataataattaatactttgtactactacatccagaaaagtcttaaactggtgttctttttactctaagtgtgtggttataaagaaaacaatgacaactagtacagtgaggtacaatgccctgctttgtgctaaggcacccacagttttaaccaccattgttgttgcattatcagtgtaaatgttaacacaaygggaagggccaataacatcctgatattattatatcatggaaacagatttgacctgatgaatccattgaaagggtttcaggaacccgacacacagaaggatctccatatttgttgaatgaatgaatgagtgaataaataaacaaggagacagctatattttaatctagatttcaaagtattttagagcttatttttcacacacaaaaaaatctaattattggaattaccttccaacattaacagaaaagactcgttaggcaatatagcacccctacccttaatatgtttgaagtagtttta

SEQ ID NO: 146519 - DNA, 601 bp, Human
ctcaagcaatcctcctgcctcagcctcccaatgtgccaggactgcaggtgtgaggtatcatgcccatccagtttattgtaataataatgtggaatctgaaacattaccagtgaacattttctactctgttacattaagatttcttattctaatgttgcactttgaatggatctttttacacatgcatgatcttgtaacatcaagcactggtcatctggaaatgttcactgatttacgcattccaaatgttgaccctttcactatgaaacttttaaaacatcagatgttaaaataaccaccratctcatcagaaaattatttaagaataaagctttcaagtttacagtggcatcatgttttccaaaattcaaattttcactaaaaagttgaaattttaccactgacaacaaatactatcacttgttttccctgcagtgagaggttcactttattctttttcaagaaaatgtctaacaaataacaaagtctcaacaaccacagtttgtctgtcaatcattctttcaagtaaaataatggtgtttcataaaaataagtggccagttcagctggcaaccaaaaaattacgcaagtgcttttcctc

SEQ ID NO: 146520 - DNA, 601 bp, Human
taaatgaatggaacttagtatatacagaaaaaaaaaaaatctgggcaataactttcctctaacaggccaggataagaataagtaagaacagctgaaagaaacacactgatagcttgaacaaactctaaatgttctctgtaatttccttattaactgtaagattcttttttctatttgctaataaacttttctactgggaagaaaatgtatgacctactaaggatcccaaagagtttatatttatgtggattatattactgatatttacactagaaattagagctgaaacatttaaaaaaaacattaattcacttaaaaataccaagaataaaaccactatacattaacactaaaattgtatttccacaaaaatcaactatgtttcccagaacaacaacaacaaaaaaaacaggaacactggcactaatttgtatttttgcaaataactttaatgccttaatagacaaccaatggattaccttaaacttgcttctatgttcaatattctacaatatgttgttttggttgaagtatataaagaaaattcaggctcacaaagatatgtagtttaaaagaagtattttaatagcctttttggctt

SEQ ID NO: 146521 - DNA, 601 bp, Human
attttctacaaactttaaaaaccacttcctcactaaaagcattgattttctgcctgaaaattaacacttacccagtttcattataatcaatcaaaaatctataaggcagtacaatagaggcaggcctacatcaatcagtacaagctatcaattaaacatgtgaagacaacctttgaagtaacctaggtcctgatgctcccctaaatgaatggaacttagtatatacagaaaaaaaaaaaatctgggcaataactttcctctaacaggccaggataagaataagtaagaacagctgaaagaracacactgatagcttgaacaaactctaaatgttctctgtaatttccttattaactgtaagattcttttttctatttgctaataaacttttctactgggaagaaaatgtatgacctactaaggatcccaaagagtttatatttatgtggattatattactgatatttacactagaaattagagctgaaacatttaaaaaaaacattaattcacttaaaaataccaagaataaaaccactatacattaacactaaaattgtatttccacaaaaatcaactatgtttcccagaacaacaacaa

SEQ ID NO: 146522 - DNA, 601 bp, Human
gaagataaatgcagagacaccaagtgacacaaaattgttactcaatacatccaatctgttgaatgtataaactattttctacaaactttaaaaaccacttcctcactaaaagcattgattttctgcctgaaaattaacacttacccagtttcattataatcaatcaaaaatctataaggcagtacaatagaggcaggcctacatcaatcagtacaagctatcaattaaacatgtgaagacaacctttgaagtaacctaggtcctgatgctcccctaaatgaatggaacttagtatatacaaaaaaaaaaaaaatctgggcaataactttcctctaacaggccaggataagaataagtaagaacagctgaaagaaacacactgatagcttgaacaaactctaaatgttctctgtaatttccttattaactgtaagattcttttttctatttgctaataaacttttctactgggaagaaaatgtatgacctactaaggatcccaaagagtttatatttatgtggattatattactgatatttacactagaaattagagctgaaacatttaaaaaaaacattaattcacttaaaaataccaaga

SEQ ID NO: 146523 - DNA, 601 bp, Human
agctttgatattgcacaaaaaaatctaatcaaaatctattacaacctttgaaaacaattgtaaaagaaattctaagaagtctggttaaaacatcaacattatctggcatactcaatacaacaccacagaagataaatgcagagacaccaagtgacacaaaattgttactcaatacatccaatctgttgaatgtataaactattttctacaaactttaaaaaccacttcctcactaaaagcattgattttctgcctgaaaattaacacttacccagtttcattataatcaatcaaaaatctrtaaggcagtacaatagaggcaggcctacatcaatcagtacaagctatcaattaaacatgtgaagacaacctttgaagtaacctaggtcctgatgctcccctaaatgaatggaacttagtatatacagaaaaaaaaaaaatctgggcaataactttcctctaacaggccaggataagaataagtaagaacagctgaaagaaacacactgatagcttgaacaaactctaaatgttctctgtaatttccttattaactgtaagattcttttttctatttgctaataaacttttctactgggaa

SEQ ID NO: 146524 - DNA, 601 bp, Human
gatccttactccaaaatcatggcctttctggcatctcaagtaactgcctagtatgtagccagatgtctctccactttgaatgagctggaatccaacatttcccagcatcataagacgttcagtatcttttgtccactcttaaccctacaacatccactatctactagaccttgcagagtatcagctatgcatgtgcaacccaggcctcagccaagcacccagggagaacatacacgtacactttggctcctccttctctgataccctgcctagcaagttccaaccacttcagcagcccagractccaatttgtgcatcctcagctcaactgaacttctttgctctgcttgagctccactctccgtaccaccgtcaggcaaccgttccaaagcacatggggctcaccttgtttgttccctttctaaggttcagtgctaaaaacagctctatttcatatttttggtcctgttttctaattgttgatgactagaggaaaactcaaataccagttactctgtcacggctaaaagtatatgttaacatcaataaatatctgatgaataaatgactaaacaagccttacttcataaagttctaagtt

SEQ ID NO: 146525 - DNA, 601 bp, Human
tgcaaaaacagtcagtggaccacatttgccaactcctgctctgatgtatgatccttactccaaaatcatggcctttctggcatctcaagtaactgcctagtatgtagccagatgtctctccactttgaatgagctggaatccaacatttcccagcatcataagacgttcagtatcttttgtccactcttaaccctacaacatccactatctactagaccttgcagagtatcagctatgcatgtgcaacccaggcctcagccaagcacccagggagaacatacacgtacactttggctcctycttctctgataccctgcctagcaagttccaaccacttcagcagcccagaactccaatttgtgcatcctcagctcaactgaacttctttgctctgcttgagctccactctccgtaccaccgtcaggcaaccgttccaaagcacatggggctcaccttgtttgttccctttctaaggttcagtgctaaaaacagctctatttcatatttttggtcctgttttctaattgttgatgactagaggaaaactcaaataccagttactctgtcacggctaaaagtatatgttaacatcaataaata

SEQ ID NO: 146526 - DNA, 601 bp, Human
tattttcaaggttgtagcatattatcagtaattcactccttttcatgaccaaattatactccattgtaaggatacatacagtattttgtttattcatcagctgatggacattgggttatttccactttgcctattatgaacattcatgtataagcttttgtgtggacgcaagttatttccctattttgcatatcagaattacatattcagttctcttgggaatattactaggaatagaactgctgtgtaatgtggtaagtatatcatttgatgacataccaaactgctttccaaaaaggckacaccattttacattctcatcagcaacgtgtgaagggtctaattaacctataccctctccatcatgtgttactgttttctgtattttgttgtttttttttggagacagggttgcactcttgtcacccaggctgggttgcagacatgccatcaggaatcactgctcctcccaggctcaagagatcctcacacctcagccttccaaatagctgggactataggcacatgccaccacaccaggctattttttaaaatattattttagtagagatgagttctcgttatgttgaccacactggtc

SEQ ID NO: 146527 - DNA, 601 bp, Human
aatctcatataaacagaattgcagtattatgtaacttagtatctttcacttagcatatttttgagattcattcctgttactacacatatcagtaattaattcctttttgttgctgagtagcaggccatttaatgaatacaccacaatctgtttatctaaaaacttgttaatagacactgggattgtttctagatactggctattatttaaaaagctgctatgaacattaatacacaagtcttttatagacacgtcttcatctttcttgggtatacagctggaaaaagaaatgctgggtcayagagtaagtgtatgttctaactttacttaaaaactgccaaactatttttcaacatgatgtacaattttacactcccactagcaatgtataagagttctggttactccgtgtcctcaaacttgctactgtcaatctttttcattttagtcattctagtgagtgtaatgtaatgtctctttgtggttttaatttacatttccatgatgactaaagatgttgagtgccttttcatgtttgttggtaaattcatatatgttctgtgaactaagtttttttgcatttgtttaaaagcaactaata

SEQ ID NO: 146528 - DNA, 601 bp, Human
atactggaaccatggaaagggaggactatctgtacataaaataactgtttgaaggcactagagggtgatcaatgcaggcaagatcacagagttatttacattctccaaaatatgagggatacagagatgagcaccacattccacttagctttttccttgggagtattttctaaaccacagcaaggagaaagggaattgaagcacaaagcaagtctactgtcctgagaaagcagaggttggagttcaatccccacacgtggaggtatctttgtacatacccagaattttccactgtgaccayagaagggtcatgactaaggaataaagaccacatccttagagtaatggcatttccttcagaagctatacccaagtttatatgacatatgccatatgttaggggctgagcaatcagtctaatgctagagaatccatgaacagagggacaccaaaagagcagaatgtaagggatgactaaaagtagcttctgtgcaaatctgggcacagaggctacaatttaaacttgtaccaccaattctaaaatgtatcaactactcacagggttatggctgtatcatattttataaagtggtattctaaa

SEQ ID NO: 146529 - DNA, 601 bp, Human
actgggccgggcgcggtggctcacgcctgtaatcccagcactttgggaggccgaggcgggtggatcacgaggtcaggagatcgagaccatcctggctaacatggtgaaaccccgtctctactaaaaatacaaaaaattagccaggcacggtggcagccacctgtagtcccagctattcgggaggctgaggcaggagaatggcgtgaacccgggaagcggagcttgcagtgagccgagatcatgccactgcactccagcctgggcgacagagcgagactctgtctccaaaaaaaaaaaaaaaagaaactgaagctcaaagcagttgacttgacctaaggactactaagacctgaaactaaaaaccaggcctttgttgttcttctaacacttaatcattatcctccatacccaatcttccaatgccccaaataaaacatttaaatcagttttagaatcctctgctgaacccctgagttctttttaacagactcagccattcacaatagactctaagaacacctacttaactgtctaattaaattattaacttcaattgtgaagttaactcaaatccttctctctttacacgatcctcatcttt

SEQ ID NO: 146530 - DNA, 601 bp, Human
caccacctgcaactacaacagaacctgacactgtaacaaaaaacacagaaattaaagactcaaaatagatacacaggtagtagctgcatcaagtctaaaaactcttgtttctgttttagtagtttttctatgttaccacagttatttctggaaagttatctatttccttctacctagtaagtcctgcttaaaaagaccgagaaggagggggatgggagaacaataaatattattcacccaggaagtccttttgaaatgaactgaaaacatctatcatcagaattaaggtgtatgtgattaytgctttacaatccttgaatttgagtcttatgaggcattaccaccttcgtatttgtaataaaactccagctttacagacatcacctaggggaagggaagggaattggggaaggggtagaaaagaaaagaaagaaaagtccagcttagagagaaaagtgacctgccatgatcatacaactgataagagacacagcaataaataaatagatcaggtctggtgctccatctcaaaacaataatttctcagtctacttattctactataagcagaagtagtaaaaacaaggcaatgcaatgacaa

SEQ ID NO: 146531 - DNA, 601 bp, Human
cagcctaacaacaggctctgccaatctacctctaaaataagccccaaatttactgacttttctccatctctcccaacatcaccctaaatatcaccatattcttatacctaagactattactagagccactttcattctggactcctattccattctacattgaacagctcttatatcatattctacatctcatcactcccctgcttaaaagtcctccaatagcttaaaatccaaattgttttccttggcctacaaggccttagataatttggttctttctcatctctccaaactcatctcrggccacacttcctcctcagtcactacacctaagacatgcttatcttcttttgacttctcaaaacatacctattgtggactgaatgtttacatccccctataattcatgttgaaatcctaacctccaacatgatagataaagtggtggggcatttgggagctgattaggtcataagggcggagtcctcataaatggaattactgtccttagaaaacagaccccagagaaagctctgttttagtctgtgaggacacaaagagaagatagctatgaatcaggaagagggccctcatcagacac

SEQ ID NO: 146532 - DNA, 601 bp, Human
cgaagttgtagattcttaaatgccacacacagagtttcaggttggaattattcaccttcctgcaaaacgtactacaggcaaataataataataacaaaaatgacctaattagctcagctatatgtacaaaaaaagcaaacataaatgaggtggctccatatttcattgctttgtatgactgtgacacattcactgccatattcctgaagctaaaattcctatactaatttgcaaagtaaacacagtacgaaactagaagctgcagcattagattctagtctattatgcattctccatctgytgtcccacactcacaatatttaattttagcaaaatctaattcagtgtatctctacatgaatgcctcattagacatctcaaacttttagcctccaagatggcctctcaaataggctttacttcccatctcattatctaatatttcatatctcagtataaagcaccactctccatgcagctgcccaaatcataacccaggaataattccttccttgtttttaacccatcctctacatccagcctaacaacaggctctgccaatctacctctaaaataagccccaaatttactgacttttctc

SEQ ID NO: 146533 - DNA, 601 bp, Human
aaggttctccacatccccactagattagctagatacaaagtgtcgacacaaaggttctccaagtccccaccagagtagctagttacagagtgtcgattggtgcattcacaaaccctgagctagacacagggtgctgattggtgtgtttacaaaccttgagctagatacagagtgctgattggtgtatttacaacccctgagctagacataaaggttctccacgtccccaccagactcaggagcccagctggcttcaccggggctgctggtggagctgcctgccagtcccgcgccgtgccccgcactcctcagcccttgggtggtcgatgggactgggcgccgtggagcagagggcggcactcgtcagggaggcttggccgcacaggagcccatggaaggggtgggaggctcaggcatggcgggctgcaggtcccgagccctgccccgcgggaaggcagctaaggccaggtgagaaatcgagtgcagcgccggtgggccgtcactgctgggggacccagtacaccctccgcagccgctggcccgggtgctaagcccctcattgcccggggccggcagggccggccggctgctccgagtgcgg

SEQ ID NO: 146534 - DNA, 601 bp, Human
agcagagggggaacattaggacaaatacctaatgtatgcaaggcttaaaacatagatgacgggttgataggtgcagcaaaccaccatggcacatgcatacctatgtaacaaacctgcaccttctgcacatgtatcctagaacttaaagtaaaataaaataaaagttttccattctctgattggtgcgtttacaatccctgagctagacacaaaggttctccacatccccactagattagctagatacaaagtgtcgacacaaaggttctccaagtccccaccagagtagctagttacagaktgtcgattggtgcattcacaaaccctgagctagacacagggtgctgattggtgtgtttacaaaccttgagctagatacagagtgctgattggtgtatttacaacccctgagctagacataaaggttctccacgtccccaccagactcaggagcccagctggcttcaccggggctgctggtggagctgcctgccagtcccgcgccgtgccccgcactcctcagcccttgggtggtcgatgggactgggcgccgtggagcagagggcggcactcgtcagggaggcttggccgcacaggagcc

SEQ ID NO: 146535 - DNA, 601 bp, Human
tgaaatacctaggaatccaacttacaagtgacatgaaggacctcttcaagaactacaaaccactgctcaaggaaatgagaggacacaaacaaatggaaaaacattccatgctcatggataggaagaatcagtatcatgaaaatggccatactgcccaaagtaatttacagattcaacgctattcccatcaagctaccattgactttctttgcagaattacaaaaaaactactttaaatttcatatggaaccaaaaaagagcctgtatagccaagacaatcctaagcaaaaagaacgaagctggaggcatcatgctacctgacttcaaactatattacaaggccacagtaaccaaaacagcatggtactggtaccaaaacagatatatagaccaatggaacagaacagagacctcagaaataccaccacaaatctacaaccatctgatcttcgacaaaccagacaaaaacaagcaatggggaaaggattcctatttaataaatggttctgggaaaactggctagccatatgcagaaaacaggaattggacctattccttacaccttatacaaaaatgaactcaaggtggataaaaagactta

SEQ ID NO: 146536 - DNA, 601 bp, Human
taggtattgatggaacatatctcaaaatagtaagagctatttatgacaaacccatagtcaatatcatacggaatgggcaaaagctggaagcattccctttgaaaacggccacaagacaaggatgccctctctcaccactcctattcaacatagtactggaagttctggccagggcaatcaggcaagagaaaaaataaagggtattcaaataggaagtctaattgtctctgtttgcagatgacatgattgtatacttagaaaaccccatcgtctcagcccaaaaactccttaagctgttaakaaacttcagcaaagtctcagcatacaaaatctatttgcaaaaatcacaagcattcctatacaccaacagcaaagaagcagagagtcaaatcatgagtgaactcccattcacaattgctacaaagacaatgaaatacctaggaatccaacttacaagtgacatgaaggacctcttcaagaactacaaaccactgctcaaggaaatgagaggacacaaacaaatggaaaaacattccatgctcatggataggaagaatcagtatcatgaaaatggccatactgcccaaagtaatttacagat

SEQ ID NO: 146537 - DNA, 601 bp, Human
ttaagatcagagcagaattgaaggagatggagacatgaaaaaccctcaaaaaaaaaaaatcaatgaatccagcagctggttttttgaaaagattaacaaaatagaccactagctagactaataaagaagaaaagagagaagaatcaaatagacacaataaaaaatgataaaggggatatcatcactgatctcacaaaaatacaaaccaccatcagagaatattataaacacctctatgtaaataaactagacattctagaagaaatggataaattattggacacatacacactgccaagaytaaaccagaagaagttgaatccctgactagaacaataacaagttctgaaattgaggcagtaattaatagcctaccaaccaaaaaagtccaggaccagacggattcacagctgaattctaccacaggtacaaagaggaactggtaccaccattccttctgaaactattccaaacaatagaaaaagagggactcctccctaactcattttatgaggccctaactcattttatgataccaaaacctggcagagacacaacaaaaaaagaaaatttcaggccaatatccctgatgaacatcaat

SEQ ID NO: 146538 - DNA, 601 bp, Human
atttaaagaaaattaatcttattaagtattgagaaaagcagactgtaaattccaatttcaacatcaccagccaataaaccatgactgtaagttacaacatctttaaacgtattccaagagtcaatcccagtaactgccttcatttttaagtagacaggattcaattatcgtattctaaccaattaagaataatttatttcaaatgtatttttaagccaggtaataaaaaagattcaaaactcaaaaatttcataatgtaaaaaacaaattattctgttgttctatgtgcttatattaaaayttctaataataatgatcttcaactatactcccattttcccttcatccatgacaatctttaaagcagcttgtcaaaaagagatttacagagctacagcacagtggtaggccaggactaattatctaaatgtattcctgttacaatcatctatagatttataaccaataacctcctgttctattactttttaaaactactgtatattaagaaaatgttatttctcttggccgaaattagtttattactttcctagatgcagagggccagaaacaaatttaatatgcaattgagttcattttt

SEQ ID NO: 146539 - DNA, 601 bp, Human
catgctatttttcttttcggtccctagtaaataccaaacttgctcccatttcagttttagcagcctagaatccccactttcctaatctttacataactgcttctcatcattcaagtctcaatagtgttaccccctcagaaagatttctttcataatcctaggtaagacagtcccactttccaatcattccctataccatcactctattttattctaaatacttatcgttacttcaaattatgcaatttacatgtttaagtatgtactgtcgctctccctcaaccaaaatgtaagtcccatkagggcaaagactttatcttcagccctagaaagttctacgtacttcagccctagaaagttaatgtactatgagtatgcacatagtacatactcaacgaatgtttgttaatcactaatagctaaatgaatgactaggcaatggagacaataaaaacaagggaatagcaaacaaagtgtggcatagtggaaaaagtagacagtctggagccacactgcctgggtttgtttcccagctttgtcatttatttaatagttgtgtgagttttagcaagacacttactgtgcctgacacaaattaagt

SEQ ID NO: 146540 - DNA, 601 bp, Human
aagctctaagtcatgctatttttcttttcggtccctagtaaataccaaacttgctcccatttcagttttagcagcctagaatccccactttcctaatctttacataactgcttctcatcattcaagtctcaatagtgttaccccctcagaaagatttctttcataatcctaggtaagacagtcccactttccaatcattccctataccatcactctattttattctaaatacttatcgttacttcaaattatgcaatttacatgtttaagtatgtactgtcgctctccctcaaccaaaatktaagtcccatgagggcaaagactttatcttcagccctagaaagttctacgtacttcagccctagaaagttaatgtactatgagtatgcacatagtacatactcaacgaatgtttgttaatcactaatagctaaatgaatgactaggcaatggagacaataaaaacaagggaatagcaaacaaagtgtggcatagtggaaaaagtagacagtctggagccacactgcctgggtttgtttcccagctttgtcatttatttaatagttgtgtgagttttagcaagacacttactgtgcctgac

SEQ ID NO: 146541 - DNA, 601 bp, Human
cccttgaaaattcatcatgaacacagaagtaggtgggcccagtgggctagcctctgcgtcagggctgagcagtgccagtcctggaggaagttcatccttcatcctgtccataaacacacatcttggcagaaggtttctacccagggaaatctgtggtttcagtgaatcacaaaagcaataaaatccaaattcctggacaattgtgacctggacagtaactgtctgaaaattaactgagagaagacatttactcctttaccctacaaagtaagtgccacagtcttagaaaattggcatcaakaacagtaatcaatatatatttagactgcaattacttctctccgtgttcaccactaccactttcacctctctgagccaacacaatagcctcctacttggtcactgtcctatgtttatcccctgtgcacagcatccagaaagctcttttaaagtataaatcatcaacgagtaaattttcaaatattttctaatgggccataaaacataatgctttatgatgcacattaatgatatggttattttaagttatgtactaaaatcatttttaaaaatatgcaacccactgcatctccttactgcc

SEQ ID NO: 146542 - DNA, 601 bp, Human
gacaaaacaggagaaaaataaaaatgaacaagtagtaattactggtaggctgccaaaagcaggttttcagtaagtgacctgtatcttcaaactcatctgccttatgagccaggtcaaattaagagaatcagcccttgaaaattcatcatgaacacagaagtaggtgggcccagtgggctagcctctgcgtcagggctgagcagtgccagtcctggaggaagttcatccttcatcctgtccataaacacacatcttggcagaaggtttctacccagggaaatctgtggtttcagtgaatcayaaaagcaataaaatccaaattcctggacaattgtgacctggacagtaactgtctgaaaattaactgagagaagacatttactcctttaccctacaaagtaagtgccacagtcttagaaaattggcatcaagaacagtaatcaatatatatttagactgcaattacttctctccgtgttcaccactaccactttcacctctctgagccaacacaatagcctcctacttggtcactgtcctatgtttatcccctgtgcacagcatccagaaagctcttttaaagtataaatcatcaacgagt

SEQ ID NO: 146543 - DNA, 601 bp, Human
ttcacctcctggtctttaacatctaagaagccaagggagagcagagttacagcatttcaaataaatgtcggattgtgacagcacatagaagacagactgtaagcttgtctttggaaggaaaagcaaatggctgaaaatcactacagaagggaacccactcttcacaaaattttccatctgtcaacagtattattcaaatcagtactacaagtgatcatgtaataattgtattgttttaatcagaggctttcaaggtatgtaacagaaaacacattcaaatatagacccatatgaattaatytcttcatacgtaatatgttaaacatctctgtaagacaaaacaggagaaaaataaaaatgaacaagtagtaattactggtaggctgccaaaagcaggttttcagtaagtgacctgtatcttcaaactcatctgccttatgagccaggtcaaattaagagaatcagcccttgaaaattcatcatgaacacagaagtaggtgggcccagtgggctagcctctgcgtcagggctgagcagtgccagtcctggaggaagttcatccttcatcctgtccataaacacacatcttggcagaaggttt

SEQ ID NO: 146544 - DNA, 601 bp, Human
aagcttttatattggtcttgcaaattttaaaacacctggaaaaaatgttattttttttttaatttcagagctctctaaaatgcataagataccaagttaatttgtattctttgttactcacatggacaaactgcaggaaaaagtgataactttaaaggatttacctattcttccacttaagctttacgagaggtaaaaactcaaggcaaaataattcttatgccacaaataacatgtctaaaatcccccacgggagacatggaggacatataaggagagtgtagggattgctactcaggcycaattcagctggctaggaccctcatgcaggaaaccgatgaaatggtctccacatgcatacactattcacctcctggtctttaacatctaagaagccaagggagagcagagttacagcatttcaaataaatgtcggattgtgacagcacatagaagacagactgtaagcttgtctttggaaggaaaagcaaatggctgaaaatcactacagaagggaacccactcttcacaaaattttccatctgtcaacagtattattcaaatcagtactacaagtgatcatgtaataattgtattgttt

SEQ ID NO: 146545 - DNA, 601 bp, Human
tggggttataggcatgcatcatcacgcccggctaatttttgtatttttagtagagacgggatttcaccatgttggccaggctggtcttggacttctgacctcaagtgatccatctgccttggcctcccaaagtgctggattacaggcatgagccaccgtgcagagccaaacaaaacaaagactaagtaggagaaaattaaaactagcagtcacttagcttattcacattgggaggaagataatatatatacttctcgccagagctacaagcaatattactgatgttagtttctttttataraacttaacatttaagaaggctatcaaatcaaaagcataaaactgaaggactgttctacagaaatattcaatcaattaaaaaaaaaaaagatgaaaaataccattcctcaaaaatcctgatggtcatccatttttcctctctctctctgctgaattaagcttttatattggtcttgcaaattttaaaacacctggaaaaaatgttattttttttttaatttcagagctctctaaaatgcataagataccaagttaatttgtattctttgttactcacatggacaaactgcaggaaaaagtg

SEQ ID NO: 146546 - DNA, 601 bp, Human
actgacatttaagtagtttccgctttttatctattataaataatgctactatgaacatttgtaaacacattttcgtgtggacatatgttttcagttctcttgggtatgtacctaggagtagaactactgggtcattaggtaactctatttaactgatacatggtaactgtgttttgaggaactgccatactgttttccaaagtgagtgtactaccttacatttccaccagcaatgtatttggattccaattagtccacatccttgccaatgcttgctactactggtctttttaattataaycattctggcaggcatcaagaagtatctcattgtggttttgatttgcatttccttaatgactatgctgagcatcttctcatgtgctcaatggccatttgtgcatctttgcagaaatgcctatcaaatcactttcccttttaaaccagttgtctttttattgttgagttataagagttctttataaattctgaatacaaaccccttatctatgactcacatattttctcccgttctgtacattgttttttaagcaactcctttttttttaactcacccagaatcccaccttataataaaata

SEQ ID NO: 146547 - DNA, 601 bp, Human
attagaaattcaaatgccgggcacttttctagaacctggacacaaagcatgaacctaacaataaccccgccttcatgaaaaatatggactatttgaaaattatacctgcaacactaaataaatattcttcattcttccagtatattgagatgtttactttcaattagacaatttgctttcctctctgaacacatagttatgtgatggctctataaaagattttaaaataactatagaaggaactattggtaaagactgtgggatactaaaaatggctacaaagaaagttatgacaaaaccyctgagtttgaatggaagtcctactagattagagtctaagcctgtgacattatgcttctggttcttgttcttaaatgcttttctcattaatagtatgtaacttacttcctggaatgccattcattaaaaaaatatttaatatttgctaaatgtcaatatttatgccagcacttttaaagtacagaaacatggagtttctttacctcatgcaaatatgctgtgagaaagacttaagagcctattgcctactttgtggtacaacactgaagactcaccatccaaaacaaacagacttagtaaa

SEQ ID NO: 146548 - DNA, 601 bp, Human
acttatttggtcagggcagacttcacttttcatgataattatgttctgaaaattctacaaacttaatgattacaaacaaaagtcatagtttgctcataaatcaggcctaggtctggattctagttcttccatttttcatttgttcactgaggcaagtgacttaaaattccctagcctcagtttcctcacatgtaaaatcagataatgattcctattcctaagatggttttgaggcttcaacaagataagatgggcctcactcaagcatgctcagtactctgtctctctctctccggttatrcagaaattctattaggattctgcaaagtaaaataaatatttcagtaaaaattatgccctttattaatgaatctagattttcagattttccttaaatttacttagtaacttaagggctcaaatattatagagatttgtatctagtattttaaagaaatgaaaggtgttaatcaaaatgctgcacaaataaatgctacatttaacaaacagaatatcacaaccatacaaactaatcagatataaagaagtcagcaacagaaatctgatgttgcctttagatcacacaattaggcaaacaaaa

SEQ ID NO: 146549 - DNA, 601 bp, Human
attttaactttattagaaaacaagcattgttttatcagcttcttgtttttttaaaactaaaaataacactgctaggttgtttctatgaagattctctaaatttatttataaccttaagaataacatgtagaacaaagtagatgactgaatgatctttgttgaataaatatgaatggatattcaaataattaaaaatctcttaagatctcccattctttacaggatacagagaaaactcgttaatatggcctgacttttacctttgcagccttatccaaactctgtggtcaagacaaacagrttgtccttatacttacaacgtccccctttgcctacaaagctcttctcatgactctttgcctatcttaagttcacctatctgtcaaatctctgggaatgcaacatttcctcaaggtagccttctctcctcccaaactagaacaaattcttcctggggcattaggtttttattgcactgtatgtctcttcttcacagcaatcacagttccaatgttatatttgtattcttagttgatttgtttctttccacctttagactataaccttctaaggggtcacacataatatcgatcatcagttg

SEQ ID NO: 146550 - DNA, 601 bp, Human
agaccagcctgaccaatatggtgaaaccctgtctctactaaaaatacaaaaattagccaggcatggtggtgggcaattgtaatcctagctactcgggaggctgaggcaggaaaatcgcctgaacccaagaggcggaggtttcagtgagccgagattgcactagtgcactccagcctgggcgacagagcaagacttcatctcaaaataaataaataagtaagtaaataaaattaaaaaatatataaaaataaaacaaagataagtaggaaccatcctttttttttttttttttttttttttttaaagatagggtctgtttctgatgcccaggcttgagtgtagtggcatgatcatggctcactgcaaccttgacctctcaaatacaagtgactctcctacctcagcctcccaagtagctgggactacaggtgcttaccaccccatccggctcatttaaaaaaatttttttgtagaggtggggtctcactatgttgtatccaggctggtctcattttaactttattagaaaacaagcattgttttatcagcttcttgtttttttaaaactaaaaataacactgctaggttgtttctatgaaga

SEQ ID NO: 146551 - DNA, 601 bp, Human
gtcctggttacttggaaggctgaagtgggtggatcgcttgagccgggaaggcagaggctgtagtgagctgagatcacatcactgcactcaagcctgggtgacagagcaagaccctctctggggaaaaaaaaaaaaaaaataggctgggcgcagtggctcacacttgtaattccagcactttgggaggctgaggcaggtggttcacctgaggtcaggagttctagaccagcctgaccaatatggtgaaaccctgtctctactaaaaatacaaaaattagccaggcatggtggtgggcaattrtaatcctagctactcgggaggctgaggcaggaaaatcgcctgaacccaagaggcggaggtttcagtgagccgagattgcactagtgcactccagcctgggcgacagagcaagacttcatctcaaaataaataaataagtaagtaaataaaattaaaaaatatataaaaataaaacaaagataagtaggaaccatcctttttttttttttttttttttttttttaaagatagggtctgtttctgatgcccaggcttgagtgtagtggcatgatcatggctcactgcaaccttgacctctca

SEQ ID NO: 146552 - DNA, 601 bp, Human
cacaatagccaaaaggtggaagcaactccagcagatgaatggagaagcaaaatgtggtatgtatatacaatggaatattattaagcctttaaaaagtggaaattatatctatctatatctatacacacatactcacacacacacacacacatttatagaagacagggtttcaccatgttgtcaaggctggtctcgaactcctgggctcaagcaaaccgcctgcctcagcttcccaaagtgctgagattacatgtgtgagccaccacacccagccaaaaaaaggacattctgacacataatmcaatatagataaacaatgaggacatcatgatatgcgaaataagcctgtcacaaaaaggcaattagtgtatgattcctcttgtatgaggtacctatggatgtcaaatccataaagtagaatggggaaacagagagttgtttaatgggtatagagtttgttttgcaagaagaaaagagttttggagaatgaatgtacaacagtgtgaacataattaacactactgaaaatggttaagattataaattttatgttacatttattttaccatgattaaaaattaaaacaaaataatattaagga

SEQ ID NO: 146553 - DNA, 601 bp, Human
cccagctactcaggaggctgaggcaggagaatcacttgagcctgggagacagagattgcagtgagccaagatcatgccacagcattccagtccaggtgacagaacgagactctgtctcaacaaaaagaacaaattaaaccctacaactcatcaacaaaaatacccaaacccaattcaaaaatgggcaaaggacttgaatagacatttcttcaaggatgataaacaagcacatgaaaagatgcagagcactattcattagtgattacatcccacatgcattaggatggctagtatgaagaayagaaaataataaatattggtgaagatctgaaaaacagaaacctttgtgcactgttggtgggaatgtaaagtggtacagctactacggaaaacagtatggccattcctcaagaaaataaaaataaaattatcttatgataggaatatgcatttctgggtaaataccccaaataactgaaaacagggtgtacacccatttcaacatttacatgtcaattcaactgggccagaatacccagatatttgttcaaatattcttctggatgcttctatatatatgttttttggctgaggttaacat

SEQ ID NO: 146554 - DNA, 601 bp, Human
catccagtgggaaaaggacagtaagaagtgagtaaactatggcccactggccaaattgtggcctctgcctatttttgcaaataaagttttactgggacaaagccaagcctatcatttgcaaattgtctataaatattttcatgttacagaatcacacagtttcaacagagaccatcttgtctacaaagctgaaaatatctactatctggcccttgaagaaagtttgccaaaccttagtttatataataaaagatcagctatctcatagacacctatctcacacaacacattgtgggaaagkaccttcttttttttttgagacggggtcttgctctgttgaccaggctggactgtagtggcatgatcatggctcactgcagcctcaacctcccaggttcaagtaatgctcccaccacagaatcccaaacagctgggagagatgtgtgccactacgcctggctaaggggcctttttaacagagaaagaaatccacatactactaagaaaaagaagggcatatttgatatatatttatattttttatatagatatcataaaaatcaagatgaattatacagttatattttgcaatgtgtttgac

SEQ ID NO: 146555 - DNA, 601 bp, Human
gaattatatcaaaatttaaatcgaaatttaatgtatttccatctctaatcagacaggacactatggggaactgaataagtgattttaaaagtcatggaaaattaataactgagaataaccatgaaaagtatgaaaaaaggagacaaatgaattgctccaacagatatcagaacgctaaaattaaataaaaatactactaggataagaaaatacatatactgatgtaatgaataaagaatccagaattagattccagtaagtcaaactactttactataaaccaggggtggcatattcatcyagtgggaaaaggacagtaagaagtgagtaaactatggcccactggccaaattgtggcctctgcctatttttgcaaataaagttttactgggacaaagccaagcctatcatttgcaaattgtctataaatattttcatgttacagaatcacacagtttcaacagagaccatcttgtctacaaagctgaaaatatctactatctggcccttgaagaaagtttgccaaaccttagtttatataataaaagatcagctatctcatagacacctatctcacacaacacattgtgggaaaggacct

SEQ ID NO: 146556 - DNA, 601 bp, Human
tgtttttccaatgccataaataactagaaatggaaacaaaataaagaaaaacaaaatctacaaaacacctggaaataaaaagaaaaatggtctatttgaagaaaaccttaaaatctatgcagaacataaaacaaaatctgaataaaaagaaatatcatgttcttgtctgggaagacttaatatcataagaaagtgaattatatcaaaatttaaatcgaaatttaatgtatttccatctctaatcagacaggacactatggggaactgaataagtgattttaaaagtcatggaaaattaatractgagaataaccatgaaaagtatgaaaaaaggagacaaatgaattgctccaacagatatcagaacgctaaaattaaataaaaatactactaggataagaaaatacatatactgatgtaatgaataaagaatccagaattagattccagtaagtcaaactactttactataaaccaggggtggcatattcatccagtgggaaaaggacagtaagaagtgagtaaactatggcccactggccaaattgtggcctctgcctatttttgcaaataaagttttactgggacaaagccaagccta

SEQ ID NO: 146557 - DNA, 601 bp, Human
acttctgtacaatgttttctcggacatatattttcatttttcttgagtggagctgttagaactgttggatcagaaagtaagcatatgttgaattttgaaagaaactggtaaactcttgtctaaagtgatttgtaccattttacactcctactaataatgtatgagagttatatttgctccacagcctttttactactttgttaatctttttagtactgtcaacctttttaatttatccaatctagggaacgtgaagtagtatctcactgttattttcattttcctgatgagtaacaatatygtgtatcttttcatgtgcttattagccattcctatatcttttgtgaaatagttaacttaaatttgtaactaaaggtgctttcctgagtttcaggtagtaagcctatttccctcaagtgaataaactacagtcttggaatgaaaaattaaacacagtggagacattttttgtataagttgttttactctgtgtatgtctggtttgcttagtctattattatatgccccatgaaagcaaacacagtgcttatttcactaatgagtatcactagcacatagaactgtgcttgcccaaagcatg

SEQ ID NO: 146558 - DNA, 601 bp, Human
ataattctgctatgaacacttctgtacaatgttttctcggacatatattttcatttttcttgagtggagctgttagaactgttggatcagaaagtaagcatatgttgaattttgaaagaaactggtaaactcttgtctaaagtgatttgtaccattttacactcctactaataatgtatgagagttatatttgctccacagcctttttactactttgttaatctttttagtactgtcaacctttttaatttatccaatctagggaacgtgaagtagtatctcactgttattttcattttcytgatgagtaacaatatcgtgtatcttttcatgtgcttattagccattcctatatcttttgtgaaatagttaacttaaatttgtaactaaaggtgctttcctgagtttcaggtagtaagcctatttccctcaagtgaataaactacagtcttggaatgaaaaattaaacacagtggagacattttttgtataagttgttttactctgtgtatgtctggtttgcttagtctattattatatgccccatgaaagcaaacacagtgcttatttcactaatgagtatcactagcacatagaactg

SEQ ID NO: 146559 - DNA, 601 bp, Human
aaaatagcttaattgaagaataaattaatacaataaaaggaatacattttaagtatacagttcaaactgtaacagtgttacagtttcaagaggaccccttcaacaagatattgggcatttccatcatgccctaaaagttccttcttgtcccttactggttgggtccatctctactacaccctcctgacctggcccagaccttggcctcagaagaatcatttttttgtcactacatattagttttgtctgttctagaacttcttaaaaacagaatcatagagtatgttctctttgtattggytctttttactcaatgtaatgttctgtgacatttatccatattattgcatgtattattccttttaatcctgaatagtatgctgttttaggaatataatgcaattgtttattcatttacctgttgacagatatctgagctattatgatggatattatgaataattctgctatgaacacttctgtacaatgttttctcggacatatattttcatttttcttgagtggagctgttagaactgttggatcagaaagtaagcatatgttgaattttgaaagaaactggtaaactcttgtctaaagt

SEQ ID NO: 146560 - DNA, 601 bp, Human
ccaatttgactctcagatgctaagaaaaaaaagacatattcttctgcagtaccgcctggcaacgatatactctttaagggggagaaacctggcatcctgagggaagcataaattataacaccatcttacagctagacctcttttgtagaaaagaaggcaaatggtgtgaagtgtcatacgtacaaactttcttttcattaagagacaactcgcaattatgtaaaaagtgtgatttatgccctacaggaagccctcagagtctacctccctaccccagcatcccccagactccttccccaamtaataaggaccccccttcaacccaaacggtccaaaaggagatagacaaaggggtaaacaactaaccaaagaatgccaatattccccgattatgccccctccaagcggtgggaggagaattcggcccagccagagtgcacgtacctttttctctctcagactttaaattaaaatagacctaggtaaattctcagataaccctaatggctatattgatgttttacaaggtttaggacaatcctttgatctgatatggagagatataatgttactgctaaatcagacactaaccccaaatgac

SEQ ID NO: 146561 - DNA, 601 bp, Human
tctaggactaatgctcatcggaaaatgactagtggtgctggcatccctatgttcttttttcagataggaaacgttcccctcaaggcaaaaacacccctaagatgtattctggagaattgggaccaatttgactctcagatgctaagaaaaaaaagacatattcttctgcagtaccgcctggcaacgatatactctttaagggggagaaacctggcatcctgagggaagcataaattataacaccatcttacagctagacctcttttgtagaaaagaaggcaaatggtgtgaagtgtcataygtacaaactttcttttcattaagagacaactcgcaattatgtaaaaagtgtgatttatgccctacaggaagccctcagagtctacctccctaccccagcatcccccagactccttccccaaataataaggaccccccttcaacccaaacggtccaaaaggagatagacaaaggggtaaacaactaaccaaagaatgccaatattccccgattatgccccctccaagcggtgggaggagaattcggcccagccagagtgcacgtacctttttctctctcagactttaaattaaaatagacc

SEQ ID NO: 146562 - DNA, 601 bp, Human
gcatcttgatggagcagctgggttgttatgaaatactcaggaactcagcctagctctaggactcacccctgagcacaaaggcaatgttgggcacgctggtaaaggaccactagaatccagcagcccggacccctttctttgtgatcaagaaaggcgggaaaaggggtgagggctgctacatcagtgagcataactaatccgataagcagaggtccatgggtggttacacaccccggaaaggaataagcattaggaccatagaggacgctctaggactaatgctcatcggaaaatgactagkggtgctggcatccctatgttcttttttcagataggaaacgttcccctcaaggcaaaaacacccctaagatgtattctggagaattgggaccaatttgactctcagatgctaagaaaaaaaagacatattcttctgcagtaccgcctggcaacgatatactctttaagggggagaaacctggcatcctgagggaagcataaattataacaccatcttacagctagacctcttttgtagaaaagaaggcaaatggtgtgaagtgtcatacgtacaaactttcttttcattaagagacaactc

SEQ ID NO: 146563 - DNA, 601 bp, Human
ttgagctgaacactagtcactgggttccacggttctcttctgtgacccgtggcttctaatagagctataacactcaccgcgtggcccaagattccatttattggaatccatgaggccaagaaccccaggtcagagaacacgaggcttgccatcatcttagaagcagcccgccaccatcttcggagttctgggagcaaggaccccctggtaacaatttggcgaccacaaagggacctgaacccgcaaccatgaagggatctccaaagcggtaatattggaccacttttgcttgctactctgkcctatcccttagaattggaggaaaatactgggcacctgtcggccggttaaaaacgattagcatggccgccagactttagactcaggtatgaggctatctggggaagggctttctaacaaccctcaacccttctgggttgggaaccttggtctgcctggagccagcttccactttcaattttcctggggaagccaagggctgactagaggcagaaagctgtcgtcccgaactcccggcattagccggttgagatcatgtcgcagccagaagtctctactcaacagtcgcccatgcgtgcgc

SEQ ID NO: 146564 - DNA, 601 bp, Human
caaggaggggcttaaactgattattttacagcttgggtgcaattatcccacaaaaaactttcaggagtttcaccagtccataaactatttggttattagaaaatagctttattgggctaccctctttgggtcccctccctttgtatgggagctctgttttcactctattaaatcttgcaactgcactcttctggtccgtgtttgttacggctcgagctgagctttcactctccatccaccactgctgtttgccgccatcgcaggcctgccactgacttccatccctctggatctagcaggktgtccgttgtgctcctgatccagtgagacgcccattgccgatcccgactgggctaaagacttgccattgttcctacgcggctaagtgcccgggttcatcctaattgagctgaacactagtcactgggttccacggttctcttctgtgacccgtggcttctaatagagctataacactcaccgcgtggcccaagattccatttattggaatccatgaggccaagaaccccaggtcagagaacacgaggcttgccatcatcttagaagcagcccgccaccatcttcggagttctgggagcaa

SEQ ID NO: 146565 - DNA, 601 bp, Human
ggtaaaacaaacagggaaataaaacaactcagaacctaagcatatcgtaagaacctaatctaacaaggaggggcttaaactgattattttacagcttgggtgcaattatcccacaaaaaactttcaggagtttcaccagtccataaactatttggttattagaaaatagctttattgggctaccctctttgggtcccctccctttgtatgggagctctgttttcactctattaaatcttgcaactgcactcttctggtccgtgtttgttacggctcgagctgagctttcactctccatccrccactgctgtttgccgccatcgcaggcctgccactgacttccatccctctggatctagcagggtgtccgttgtgctcctgatccagtgagacgcccattgccgatcccgactgggctaaagacttgccattgttcctacgcggctaagtgcccgggttcatcctaattgagctgaacactagtcactgggttccacggttctcttctgtgacccgtggcttctaatagagctataacactcaccgcgtggcccaagattccatttattggaatccatgaggccaagaaccccaggtcaga

SEQ ID NO: 146566 - DNA, 601 bp, Human
tctttatatcagctctttttactcaacacaatgttgtgtgagatttatccatgttgttgcatgtatcattcccaaacagaaatagaaattatagagataaataggagttacaaaaaagtaccaaacaaaaattctggagttgaaaagcacaaaaactgaattaacttgaggggctcaacagctgatttgggcagccagaagaatgaatcagcaaatctaaagataggtcaattgcgagaaagagagggaagaaggaaggaaggaaggaaaggaggctcagagacccaagagacaccatcargcataccaatatacatataatgagaggcccagaagaagatgcagaaaaagggtcagagtatctgaaaaaataatggccctaaacttcccgaacttgaccccaaaaattaatctacacatccaagaagataaacaaactaaaaagaataaaatcaaagcgatccacacctaggtacatcataatcaaatgactgaaatataaagagagactctcaaaacaggcaagggacttatgtacaaaacatcttcagattaataacaaatttctcatcagaaatgatgttgtcaataggcaatcaga

SEQ ID NO: 146567 - DNA, 601 bp, Human
aactggccctgaaaaagaccagatgctggacttactggacaaagactttaagagagttattttaaatatgcgcaaagaactaaaaaaaagtttatctaaagaactacaggaaagtatcagaacaatatttctgatccttcagaagaaccactttttgtcactacagattagttctgtctggtctagaacttcttaaaaacagaatcatagagtatattctctttatatcagctctttttactcaacacaatgttgtgtgagatttatccatgttgttgcatgtatcattcccaaacagaartagaaattatagagataaataggagttacaaaaaagtaccaaacaaaaattctggagttgaaaagcacaaaaactgaattaacttgaggggctcaacagctgatttgggcagccagaagaatgaatcagcaaatctaaagataggtcaattgcgagaaagagagggaagaaggaaggaaggaaggaaaggaggctcagagacccaagagacaccatcaggcataccaatatacatataatgagaggcccagaagaagatgcagaaaaagggtcagagtatctgaaaaaataatggcccta

SEQ ID NO: 146568 - DNA, 601 bp, Human
aaatttttatattttataaataattagaaagaatacattttttaaaactttaaaaaacacctcagtttttattctcttccccaaatttcaacaaaatccatttatccaaacttgaggttgaatcattaaagtggtgatatcatcagtaatagcagagtgaggaccctgaatatactctcctccataaaagcaacaagaacacaaaaattctcaaaatgaactttttctgaaatctttcaaaagccccactctcagaaaactgtcattatttgatctgccagttccctagaaaaacctccctcataggacattatttgacttgactcagagctcactcagtgcaaacaattttatcaccaggagagtttgtggaaaatcagtggcaattgttaaacatcacatctgccatgagatagcaataacagatgggacaaacaagctaaccaaaaaattaaaagaaaaacctgggaaataagaaatccaaagggggtctgaaaagttctaacatatttctgataatccagaaagccatacacatgtatagagctgtgtacacgctcaaaaaacatctacgaaggccctaaactctcacctatgggaa

SEQ ID NO: 146569 - DNA, 601 bp, Human
tgtaaaataatttaaaacagtacctggtattcaataaagcgcaataaatgttagctgctattattattcatctaaactttactttcattaccagcaatattttttaatcttaaaaatattgaataaaacaatgacctagcttagtaaataaattcataatgagaaaatgttgatttcatttaataataactttagtagtttgggataacactttgcatattttaatttccccagctataaataactcaaataatttgccatcagatgatctgttattttgaagttaacaaataaagcattycctaaaaaagttctaatacataacttttgctctcatcttatgttttaaaaacaaaatggcaaatcatctgcatcaaatagttcctactcttataacatgacaattgttttaaaatatatctgctggaaaaagcaactgaagtcctagaaaatagaaatgtaattttaaactattccaataaagctggaggaggaaggggaaaaacatatctgccaaataagcttataattaatagttgttttcagttttcaaaaatccacataggaagcaatttaagcctaaattgcctaagtctcaatc

SEQ ID NO: 146570 - DNA, 601 bp, Human
tgattaagagcataggctataaagccagactggactccctggattcaaatcctggctcttctaattactaggtaggtaaccctgagcaagtttcaatgaccaatctttttctcaattacctcaggtatataaaggggacagtaacagcatttaacccagaggacaataaggattaaataaatacatgtaaaataatttaaaacagtacctggtattcaataaagcgcaataaatgttagctgctattattattcatctaaactttactttcattaccagcaatattttttaatcttaaaawtattgaataaaacaatgacctagcttagtaaataaattcataatgagaaaatgttgatttcatttaataataactttagtagtttgggataacactttgcatattttaatttccccagctataaataactcaaataatttgccatcagatgatctgttattttgaagttaacaaataaagcatttcctaaaaaagttctaatacataacttttgctctcatcttatgttttaaaaacaaaatggcaaatcatctgcatcaaatagttcctactcttataacatgacaattgttttaaaat

SEQ ID NO: 146571 - DNA, 601 bp, Human
gaggccgggtacggtggctaacacctgtagtcccagcactttgggaggccaagatgggcggatcacttgagcccaggaattcgagaccaacctgggcaacatggtgaaaccccatctctataaaaaatacaaaaattagctgcgcctggtggtgtgcgcctgtagtcccagctactagagaggctgagggaggagaatcaccagggcctgggagatcaaagctgcagtgagctgagatcgtgccactgcactccaccctgggtgacagagtgagaccctgtctcaaaaaaaaaaaaaaaaagaaagaaagaaaaaaaaatcaaaactgatcacttgaggtccaacttatgtttactatatctacttatattcccaaagacatcttaaggagagatgaaatcataaaaaggtgaggatgagaaagaaaatagtaagtcagtaaggtcaatttttacatatattaggctagcataataaaaatatgagtgtcttattattatttttttttgagacagagtcttgctctgttgcccaggctggagtgcagtggtgcaatcatggcttactgcaatgtctgccttccaggttcaagcaatccttg

SEQ ID NO: 146572 - DNA, 601 bp, Human
caggtgactttcatgaaaagattacacccaagatagacatatggtctactcaaatacggtttccaaatgtgtatccaatcttgtttaattataatcaaactcaccattccattgataagcgacctctaccaacctgcttatcccctccaagcaatataacagtggttctctgaaccaatattgaccctcctttaaattgatagcctttttttaaaaagctaaccattgagaagtacatactgttgaagacagaacatattctgtaaaatgctcccaagatatcaaagtcagatgatacaaytgaatgtttatgctagattatatttctaagctgagaattacattttaatataccataagcaatctgcaaaagaagcaacttgcctaaagatttcaggagtttcaagtatgcatatgtcaatatctgtatcaatatgtaatatcaatataatcaatgcacacaacaatacgtaactgtacttatatcatctccttagcactaattattacaaacaatctgcatgcactgcaaagcaaaagtataatataaaatcccaaaaaaccttgaaaatttaataaaaccaaaaaacaggcatcacac

SEQ ID NO: 146573 - DNA, 601 bp, Human
tattccaaatttcatgcacattaactcagccacacatctaacacagtcagccctccctatccaggggttctgcatctgcagattcaactaaccatgggtcgaaaatgtttttgtaccaaacatgtacaggctttttttcttgttatcattccctaactacagtataacaactattttcacagtgtgtacatgtgtatgaaatattataagtaatctacagataatttaaagtatacaagagggtatgcataggttatatgcaaatactacaccattttatatcagactctcaaacatcagkagaatttggtaacccagggaggtcctggaactaatcacccagaggtatcgacagatggctatatataaatcactcagtgaattcaggattcacattatttcacaactagtataattttatgttgttcacataattgtgtcacaacatatacatgcagacaggtgactttcatgaaaagattacacccaagatagacatatggtctactcaaatacggtttccaaatgtgtatccaatcttgtttaattataatcaaactcaccattccattgataagcgacctctaccaacctgcttatc

SEQ ID NO: 146574 - DNA, 601 bp, Human
tcttaacatacgtcaattttctatatttcatgtcatttctatttgcaaatgttataaagttcaatatgatgtaaaacatggttaaatgaagttcaaaaataagtataacatacattagtttggctattccaaatttcatgcacattaactcagccacacatctaacacagtcagccctccctatccaggggttctgcatctgcagattcaactaaccatgggtcgaaaatgtttttgtaccaaacatgtacaggctttttttcttgttatcattccctaactacagtataacaactatttkcacagtgtgtacatgtgtatgaaatattataagtaatctacagataatttaaagtatacaagagggtatgcataggttatatgcaaatactacaccattttatatcagactctcaaacatcagtagaatttggtaacccagggaggtcctggaactaatcacccagaggtatcgacagatggctatatataaatcactcagtgaattcaggattcacattatttcacaactagtataattttatgttgttcacataattgtgtcacaacatatacatgcagacaggtgactttcatgaaa

SEQ ID NO: 146575 - DNA, 601 bp, Human
aaacgagcagaataaattcttttgttttataactatgaaataatctatgttcctcttatctatgcttggaaaatttagacaaaatgttaagagtaagtactacattggatttccgggtcttcagctctgaaaacaagctgtttcttaacatacgtcaattttctatatttcatgtcatttctatttgcaaatgttataaagttcaatatgatgtaaaacatggttaaatgaagttcaaaaataagtataacatacattagtttggctattccaaatttcatgcacattaactcagccacayatctaacacagtcagccctccctatccaggggttctgcatctgcagattcaactaaccatgggtcgaaaatgtttttgtaccaaacatgtacaggctttttttcttgttatcattccctaactacagtataacaactattttcacagtgtgtacatgtgtatgaaatattataagtaatctacagataatttaaagtatacaagagggtatgcataggttatatgcaaatactacaccattttatatcagactctcaaacatcagtagaatttggtaacccagggaggtcctggaactaa

SEQ ID NO: 146576 - DNA, 601 bp, Human
attagaatctggcattacaaaagaacaatgttataaatccaggtcagagtttatagttctatttcactattacttatatggcttgtcctaggaacttaactattatttacaatgtaagtacctatttccacaaaaaaattcaaaattttggaatacaatatctgaagagagaatggtctattgaatccaaagtaggctgatacatcccaacagtatttcagattgagataataataataccaccaattcatcaagtcaaattatatgcttattttccacaatggaagttttaaaatagtayaaacattttaatatatagcaggcttaacttatgattattaaacagggttctaagaaaatagtatacatcaaatattaatgtgcttcttgtataatttaggtgacaatttatccatctgagaaatgcaaaagagactttggtaaggggttgagtaaggagcattctgtgtcaaagaattcactagcaaaagagggtatactgtagttacaagctataatcactgtacttattttaaatccctcttcagaaccaggtcttaaaagatgataaacatggcctcatgaataactatcaaccaaa

SEQ ID NO: 146577 - DNA, 601 bp, Human
ggaacctctggattcccacccacactgctgtgacctgaatggggaagagaaacgccatagtaagggaactcttccttttatagatttctgaattagaatctggcattacaaaagaacaatgttataaatccaggtcagagtttatagttctatttcactattacttatatggcttgtcctaggaacttaactattatttacaatgtaagtacctatttccacaaaaaaattcaaaattttggaatacaatatctgaagagagaatggtctattgaatccaaagtaggctgatacatcccaacagtatttcagattgagataataataataccaccaattcatcaagtcaaattatatgcttattttccacaatggaagttttaaaatagtataaacattttaatatatagcaggcttaacttatgattattaaacagggttctaagaaaatagtatacatcaaatattaatgtgcttcttgtataatttaggtgacaatttatccatctgagaaatgcaaaagagactttggtaaggggttgagtaaggagcattctgtgtcaaagaattcactagcaaaagagggtatactgtagttaca

SEQ ID NO: 146578 - DNA, 601 bp, Human
aagtatcaaatatgggaccattaaaaatgtccttactaacaaattgctacccacattgtggactcactgcgtccactgtttgcgagcttttccagaacgctcgccaccagttagggtagccaagaactcctcatcttcactttcttcctcactagcttggaacctctggattcccacccacactgctgtgacctgaatggggaagagaaacgccatagtaagggaactcttccttttatagatttctgaattagaatctggcattacaaaagaacaatgttataaatccaggtcagagttyatagttctatttcactattacttatatggcttgtcctaggaacttaactattatttacaatgtaagtacctatttccacaaaaaaattcaaaattttggaatacaatatctgaagagagaatggtctattgaatccaaagtaggctgatacatcccaacagtatttcagattgagataataataataccaccaattcatcaagtcaaattatatgcttattttccacaatggaagttttaaaatagtataaacattttaatatatagcaggcttaacttatgattattaaacagggttct

SEQ ID NO: 146579 - DNA, 601 bp, Human
cagaattatatccacaatctggtttggagtttatgttttgtcttatttaaattgttatacttattataattctgtctagacagtgccaaatgtactttgtcatacaaacacttgaggcaaattttcttcaaataagcgcaacactttgtttcctcttcgtatcctttgactgaataacgtgtggtacagagaagtaatacttccctttcttgggatcgagatcaatttgatgcttgttataagcccatttacagaacaaatggtattgcttttaaatttttatatgaacttatcagtagastagccaaaaaagaagcttcatataaaagtgctaggattgatattcttagtaataattaggtaaattctctaaaattttctcccaaaagatctgaaaaatcataccaagggaagtatagtttaaatttcattatatataatagctttaaaatatctttgctaattctacccaaagccacactaaaaagactaatacaaaaagaatgtaattaataaactattttcctctgaagaatcaaagggcacttctgcatatgaacatgttttatccttttggtgtacttacataaaataattaaga

SEQ ID NO: 146580 - DNA, 601 bp, Human
aattttgagataatgaaccgaacttactatttttgaaaatattacataataaatattagtgaagcttcattgctgaaatggtgacaaagatgaatagcaataaaacttttcttatagatctttagcaaaaacaaaaaaaccccaagcatactatggtacattactttagagaatcaagtagctgctagttgagtaatagtggtaataggcactacaatgatataaacaaattacaacaaagaatattgtttttatttcctgtccatgttttaaaaaagctttggttttacctatgtttaayaaaagcataggtacaacaacgactactactactaacatataagtagcctggatagaattatcttaatagtagtacccaagtgcaggatctctaagtaatgatcagaaggcaggaataaattttatcagaaatcttcattcattacatatttactatgcatttaccagggtatcactatgctaatggatacaaagataaataacatgcaaacaactgtaatacagtgttatgtgataacagaaatatgtacaaagcactatgaaaaaaattacaaagcttgagcacaaattttaactctgg

SEQ ID NO: 146581 - DNA, 601 bp, Human
gctgtggcgggtgcttgtaatcccagctactcgggaggctgaggcaggagaatcacttgatcctgtgaggcggaggttgcagtgagctgacaccgtcccactgcactccagcctgggcgagagcccagagcgagactccgtatattaaacaaaacaaaacaaaactcaaaaaaccctattggcaattactagggccatcaaatcagtatattttcacttgacacacaattttgagataatgaaccgaacttactatttttgaaaatattacataataaatattagtgaagcttcattgctcaaatggtgacaaagatgaatagcaataaaacttttcttatagatctttagcaaaaacaaaaaaaccccaagcatactatggtacattactttagagaatcaagtagctgctagttgagtaatagtggtaataggcactacaatgatataaacaaattacaacaaagaatattgtttttatttcctgtccatgttttaaaaaagctttggttttacctatgtttaacaaaagcataggtacaacaacgactactactactaacatataagtagcctggatagaattatcttaatagtagta

SEQ ID NO: 146582 - DNA, 601 bp, Human
gcctgggcaacagagtgagactgctcaggatctcccaaagacccaaatccctgtaaactgaatgcataatatcatttgctccagtgaggcttagatggacattctagtcttcttggttgagctgaagaaacaaatattatattgataatttatgtatgttgtatttttcaaggtatagcaacaagtttttattcatcagctactttgtgtgtgtgctttgtttttaagtcttttgaaacaggatggtgatttactacatttataagtaaaatttatttgatttacaagggttgcttaagtrtatcacaggatttcacttgttatatttgcaggtgcttaaaaaatcagctatactaaactataactggaattagcaaagttcatttattgattaatcaagaatataattagatttgcctaactatataagtagtactatgtgttatttaagaattaaatctagaaaagggatggactctggaaatatcaagaagtgaaaaagactgctctcatttttgtacaacaattactaaatttctaagtagcattaattgaactgaaaaggcattttagaaaaactagattttacaatttataactc

SEQ ID NO: 146583 - DNA, 601 bp, Human
actactttcaaaatcagcctagaacttaacactaaaggcatgacccataaaagggaatactaataaatagacttaattaaaattaaacaacaacaacaacagctaagcttttgttctgcaaaagatcctgtgaagagaatgaaaacataagccgcaggctgggagaaaatatttgcaaaccatatttccgagaaaggtcttgtgtctataatatataagaactcccaaaattcaacagtttttaaaaaaagcaaataatccaattagaaaatgggcaaaagacatgaacagacattttacmaaagagaatatataggtggcaaataagcatatgaaaacatatctcacacatcattagccattaaagaaatgcaaattaaaaccacaatgtgatatcattacacacctaccaaaatatccaaaataaaaattagtggtaacaccaaatgctggtgcgcatgtggaaaaatagtccttcacacactgatggtacaaatgcaaaacagtacagtccctcaggaaaggagtatggcagtttcttacaaaactaaacatgcacttaccatatgaccaagtaattatactcttgaatattcccaga

SEQ ID NO: 146584 - DNA, 601 bp, Human
tgtaatcccagcacttcaggagaccgaggtgggaggagagcttgagcccatgagtttgagactcacccgggcaacacagagagacctcatctcttaaaaaaaaaagaaagaaagaaagaaatgaaatgcaaagaaaaagtctctatttcaaatgtagccagtagagccaataggttaaccaatattaacattaacgttgataaaacaagaaatgatgatttactataagctgaaaatcagacaatgtatggactttaagagtaacaggcacgatcatcacaaacttaaatcaggtttgagycctatgagttatatacagttacatgatgcaacaaaagatgccagccagttgttaaagagtattagattcggctgggggtggtggctcatgcctgtaattccagcactttgggaggccgaggagggaggatcacgaggtcgggagtccgagaccagcctggccaatatagtgaaacctgatctctactaaaaatacaaaaactagtcaggcatggtggcacgtgcctgtaatcccagctactcgggaggctgaggcaggagaattgcttgaacccagggggcggaggttgcagtgagccga

SEQ ID NO: 146585 - DNA, 601 bp, Human
ctcagcctcccaagtagctggaactacaggcgccccgccaccacgcccagctgattttttttgtgtgttttttagtagagacagggtttcaccatgttagccaggatggtctcgatctcctgacctcgtgatccacccgccttggcctcccaaagtgctaggattacgcgtgagccaccacacccgaccaactctatgcaatttttatgtcaatacagtaatatgccactgaaaatttcccctatagtttagtaagcattaatagggctgggattcaagagcagcaggacattttacacayacacacacacaatgtggtcacttggtattcatgaaggattggttcaaggatccctgaggataccaaaatccacccaggctcaagtcgcttatatagaatggcataatatttgcatataacctatgcacatgtgtgctttaaatcattcatctctagattacttgtaatatttaatgcaatgtaaatctatataaatacttatactgtattcttagggaataataacaagaaaaaaaagtctgtttatcttcagtacagacacaatcatccattttctttcccaaatgttttttatctgct

SEQ ID NO: 146586 - DNA, 601 bp, Human
tcattccacccctaggaagctacccaagaaaaatgaaaacaaatgtccacagaaagacccatatttgaatgttcctagcagctctgtttataaaggtgaaaggctggaaacagtccaaacacccatcagctggtacagggagaaccaaaatgtgatgtatctacccaatggagtattattcaccaatcaaactatggacacttgcttcaatacggatgcaactcaaatacataatgttaagtggaaaaaaacagttgcacaagactatatgctgtatggttcaatttatgtgaaatataakaggcaaattatagagacagaaaacagaccagtggttgtttatagctggcagtggagcagagattagctacaagtaagtacaaggagatggaaatgttctaaaaaccaaattgtggtgatggttgcacaactctataaatttactaaaaaatcattaaattataaaaaaattatttaactaaaactcttattgaaagctaaaattacacagtagtaaagatggattaggagtctaagatagtattataatcaacttaatgttaattgctccaagatttaatgatcgtaaataatatgtttc

SEQ ID NO: 146587 - DNA, 601 bp, Human
gaagacaaggctgggcatggtagctcacacttgtaatgccagcactttgggaggctgaggcggatgaatcccctgtggtcaggagtttgagaccagtctggccaacacagtgaaaccctgtctctactaaaaacacaaatattagccaggcatggtggcaggcacctgtaatcccagctactagggaggctgagtcacgagaatcacttgaacccggaggtggaggttgcagttagccaagattgcaccactgcgctccaacctgggtgacagagcgagaccctgtctgggaaaaaaaaaagagagagagtgagaaagagagaaagaaaatgaaggcaagtcacagactaggagaaaatatctgcaaattgtgtatctgataaagaacttgtatccagaatatataaataatgctaaaaactgagtaataaggaaacaatccatgaaaaaaaacaaggatttgaatagacacttcatcaaagagatctacaaattataataagcacatgaaaacatgttcaataccattagccattagaaaaatgagaattaaaatcatcatgagataccactaggatggcaatacatgtgactgaggatg

SEQ ID NO: 146588 - DNA, 601 bp, Human
aagagacgtttggcacaatcatgcaaaaattaagagagtgaactttgggaggccaaggtgggtgaatcacttgaggccaggagttcaagaccagcctggccaacatggtgaaaccccgtctctaccaaatatacaaaaattagccaggcatggtggcacatgcctgtaatcccagctacttgcgtgaccgaagcacaagattgcttgaacctgggaggcaggggttgcagtgagctgagatggcatcactgcactccagcctgagcaacagagtgagaatcagtctcaaaaaaaaaaaaaagtagattgaaagttctacagttatacaattctttaaagaagtaaaatacagtattaacacccaactaatttcttcccactctaggcactccttaaccacacccacaaactagaaattggcaaccatgaaataaaaatgaattgaacaaatgaatccattaacaaaataaacaatataaaatttcaagtaagccctctttcctggattaaaaagcaactgttaactttagtttttacagataaaacacaaatgtatcaagggagaccccccacttatataaacttgggactagcaaatatg

SEQ ID NO: 146589 - DNA, 601 bp, Human
caaaaaaagaaaggaacacacaaaagagctcatcattagttactccacaagcagcagctcatcattagttactccacaagaacaatgacctaaagcacgtattcataaatactagtacatttgactttcatatgatgaaatcagacaaaattctttcatcactgaatcacttgtagggagtagaagacaatggtgccacataacttttatgaagtactttctcttttcatcatgtgatgacagcaagttcttatccatacacacccaatcttaaagtctttcgctttcaacttaagttgartgcaggtgtgtcaaaatgcttcatgtttgacacatctgacaatactacaggtgaactgaaccaggcagtaaacagttttttactgaaacagtgactcgatgttttggatactctacatagatttttaaatgacaattttttttaatacgtaataaaaagaagaagcaaagataaaagtttttttctaaagaaaagatactgagatgtgttagagatgtggcttcctcctggtatgaaagataccatcaaaaatacctgaaaagaataggcattatctatgtcatttcaatgaagtgtgtg

SEQ ID NO: 146590 - DNA, 601 bp, Human
atgttcttgatgtgttatttttaatgtacaaagaaaaaaatatttcactcaggtctggcacagaagcttagatctctgagtcattttaactacagctgaaacgacaaaaacaatttacctgagctcacctttggtcatttcctgttacctccaacttgactaattcccttagccatttacaaaaaaagaaaggaacacacaaaagagctcatcattagttactccacaagcagcagctcatcattagttactccacaagaacaatgacctaaagcacgtattcataaatactagtacattygactttcatatgatgaaatcagacaaaattctttcatcactgaatcacttgtagggagtagaagacaatggtgccacataacttttatgaagtactttctcttttcatcatgtgatgacagcaagttcttatccatacacacccaatcttaaagtctttcgctttcaacttaagttgagtgcaggtgtgtcaaaatgcttcatgtttgacacatctgacaatactacaggtgaactgaaccaggcagtaaacagttttttactgaaacagtgactcgatgttttggatactctacataga

SEQ ID NO: 146591 - DNA, 601 bp, Human
aatacttaaaagtatctgctttatacggtcagcatgagatttatatgtttctttttctaactgctttatgtctgaaaaaaatttatcttgtcaactaattcactttattaacataatctaatcatatacagcaaaggagaaaaaaatgtgaatataccattttttcttttctttttctttttcttttttttttgagatggagtttcactcttggtgcccaggctagactgcaatggcgcattccaggtcactgcaacctctggctcctgggttcaaccaattctcctgcctcagcctcccragtagctgggattacaggcatgcaccaccacgcctagctaattttgtacttttagtagagacggggtttcaccatgttggtcaggctggtctctaactcctgacctcaggtgatccacccgcctagcttaccacgttgttatacattacattagaagactgggaaatgaagtataattgggtaaagcttataggtgttttgtattctccaaggtaaaaataaatgttcttgatgtgttatttttaatgtacaaagaaaaaaatatttcactcaggtctggcacagaagcttagatctctg

SEQ ID NO: 146592 - DNA, 601 bp, Human
ttgagaccagcctgggcaacagaccccatctctacaaaaaataaaaaaactcaaccaaacaaagattagctttagctgggcgtggtggtgcatgcctgtagttccagctacttgggaggctgaggtgggaggattgcctgagcccaggaggtcaaggctacagtgagccgtgatggcaccactgcactacagcatgggtaacaagtgagaccctgtgtaaaaacaaaaaattaataataaaacagtaaaaaaaaaaaaaaaatcagtagatgtctttttcttacagtacaaaggaaacacytgatactgttaaagtaaacaatatttttggtaaacatgtctttttgtttcaaaatgggaatctagaccttaatacttagaatgagaaatgtcactacaaagaaaatgactcaggagaaaaatgttactgtatgcctctcccactcaggtttttaaaaaaagctagcttgaagctttaagttaggcaaacatatgagaaaaatcaagtgaactagttctatatgaacttctttatatagggcactttttagagagtaatttttgttatgatttcaaacttacagtgtaccatttctaatat

SEQ ID NO: 146593 - DNA, 601 bp, Human
tgggaggtcaaggtgggaggatcgcttgagcccaggaatttgagaccagcctgggcaacagaccccatctctacaaaaaataaaaaaactcaaccaaacaaagattagctttagctgggcgtggtggtgcatgcctgtagttccagctacttgggaggctgaggtgggaggattgcctgagcccaggaggtcaaggctacagtgagccgtgatggcaccactgcactacagcatgggtaacaagtgagaccctgtgtaaaaacaaaaaattaataataaaacagtaaaaaaaaaaaaaaaatcagtagatgtctttttcttacagtacaaaggaaacacctgatactgttaaagtaaacaatatttttggtaaacatgtctttttgtttcaaaatgggaatctagaccttaatacttagaatgagaaatgtcactacaaagaaaatgactcaggagaaaaatgttactgtatgcctctcccactcaggtttttaaaaaaagctagcttgaagctttaagttaggcaaacatatgagaaaaatcaagtgaactagttctatatgaacttctttatatagggcactttttagagagtaatttt

SEQ ID NO: 146594 - DNA, 601 bp, Human
ctctggtttagaagctggggccacttttaatttttaacataaaagcatcactaactaaatttaagtaactaaggaaagaatctaagactgtcatatccctcaacagaacagtttaaggttttaaatatattattttgtcactgcctacatatgtccaaatatctcaccggcatttatgtattttgtttattttctgacttgcctcaataacacaattttaaacagagggattcttagaatagggcagcagaaacttcaaaccgaagtttctctcttatttgttactctgtccccagtgccyagcatggtacctgacatatacagtaattagataataaatattctcatagctggcataatattgttgctggtagaattatactgtcaaaattaatgtttttggaatgctttctgatagctagccctaccatggagaataactctacccgtaaagactgttttggttattaaaacaacaaagtaaaaaatgtttccagataagccaaatgtatatgctatccttaattcatggtaccataaataacaacaaagtatgaaggacattttagcaatatcaaaaccaataaaagaaaacaggcca

SEQ ID NO: 146595 - DNA, 601 bp, Human
aggttacttggttaagtaccaaataagatagcttatttttataccatgcttgcttaatgaaggtatacttccatgacaagtaggtttcttgacaagaaaatctaacaattttagtaactcaactaaacattaacacacagaaaatgtagttgatcactgacgtttaatttagaaaatgtctatctttagaaagagctaaattttgcgtgcttattatgtgccaggcactgtgctagaaagattcatgtgccttatcccatttagtcctaagaggtaggtactattattagcacacctattycacagaggggaagtggagctttgattttgtatcttacccagctaggaaatgttaaatctattctttgaactgaggactatgtcagagctcaagaaagattctaattccattcctgttcaaaacagtggtctccaggtaaaatagatcttgattaacttaaaaatctccagaatattaaagttatattacagcacaaacttcataaacagtgactgaattttgctttcagccttctcttgaatatgcctaaataattccagaccttgaactttcctaaacctttaatcatttatggtgctc

SEQ ID NO: 146596 - DNA, 601 bp, Human
ggtggctcatgcctgtattttgggaggctgaagtgggcatatcacttgaggccaggagttcgagaccagcctgggcaacacgatgaaaccccatctttactaaaaatacaaaaattagccaggcatggtggtgcacgacctatatattcccagctacttgggaggctgaagcatgagaattgcttgaaccagggaggcagaggctgcagtaagctgagactgcactattgcactccagcctgggcaacagggtgagagactgtctcaaaaataaataaataaataaaacaaacaaaaaaamaaaaaaatgaagtagaactttggttgaaagctttgtcttttaactaaggaatcaaaacagtaaactgcagttccagtttcctgtgctgggtctaaggaagggatggcaggcaccacgtccagcttcctgacaggcacctacggcaagaagcccctgacgagaaacaggccaaggagatgtatgaggaagacaaggatttcaagcagaaacaagaagaggagcagaaaaaacttgaggagctaaaagcaaaggccacagggaagggttccctggataggtggaattaagaaatccggcaaa

SEQ ID NO: 146597 - DNA, 601 bp, Human
gcgcggtggctcatgcctgtattttgggaggctgaagtgggcatatcacttgaggccaggagttcgagaccagcctgggcaacacgatgaaaccccatctttactaaaaatacaaaaattagccaggcatggtggtgcacgacctatatattcccagctacttgggaggctgaagcatgagaattgcttgaaccagggaggcagaggctgcagtaagctgagactgcactattgcactccagcctgggcaacagggtgagagactgtctcaaaaataaataaataaataaaacaaacaaamaaaaaaaaaaatgaagtagaactttggttgaaagctttgtcttttaactaaggaatcaaaacagtaaactgcagttccagtttcctgtgctgggtctaaggaagggatggcaggcaccacgtccagcttcctgacaggcacctacggcaagaagcccctgacgagaaacaggccaaggagatgtatgaggaagacaaggatttcaagcagaaacaagaagaggagcagaaaaaacttgaggagctaaaagcaaaggccacagggaagggttccctggataggtggaattaagaaatccgg

SEQ ID NO: 146598 - DNA, 601 bp, Human
tttcctgaggcctccccagctatgcaatactgtgagtcaattaaacttctttcctttacaaattacccagtctcgggtagtaaatttatagcagtgtgaaaatggagtaagacaggaggaaacaggaaacgattattgctaagtaagaatgatgaagtggtcaatatctaggatgtattttttgagtgtgaccgggtctcactctgttacctaggctggagtgcagtggcacgaccacggcttaatgtagcctcaaccacttgggctcaagtgatccttctacctcagcctcctaagtagytgggactactagtccatgccaccatgcccagataattaaaaaacaaaaaacaaacaaaaaaaaacaacgtttaagtctccctatgtttcccaggctggtcttgaacacctgggctcaagtgatcttcccacctctgcctcccaaagggctaaaattataggcatgagccaccacgcccagcctatcatttgttttaactggaaataagagtaattacagtttgtaagaaaatgcagtagaataaactatatcagagaaaacacagagtgaaagtgcctaccataccgcctgaacatcgat

SEQ ID NO: 146599 - DNA, 601 bp, Human
agtgatcctcctgctttggccttccaaagtgctggcattacaggagatagccactgtacctggcccctccatactgtttgtttccatatttattactgtggtaaaatatacataatataaaattattttaagcatgtttaagtgtacagagttctgtggcattaagtaaatccatattgttatgcaaacatcaccaccatcaatctctggaataaccacatttaaaataatatagtctataagaatataagtaaggagttttttttttttttttttttttttgctctgttgttgccaggcrggagtgcagtggcatgatctcagctcactgcaacttccacctcgtgggttcaagaaattctgtctcagctttcccagtagctgggactacaggcatgcaccaccatgcccagctaattttttgtgttttcagtagagacggggtttcgccatgttgccagtctggtctcgaactcctgacctcaagtaatccacctgcctcggcctcctaaactgctggggttacaggcatgagccactgtgcccggccaagaaaataagaaattttctttttagttctgggatacacgtgcaaaaaaac

SEQ ID NO: 146600 - DNA, 601 bp, Human
ggatttccaagcagctatcaatatgttcaaattaaaggaaaccatgcttaaagaactgaaagacagcatgatgacaatgattcaaggaatagagaatctcaacaaaaagattatttaaaaaacactgaattggacctctacagctgaaaagtataatagctgaaatgaaaaattaactgaaggggatcaacagtggattcaaactggcagacaaaagcatcagcaaacttgaagacacatcaagaaactgtccattctgaaaagcagaaagaaagaaaaaaataagaatgaacagagcatyagggacctgtaggatactaacaagcatatcaacacacatgtaatgggagtcccacgatgagagaaagaaacaataaataatggctgaaaacttaaaaaaatttgactaaacccttaatctatacatccaagaagctcaatgaactctaagtaggataaacacaaagagattcccacccaataaacatcacagtaaaaagccaaagaaaagcaaaatcttgaatacagtggcaagagaaatctactcatcactacaggggacccataataagattaacagctgacttctcaccagaaacaa

SEQ ID NO: 146601 - DNA, 601 bp, Human
gctggggcgaacttgtaaactgcctgaactttgacttgttccccaacctgcactggcaaaaagcagaagctggtcaggtgcagtggctcacgtctgtaatcctagtactttgggaggccaaggtgggaggactgcttgaggccaggagttcaagaccaacctggccaacagaacaagatcctgtctcttaaaaaaagaaaaaggctgaagcctcactggctcaagtagctacgcataacctttgaccagtcatttctgaccactgagataagctgacaaactgactcagggtgacccttaraaaacctggcttaaaaaaaaaaaattgatccgtgctatcaccacctcatactacagacttaatgtgggcaagtccctaaaaaaaataaatagcaaccaccacctcccctttggggaggggcaggaggcaatctaactcagagtctctacaacgtattatctaaaatgttcagtttaacaaaaaattatgagacatgcaaagaaactggaaagtgtgagccatagacaggaggataaaaagtcagaaaatgtctctggggtggttcagctgttcagctgtccaggatttccaagcagctat

SEQ ID NO: 146602 - DNA, 601 bp, Human
ggctaagagaagctgcaacttgccatcaaaagtttcaatacataatcagcttagcacaatttaaaatattttctggctactatatcttctttaactgttaggtataataagtggttgaggtagagctggagagcagaatattctggttcttttcctcataatttaaaattgatttctaagtactttggccacctttctctccaccttccaataccttcccctctactctgagttgcagagtttgtaagaaaaggatatcattccagatcctttatctctagccctcaaatcttacttggargcatggtaagattttaaaccatgatatctataaatattgattatggcagctcattagccattaaaatgatgttacttagaatgctaataagtgtacaacataaaaggcattaagaatctaccatgaggccaggtgcggtggctcacgcctgtaatctcagcactttgggaggccgaggcaggcggatcgatcacctaaagtcaagagctcgagaccagcctggctaacatggtgaagccccacctctactaaaaatacaaaaattagccaggcatggtggtgagcgcctgtaatccagct

SEQ ID NO: 146603 - DNA, 601 bp, Human
cacatgagtgatacatatattaataaactcttccagtcagagtgattagctataacagcaactagacatcatgacattaaacactatacacacgcatatgctttaaatttgcagattgacagtagtgccattacaatactttactcctttcataaagctccacaaagaatgtttattgttctaacagtctgacagtactcaaatcacttaacataaaaatctttttattagaaatggaaagtaactctttgtctaagaatcccctaaataaaccatggctaagagaagctgcaacttgccrtcaaaagtttcaatacataatcagcttagcacaatttaaaatattttctggctactatatcttctttaactgttaggtataataagtggttgaggtagagctggagagcagaatattctggttcttttcctcataatttaaaattgatttctaagtactttggccacctttctctccaccttccaataccttcccctctactctgagttgcagagtttgtaagaaaaggatatcattccagatcctttatctctagccctcaaatcttacttggaagcatggtaagattttaaaccatga

SEQ ID NO: 146604 - DNA, 601 bp, Human
tgtttaataagtctaaattctctaacacatgagtgatacatatattaataaactcttccagtcagagtgattagctataacagcaactagacatcatgacattaaacactatacacacgcatatgctttaaatttgcagattgacagtagtgccattacaatactttactcctttcataaagctccacaaagaatgtttattgttctaacagtctgacagtactcaaatcacttaacataaaaatctttttattagaaatggaaagtaactctttgtctaagaatcccctaaataaaccayggctaagagaagctgcaacttgccatcaaaagtttcaatacataatcagcttagcacaatttaaaatattttctggctactatatcttctttaactgttaggtataataagtggttgaggtagagctggagagcagaatattctggttcttttcctcataatttaaaattgatttctaagtactttggccacctttctctccaccttccaataccttcccctctactctgagttgcagagtttgtaagaaaaggatatcattccagatcctttatctctagccctcaaatcttacttgga

SEQ ID NO: 146605 - DNA, 601 bp, Human
aaaaaaaaaaattagctgggtatggtggcacatgcctgtagtgggaagataaggtgtcaggatggcttcagccttcgaggctgaggctgcatgagctgtgatcacatcactcactgtatttcagcctgggtgacagagggagacggtctcaaaaaaaaggggggcattttggtgaatacattatccattactctattaaatacacataacttttgaatgaacaatttcaatgggaattaatcctacaaatatttccacacatacaaaaatattttagcattgtaatagacacaaaaaaaamccccaaaaaagaccagaaacaataaatcttacattacaagcttatattacacagctttttacaaaatataactcagccataggttaatcagaaaagctgtctagaatgtatgacatgtaaaaagtttcaggctgggtgcggtggcttatgcctataatcccagcactttgggaggctgaggcgggtggatcacttgaggtcaggagttcaagaccagcctggccaatacagtgaaaccccatctctactaaaaatacaaacattagccgggtgaggtggcacgagcctgtaattcctgct

SEQ ID NO: 146606 - DNA, 601 bp, Human
tctgggtacggaagtctataaagttaatctctgaaacaacatatcaagcttacaggtacaatgttgagagaagagtgccaattcagctcattttaccttccattttcccttttgaacttttgacacaatcatgattatatctgattcactctaacagaaaggggaggggtgagggggaaaagtactttcccttctatgattagctaatagtttgatagtttatatacttaaatttagaggaccatgattagcttaagaaagttcctttagttttcttaactggttatgatttctctttttscatgaggactgctttagagtttaaagtcacatcaagaaattcaaacatcacttgcccattacatatgcagtggttaacttagcctgttaaacgtcttcctcatcattacaaggatttgtaattcaatgtaactgattaaaataactaagtgcaaaatgtgggttttttttttttgttgttgttgttgtttaaggtactgaactatcactgctgaaactcctgtgattggtcactttcaatttatttaactttcataaaatgattgaagggcggagaggttttttacctacagcttcagga

SEQ ID NO: 146607 - DNA, 601 bp, Human
ttgtataccttacagctcagaattttcaacagatgctattgggcataacagtgtataggtttcaagcatgaaaccaaatctcacaagagatttaaaagcacttgaattttctttcccaggtaaccacaacatttgttcattgtataaatgactaaggaaaaaattgcacctaacaagactcttattatactaaaagtcaagcttatatttaaagatgctggcttgttgtacagagggtattctcattccccacagggaataaaattaggtcccctggagagtagaataattcccagaaagmaagcactggattatttctctctaatttcacctattggctttttaaccaagttcacccttccgcattaaaatattaagtctttgtaaatgccttaaagataaaaaggcctttacagagttgagtgttttctgcaggtgagattttacattctgaattccctcctctcaaattactttacaaaggggattaactgctctctttattcaaatacgttaagatcaagcttgcgaaaagagtcccctaagaattttcatacttctgggtacggaagtctataaagttaatctctgaaacaacata

SEQ ID NO: 146608 - DNA, 601 bp, Human
ggcctcccaaaatgctacgcttacaggcctgagccactgcctggcccactagttctttaaaagtatttacacaagaacacaacttttaaatgtacctttgcatgcatgcttttggatgtcattctgcctgaggatatttacataaatgtaggtcattttcttattatttcagtgagctttaaaaatgtcaactaagcaggggtgaaaaaaggctagctcttgactattctccagcttagctagtacctcagcaaacagtcctcataggggaaatataccttaccttttaatttttaaaatyttattttcttggtgctcattcatcatagcaaaaccctaacctatgtctcaatgcctatcacactgcccgttgatgtagaagttctttttcttctcccagagacagggtctcactccattgcccaggctggatttaaactcctaggctccagcaatcctctcgccttggcctcccgggtagctgggactgcagggtcataccactgtgctggctcacttaactactttttttgatttatttttttgaggcagaatctcgctctgtcgcccaggctgtagtgcagtggcgtgatctcggctc

SEQ ID NO: 146609 - DNA, 601 bp, Human
atacaggtgtactatttaaaaaatcttccatgctttaaaaaaaaaaaagtcttccacgctgtattttttaccatatcttttatatgtttagatgcacaaatgcttcccactatgttacaactgcctgtagtattaagtacagtaacatgttggataggcttgtagtctaggagtaataggctgtaccatatagcctaggtgtgtagtaggctacaccacctgggtttgtgtgagtatactcatatgatgtttgcacaaacaatgaaatcacctaaggatgcatttcttagaatgtattctmatcattaagtgccatatgactacaccacattgtttgaattactatagccttaagatatgttttgggtcaggcacagtggctcacacctgtaatcccagcactttgggaggccgaggagggcggatcacctgaggtcaggagttcgagaccagcctggccaacatgatgaaaccccatctctactaaaaatataaaaaaaattagccgagtgtggtggtgggtgcctgtaatcccagctactcgggaggctgaggcaggagaattgcttgaaccccggagatggaggttgcagtgagccga

SEQ ID NO: 146610 - DNA, 601 bp, Human
agcattctcagatctcacccccatgttaacatctgtttagttgagagttaaaatctgcagggaccttctataactgagaaacaaaggaatgctaaccattacgttccagtagaatggctatctggtgggcagggaaaaatatctgtatctacacaattattatttaaaaaaagaattctggaaccactgtgttaaataaatgaccaccattaattcagggtagaatttagcatgaaacttaagaaaaggatagctcaaggatgtcagttaaagaaagaaggaaaatgataaaaaatgtaasaatatatatataattaaatatatataaatttcatatataatgggaatttaagaaaaggatagctatgcattatcctctgtagagatacactcttcctaacatattcaaactagtcattcaaatggatggggaggtggtaggcaacaggattaatgatctataaaaatcataaatggctcatccagctaagattctcttctacatcaaattatttttgctgaagcagtctgaaaacacctaactggaattctaacaccaggttgggtgcggtagctcacatatgtaatcccagcacttcag

SEQ ID NO: 146611 - DNA, 601 bp, Human
ggcacacgcaacattccaggcgagagcgggtttggaacgcgcagacacgccacattccacactggctaaagcggggcgcagcgaggggggcccgggggctgacccccagcgacccgcgggccatttcgcaaacgcccaattagcccggctttcacccaaaccccggacgcgcagcccagcccagctctgggaggcggggtcaggcggggctggccaggatcataagacacgcgatgtcatttcattctgcaaaggccgcctccgccccaagcggcgcgtagatctgccgggagcgcccccygcaccctccccacggggccagggaagccgaagagctgctccgcgtagagtagtccccacccccactccgttacacacacgcccactcgtgtgctatacacacgcccgtgtacacgtccgttcatctgctcttcccgaggctcacatcacacatcccccgtgcacacacgcacgcacacgcgagcctgccacccccacgcaacaccattcctcaccccaccccccggctcacacatcctcagtgccaccgagggctccgctggcccacgcaaaagcagcccaccacagaaggggcacaggg

SEQ ID NO: 146612 - DNA, 601 bp, Human
ggtcaccaggggcactctccactgccagaccctgctctggaccatcaaggcaacagccggggagtgtgggcgatgtccccgcccatcacttctgcaaaacccaggcatctgagcctcacatatctccagtgactcttgaccttgagaggccggtcgccccgactaggccgccggccccgcagctcccccgccccttgcccgctgccgctccccccttcccccacccccgcccgccgcggcggcggcacacggcggcgcgcgcgcacacaacacactactacctcctgcatgactcatcatygaagcaacaataggcagagagaaaggaaaggagggcgaagcactctccaacacaaccaaccctgccgggggattctggggggcggggagggcacaggagtccccgggtcctgcacacacaccgttccagagccgaggccctggcagcaccctggaaaagggaggtctttcccgccagcccctctgcagcaccctgaagccagggaccaccaacagggcgcgtgaagataggagtcattagtctcttccctttcgagggagcgccgaagtttgccctttctcatcctggctcattccagcg

SEQ ID NO: 146613 - DNA, 601 bp, Human
tgtggaaacagcccagcactcttgactccgaggctaggtcccaatgcctgttttcctcagggaccattcaacaaacacacttcgtccctctctgacccttctcgtgttataactcattttccccaaatccccaacatccccaccaccagcagcagcgccagcatgtcctgtccttcaggcctaaagcatcctctgacatcctcagtgacaccccgctcagcctgagacaatacaaatacccaaccactccagccaggcaccggggaaagtgcacctgcctggttctgggtgagagagggcrgttgaggaggaggaggtacagcagcgaccatttctcccaaacaagaaggggctgggctcttcaatgggggctgagcagggcagtgcaccccaccacccgctcagcatccctgctgaaagcccagcaggaaggcaaggcccactcaggagctggctgccaacaggggaaggggaggcacctccatctcccgcttgcctcgtcctctcccaggcgccaccattctggttccctggctacggggctggcccaggcccttggagtctgcagactccaggccagggagccgccgggacaagcagc

SEQ ID NO: 146614 - DNA, 601 bp, Human
caggcacgggggaaagtgccgggggcacagcagtgaacaaatcaagcagacctgttccccgccaccagggaatagtaggacggtcacgggggctgacagtcacgggggctgacagtccgggctgcgggcaggacaggcggccctggaaaggtggagcagagctgtcagagggtgctgcaggccacctgccagcctgcagggtgaggaggaaggcgggtgagggcagcgagggtcaggggaccacagggccgaggtgggagaggcgggcagaggcccagccacccaagacttcacaccagaggggggggtgtgctgacagatcccagcttccgtggaaggcctttaacaatgtttaccaagcactttctagagggcaggcagtgcctgcatggcacagatgaagtcagtgaagctcagggagcaaagtgattcgctgcaggtcccacagcaagcctcctgacccctggaggacgcttgccgtgctcacaaggaagtgctgacagtccctggatcctcacaagagccccacgtcacatcatgggcaggacagggacatcaccctcatttcacacatgtggaaacagcccagcactcttgactc

SEQ ID NO: 146615 - DNA, 601 bp, Human
ccagcctggccaggctattggccttcttctgttcctgctctcgctcctgctccaagcgaagccgctcctgctcctctacacagagagaacacaagggggggagggtctcagcggggccccagaactccagccctaactcgtcctctgaccctagcccagtcagtactcagtgacacccctgctcagcgagagacaccacaaatagcctaccagcccagccaggcacgggggaaagtgccgggggcacagcagtgaacaaatcaagcagacctgttccccgccaccagggaatagtaggacrgtcacgggggctgacagtcacgggggctgacagtccgggctgcgggcaggacaggcggccctggaaaggtggagcagagctgtcagagggtgctgcaggccacctgccagcctgcagggtgaggaggaaggcgggtgagggcagcgagggtcaggggaccacagggccgaggtgggagaggcgggcagaggcccagccacccaagacttcacaccagaggggggggtgtgctgacagatcccagcttccgtggaaggcctttaacaatgtttaccaagcactttctagagggcaggcagt

SEQ ID NO: 146616 - DNA, 601 bp, Human
gacacatctgtgctcataatcacaactcctgtcaccctccgtcccaccaggagggagacaggaggactcctgggactcagaggcagccggttgaccccagccctcacccaagaggcccatactctgtccagaggcctgggaatgccataagcctcagccttggactgcgttaggaaacacagaagcctgggaacggggggcaatgggacattccttcccaggatagacatgggcacagtgatgacgtgttcaaatacagggggcacttctaagctggggagggcaccttgtcttgcacacrgcccgggggatgggcacctctcctatcccccaccagcccgaccccgccacaccccactcaccccccgggcctcttcttctgttcactggatttgacttcttcagctggtgccaacttcagggtccccagcgtgggtgggggcggctgctggggggccagctgaggctggactccagggtgtggcgctatggtcaggacaggcgtggggaggggctgcaaaggcttggggctgccattgggtggaatggtggccttcgagtccggcagtaggggagcaggggtgggcacctgcggcctgct

SEQ ID NO: 146617 - DNA, 601 bp, Human
tttccaaacccacacgttacgcaaggcgccctctgcaagtagtatctgcaaagaggaactcgccatgccgtccttcctatttctcaaaaataatagctaagcaaatgtcgggagtgcagcgaagtgtctgcatgaacaccctcagccagccctgcgactaaactacaaccaagcccaggttctgcaaaacgattccagaaataagccaccggcctgccgcggcctccggagccctctcccgctcggcgccccgaggccccaccccgaagcacgcgcgcacccacgcggccgcggcttcccygcgtcaccctcgccggctgcaccgccctccgcgactcgagagcaccgcccccgcccgctgcagccaatccgcgagcccggccccgcccctcccggctgcccggaagcggcctggaggcgcgccagccccgccccctggccgggagggcgggcggaagggcgcgttggcgggaggctgggagagagctgcccccctggagcagtcgcgaagcagcgcctcagcccctccctcagcaagtcaggctccggttacctcagggctgtgaccccgcggtcgaggccgggggaggggcggcgccca

SEQ ID NO: 146618 - DNA, 601 bp, Human
gcaggtctcagctcaaaggtcctttcctcaggaacagctatcctccctccccagaacagatcccgccgcccggtccctattatgcccatacggccgccttctgtagaatgacttgttcgtcatctgccacaagacccaggcttttttacttgctcgccaccattcgcccagaagcagagacttcgctaaaagcacctcaatgaataaatgaataaatggtttgtagacaggcctttgaggttcctgcttctgtgaccagcaccagaatgggtgtcccttctgcacagcctgagtgaggacyaccccggctcctacttcaccgggcccagctcctcaagagcttccttctgcggctgctgctgagtcttcttccgattcatttccaaacccacacgttacgcaaggcgccctctgcaagtagtatctgcaaagaggaactcgccatgccgtccttcctatttctcaaaaataatagctaagcaaatgtcgggagtgcagcgaagtgtctgcatgaacaccctcagccagccctgcgactaaactacaaccaagcccaggttctgcaaaacgattccagaaataagccaccggcctgccgcgg

SEQ ID NO: 146619 - DNA, 601 bp, Human
ctgcaggtctcagctcaaaggtcctttcctcaggaacagctatcctccctccccagaacagatcccgccgcccggtccctattatgcccatacggccgccttctgtagaatgacttgttcgtcatctgccacaagacccaggcttttttacttgctcgccaccattcgcccagaagcagagacttcgctaaaagcacctcaatgaataaatgaataaatggtttgtagacaggcctttgaggttcctgcttctgtgaccagcaccagaatgggtgtcccttctgcacagcctgagtgaggmccaccccggctcctacttcaccgggcccagctcctcaagagcttccttctgcggctgctgctgagtcttcttccgattcatttccaaacccacacgttacgcaaggcgccctctgcaagtagtatctgcaaagaggaactcgccatgccgtccttcctatttctcaaaaataatagctaagcaaatgtcgggagtgcagcgaagtgtctgcatgaacaccctcagccagccctgcgactaaactacaaccaagcccaggttctgcaaaacgattccagaaataagccaccggcctgccgc

SEQ ID NO: 146620 - DNA, 601 bp, Human
ttgttcttagagacggaggtcgcactctgtggcccaggctgtcctcgaactccctgggctcaagcgctcttactgccttggcctcccgagtagcgtagctgggactcaggtgcaagccaccgtgcctcacttttatttccaaaaagcatcctgttccctcctgctggagaaactgggctgcccctgggctcttggcctccactttgctccgtgccacccagacttatcctgcaggtctcagctcaaaggtcctttcctcaggaacagctatcctccctccccagaacagatcccgccgccyggtccctattatgcccatacggccgccttctgtagaatgacttgttcgtcatctgccacaagacccaggcttttttacttgctcgccaccattcgcccagaagcagagacttcgctaaaagcacctcaatgaataaatgaataaatggtttgtagacaggcctttgaggttcctgcttctgtgaccagcaccagaatgggtgtcccttctgcacagcctgagtgaggaccaccccggctcctacttcaccgggcccagctcctcaagagcttccttctgcggctgctgctgagtcttctt

SEQ ID NO: 146621 - DNA, 601 bp, Human
caaagtctccaaccccacccaccagtgaggccagcttcccacaccccctcctgcatacatttctgccctcaccagtgacagatgtctctaaccattagtgccggcaacacataacccaggtagaaccgtgctctgtactggcctgaaacctggcagcttgacacttctgttgccagtcccaggccacacacagccctccctcattctggctttaacagtttctccccattttctgctaggaagacagtaggaaactcccttgcccctacacacacacctgtgtggcttttctttttttggwgacagagtcccgctctgtcacccaggctggagtgcagtggcatgatctcggctcactgcaacctccgcctcccgggttcaagcgattctcctgcctcagcctcccgagtagctgggactacaggcatgtgccaccaggcaggactaatttttgtatttttagtagagacgggattttgccatgttggccaggatggtcttgaactcctgacctcaggtgatccacctgcctcggcctcccaaagtgctgggattacaggcgtgagccatcgcgcccagcctgtgtgtggcttttcacctg

SEQ ID NO: 146622 - DNA, 601 bp, Human
ccactgaagcaagctcaaccaggtgtgcaggtccttccctgtcctccacaattcatcctcaggggcttctccgcctctcgccccatccctcctccagcagcctcttcactttgcacacttctgccgcgagctaccctctaaggaacctgatcctgcgcttccacctcaccgttcacttgtctccctggtaacatcaacatccttgcacgatgagccactaggcagtgacacgccctcgccccatctcatctccaggactcgcctccctcctggctgctggtctgcacctgctccccgaccycctaggcgactctccactgtgcccgcctgtgacgcttctcgacgaggctccatttacatgctgctccccatcaccctgcccactcccctccagactccctgggctgaacaacccccaagcctaggaacgtgccccctgtacttgggctaaaccgatccatgagaaatggctgttgcgtcccatgacccagctcccctccacactcagtctttcccgtgctccaacccgacacttcatcaatcccaccctttcaagtctcacagacctccctgctggcagcttttcgcccaggcacgtcat

SEQ ID NO: 146623 - DNA, 601 bp, Human; identical to SEQ ID NO: 31605

SEQ ID NO: 146624 - DNA, 601 bp, Human; identical to SEQ ID NO: 31606

SEQ ID NO: 146625 - DNA, 601 bp, Human; identical to SEQ ID NO: 31607

SEQ ID NO: 146626 - DNA, 601 bp, Human; identical to SEQ ID NO: 31608

SEQ ID NO: 146627 - DNA, 601 bp, Human; identical to SEQ ID NO: 31609

SEQ ID NO: 146628 - DNA, 601 bp, Human; identical to SEQ ID NO: 31610

SEQ ID NO: 146629 - DNA, 601 bp, Human; identical to SEQ ID NO: 31611

SEQ ID NO: 146630 - DNA, 601 bp, Human; identical to SEQ ID NO: 31612

SEQ ID NO: 146631 - DNA, 601 bp, Human; identical to SEQ ID NO: 31613

SEQ ID NO: 146632 - DNA, 601 bp, Human; identical to SEQ ID NO: 31614

SEQ ID NO: 146633 - DNA, 601 bp, Human; identical to SEQ ID NO: 31615

SEQ ID NO: 146634 - DNA, 601 bp, Human; identical to SEQ ID NO: 31616

SEQ ID NO: 146635 - DNA, 601 bp, Human; identical to SEQ ID NO: 31617

SEQ ID NO: 146636 - DNA, 601 bp, Human; identical to SEQ ID NO: 31618

SEQ ID NO: 146637 - DNA, 601 bp, Human; identical to SEQ ID NO: 31619

SEQ ID NO: 146638 - DNA, 601 bp, Human; identical to SEQ ID NO: 31620

SEQ ID NO: 146639 - DNA, 601 bp, Human; identical to SEQ ID NO: 31621

SEQ ID NO: 146640 - DNA, 601 bp, Human; identical to SEQ ID NO: 31622

SEQ ID NO: 146641 - DNA, 601 bp, Human; identical to SEQ ID NO: 31623

SEQ ID NO: 146642 - DNA, 601 bp, Human; identical to SEQ ID NO: 31624

SEQ ID NO: 146643 - DNA, 601 bp, Human; identical to SEQ ID NO: 31625

SEQ ID NO: 146644 - DNA, 601 bp, Human; identical to SEQ ID NO: 31626

SEQ ID NO: 146645 - DNA, 601 bp, Human; identical to SEQ ID NO: 31627

SEQ ID NO: 146646 - DNA, 601 bp, Human; identical to SEQ ID NO: 31628

SEQ ID NO: 146647 - DNA, 601 bp, Human; identical to SEQ ID NO: 31629

SEQ ID NO: 146648 - DNA, 601 bp, Human; identical to SEQ ID NO: 31630

SEQ ID NO: 146649 - DNA, 601 bp, Human; identical to SEQ ID NO: 31631

SEQ ID NO: 146650 - DNA, 601 bp, Human; identical to SEQ ID NO: 31632

SEQ ID NO: 146651 - DNA, 601 bp, Human; identical to SEQ ID NO: 31633

SEQ ID NO: 146652 - DNA, 601 bp, Human; identical to SEQ ID NO: 31634

SEQ ID NO: 146653 - DNA, 601 bp, Human; identical to SEQ ID NO: 31635

SEQ ID NO: 146654 - DNA, 601 bp, Human; identical to SEQ ID NO: 31636

SEQ ID NO: 146655 - DNA, 601 bp, Human; identical to SEQ ID NO: 31637

SEQ ID NO: 146656 - DNA, 601 bp, Human; identical to SEQ ID NO: 31638

SEQ ID NO: 146657 - DNA, 601 bp, Human; identical to SEQ ID NO: 31639

SEQ ID NO: 146658 - DNA, 601 bp, Human; identical to SEQ ID NO: 31640

SEQ ID NO: 146659 - DNA, 601 bp, Human; identical to SEQ ID NO: 31641

SEQ ID NO: 146660 - DNA, 601 bp, Human; identical to SEQ ID NO: 31642

SEQ ID NO: 146661 - DNA, 601 bp, Human; identical to SEQ ID NO: 31643

SEQ ID NO: 146662 - DNA, 601 bp, Human; identical to SEQ ID NO: 31644

SEQ ID NO: 146663 - DNA, 601 bp, Human; identical to SEQ ID NO: 31645

SEQ ID NO: 146664 - DNA, 601 bp, Human; identical to SEQ ID NO: 31646

SEQ ID NO: 146665 - DNA, 601 bp, Human; identical to SEQ ID NO: 31647

SEQ ID NO: 146666 - DNA, 601 bp, Human; identical to SEQ ID NO: 31648

SEQ ID NO: 146667 - DNA, 601 bp, Human; identical to SEQ ID NO: 31649

SEQ ID NO: 146668 - DNA, 601 bp, Human; identical to SEQ ID NO: 31650

SEQ ID NO: 146669 - DNA, 601 bp, Human; identical to SEQ ID NO: 31651

SEQ ID NO: 146670 - DNA, 601 bp, Human; identical to SEQ ID NO: 31652

SEQ ID NO: 146671 - DNA, 601 bp, Human; identical to SEQ ID NO: 31653

SEQ ID NO: 146672 - DNA, 601 bp, Human; identical to SEQ ID NO: 31654

SEQ ID NO: 146673 - DNA, 601 bp, Human; identical to SEQ ID NO: 31655

SEQ ID NO: 146674 - DNA, 601 bp, Human; identical to SEQ ID NO: 31656

SEQ ID NO: 146675 - DNA, 601 bp, Human; identical to SEQ ID NO: 31657

SEQ ID NO: 146676 - DNA, 601 bp, Human; identical to SEQ ID NO: 31658

SEQ ID NO: 146677 - DNA, 601 bp, Human; identical to SEQ ID NO: 31659

SEQ ID NO: 146678 - DNA, 601 bp, Human; identical to SEQ ID NO: 31660

SEQ ID NO: 146679 - DNA, 601 bp, Human; identical to SEQ ID NO: 31661

SEQ ID NO: 146680 - DNA, 601 bp, Human; identical to SEQ ID NO: 31662

SEQ ID NO: 146681 - DNA, 601 bp, Human; identical to SEQ ID NO: 31663

SEQ ID NO: 146682 - DNA, 601 bp, Human; identical to SEQ ID NO: 31664

SEQ ID NO: 146683 - DNA, 601 bp, Human; identical to SEQ ID NO: 31665

SEQ ID NO: 146684 - DNA, 601 bp, Human; identical to SEQ ID NO: 31666

SEQ ID NO: 146685 - DNA, 601 bp, Human; identical to SEQ ID NO: 31667

SEQ ID NO: 146686 - DNA, 601 bp, Human; identical to SEQ ID NO: 31668

SEQ ID NO: 146687 - DNA, 601 bp, Human; identical to SEQ ID NO: 31669

SEQ ID NO: 146688 - DNA, 601 bp, Human; identical to SEQ ID NO: 31670

SEQ ID NO: 146689 - DNA, 601 bp, Human; identical to SEQ ID NO: 31671

SEQ ID NO: 146690 - DNA, 601 bp, Human; identical to SEQ ID NO: 31672

SEQ ID NO: 146691 - DNA, 601 bp, Human; identical to SEQ ID NO: 31673

SEQ ID NO: 146692 - DNA, 601 bp, Human; identical to SEQ ID NO: 31674

SEQ ID NO: 146693 - DNA, 601 bp, Human; identical to SEQ ID NO: 31675

SEQ ID NO: 146694 - DNA, 601 bp, Human; identical to SEQ ID NO: 31676

SEQ ID NO: 146695 - DNA, 601 bp, Human; identical to SEQ ID NO: 31677

SEQ ID NO: 146696 - DNA, 601 bp, Human; identical to SEQ ID NO: 31678

SEQ ID NO: 146697 - DNA, 601 bp, Human; identical to SEQ ID NO: 31679

SEQ ID NO: 146698 - DNA, 601 bp, Human; identical to SEQ ID NO: 31680

SEQ ID NO: 146699 - DNA, 601 bp, Human; identical to SEQ ID NO: 31681

SEQ ID NO: 146700 - DNA, 601 bp, Human; identical to SEQ ID NO: 31682

SEQ ID NO: 146701 - DNA, 601 bp, Human; identical to SEQ ID NO: 31683

SEQ ID NO: 146702 - DNA, 601 bp, Human; identical to SEQ ID NO: 31684

SEQ ID NO: 146703 - DNA, 601 bp, Human; identical to SEQ ID NO: 31685

SEQ ID NO: 146704 - DNA, 601 bp, Human; identical to SEQ ID NO: 31686

SEQ ID NO: 146705 - DNA, 601 bp, Human; identical to SEQ ID NO: 31687

SEQ ID NO: 146706 - DNA, 601 bp, Human; identical to SEQ ID NO: 31688

SEQ ID NO: 146707 - DNA, 601 bp, Human; identical to SEQ ID NO: 31689

SEQ ID NO: 146708 - DNA, 601 bp, Human; identical to SEQ ID NO: 31690

SEQ ID NO: 146709 - DNA, 601 bp, Human; identical to SEQ ID NO: 31691

SEQ ID NO: 146710 - DNA, 601 bp, Human
gttacatttatgttaactgttatggttacataaagagctactctttatggtttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagacyttttattgcctcttggatctttgtgggggctggggaggaatgtatggggtgtgtgtgtgtgtgtgtgtgtgtgtgtatctattttggtgtttattgggggttggaataggagaatctttggagataggcagtgacttgatggaaaggtcttggagagagggagcaaaagtagtcctggtcttaaggggagatggggaaggttaatcacctacatataaccataactgcatttattgtgggatatagtagagctgagccttctctagtaccaaatggtttgccttccttccagagaaatcc

SEQ ID NO: 146711 - DNA, 601 bp, Human
ttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagactttttattgcctcttggatctttgtgggggctggggaggaatgtatggggtttgtgtgtgtgtgtgtgtgtgtgtgtatctattttggtgtttattgggggttggaataggagaatctttggagataggcagtgacttgatggaaaggtcttggagagagggagcaaaagtagtcctggtcttaaggggagatggggaaggttaatcacctacatataaccataactgcatttattgtgggatatagtagagctgagccttctctagtaccaaatggtttgccttccttccagagaaatcccagatcctgtgatgggggacaccagtgaggatgcctcgatccatcgattgg

SEQ ID NO: 146712 - DNA, 601 bp, Human
atggggaggacaagaagaagtccaaagtctcctcctacaaggactgggaagagagcaaggatgaccagaaggatgctgaggaagagggcggtgaccaggctggccaaaatatccggaaagacaggtaaaggccttagtatgggttagcccagagggaagcgaacggaggctggaaaataacagctcatgtttatctctcagttttcctgttggagatttagagctttatgattttattatgattctgtaatactgaaggtaggtaggaatttgtggggaaaaacaaaggtgaataaagackagatggtagaggttagaaatgccttgggttgttgccatatgtgagcctgcgtcccagggagagaaagtggaaaaggacagatcacttgtttggacagccaaaggttttagggcagagtttttctcctatggaggggcctttaccagttgctctccctgtttcagacattatcggtctgctcgggtagagactccatcccatccgggtggtgtgagcgaagagttttgggaacgcagtcggcagagagagcgggagcggagggaacatggtgtctatgcctcgtccaaagaagaaaaggat

SEQ ID NO: 146713 - DNA, 601 bp, Human
atgggtaaatatgtataagagaccagcatttctaatagtattggtgatagagaaaggacagtgctatggaacaaagctagacaaaaaaatccaatgctgtccttgctcagtattaagttttatagctgatagaattgtaactattaaaaaaaatgattcactgtaaactcgcactagtattttttgaattcttgctggaaaataactgttactgtgggtttgaaattttctaggcagtaactatttttcccccttgggagaatggggataggtgagtttcaggagtccacggatcacattygagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactcgtcttcagtgagattgc

SEQ ID NO: 146714 - DNA, 601 bp, Human
ggagtccacggatcacattcgagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactcgtcttcagtgagattgctgaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactgg

SEQ ID NO: 146715 - DNA, 601 bp, Human
gaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtgsctcatacctgtaatcccagtactttgggaggctgaggcaggcagattacttgaggtcaggagttcgagaccagcctggccaacatggtgaaaccccatccctactaaaaatacaaaaattagcctggggtggtggtgggtacctataatcccagctattcggtaggctgaggcaggagaatcacttgtacccgggaggcagaggttgcagtgagccaagatcacaccactgtactccagcctgggcgacagagcaagactttgtctcaaaaaaagaaaaaaaggaaaaatacatcctgga

SEQ ID NO: 146716 - DNA, 601 bp, Human
tgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtggctcatacctgtaatcccagtactttgggaggctgaggcaggcagattacttgaggtcaggagttygagaccagcctggccaacatggtgaaaccccatccctactaaaaatacaaaaattagcctggggtggtggtgggtacctataatcccagctattcggtaggctgaggcaggagaatcacttgtacccgggaggcagaggttgcagtgagccaagatcacaccactgtactccagcctgggcgacagagcaagactttgtctcaaaaaaagaaaaaaaggaaaaatacatcctggaccattaaaaattgagatatctttaaaaactgtcaaaaccgatcttaaccgttatagatacatgca

SEQ ID NO: 146717 - DNA, 601 bp, Human
cgttatagatacatgcaaggtttagaaatagtaaaaggagtaaatttggggaattgacttttggcaactggttctagaccatgtcatggttaagtgagatgtttcctgtggatgtgtcttttgtggcccagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtgatgttctgggcagagcagyccagtttcgctgggtgggcggtaaggagcctcggcagggagagcagatggtggccaggaggacgtggcttagctcagtgacagttttgtgatgctggtgctgctgttcccaggtctgtgaggggcaagtactcggatgacacgcctctgccaactccctcctacaaatataacgagtgggccgatgacagaagacacttggggtccaccccgcgtctgtccaggggccgaggtgaggcctgtggggcagcaggcagaagagcaggcttgcttgccctagcgaggatgagcaggggctgcc

SEQ ID NO: 146718 - DNA, 601 bp, Human
ttggggtccaccccgcgtctgtccaggggccgaggtgaggcctgtggggcagcaggcagaagagcaggcttgcttgccctagcgaggatgagcaggggctgcccttctggagctgcatggccctgcagatctgtctggggccgctggggacaggccagggcatggactgacctgcttcctgtgctcctccaggaagacgtgaggagggcgaagaaggaatttcatttgacacggaggaggagcggcagcagtgggaagatgaccagagggtaaagttttatacctctgaggggctgatcgrggctggtggccgtctgtagatgggtgaccctctagcaggactgggctttgatgagggtacacctgagccctgttcagacccaatgccctggagtctctttgcagaggcatagacggcacggtgaaccctgtcactcactgcagtaggctgacctaactgttctgttatgtgttggtgccaccatgtggtaaatctaagaagtgctatcgtgatgggctgccctccagtcctgtgtagttgcccactgtggttctccagatggcatgtgtctgcagggaggcctctcctgcacccctcaca

SEQ ID NO: 146719 - DNA, 601 bp, Human
ggaagatgaccagagggtaaagttttatacctctgaggggctgatcggggctggtggccgtctgtagatgggtgaccctctagcaggactgggctttgatgagggtacacctgagccctgttcagacccaatgccctggagtctctttgcagaggcatagacggcacggtgaaccctgtcactcactgcagtaggctgacctaactgttctgttatgtgttggtgccaccatgtggtaaatctaagaagtgctatcgtgatgggctgccctccagtcctgtgtagttgcccactgtggttctccagatggcatgtgtctgcagggaggcctctcctgcacccctcacaagggtagctccactgcagtagtgacttcctaccaagcgtcccttcttctgttggccatgtctcgtgcataaacttgatctgtccctcactcccttgctttgcctcctgccctgcagcaagccgatcgggattggtacatgatggacgagggctatgacgagttccacaacccgctggcctactcctccgaggactacgtgaggaggcgggagcagcacctgcataaacagaagcagaagcgcatttcagctca

SEQ ID NO: 146720 - DNA, 601 bp, Human
caaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgtgggcagttgcggcagaacccatcgactttgtggctcctgagtgggagactcttaggatacctctctgcatcttccattctctctggtcccttcctcctggtctcttcactgtcctccacttttcctatatgtgattcctsctccctcacactgcttcctctggtgctggtgttgtgagaggaaggaggcccagggaggttaagtaacttgtctgaggtcacccagcttgtcagtgagggagttaggatcagacccaggccgtctcacatcagagccactctgctgaagtacctcccaggtgttcagcatgggcagctgggttttagtcccttagatttgagttcactataagaactatttttaaaagaggttccaaaatagaaagggttatcttattggccagtgacttctctgctcatagaggcatctaagcagatgct

SEQ ID NO: 146721 - DNA, 601 bp, Human
gttctttgaaaacaaaaccgtacagactatgctttcctgctgtcctgccaagaggagggaggaagtttgacccatgtcccgtgctctgcacccttacctcctcacaaggcctgtgtggctattttagccctttagacgttgtgctgaaattgcccgagggtattttctacaagttagtgacctggggattgatttccactcctcttctgctcactctgttttggttagagggtttgctaatatggtgatctgtaaatcctccgatccatgttcagctagctctgttggaccctgtggtgtygagtgtgttgtggatgatggattctcaagtagcagtttcagtcctgaggtcgatgagaaccatctcagattccctggctgctttggtgtctcagactcttgccgaagtcctcattcctgagcgtaggaaggagggcagcaacccaatcaggaaggacagcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctg

SEQ ID NO: 146722 - DNA, 601 bp, Human
agcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctgcccatctttgcagtgcagcaggagctgctcactattatcaggtaacttcacccggggcccaggaatctagtgtcaagtcaggggtgcccttggtctcccatgtttacccaggagctctttttcttttgtgcattgcacccagtggagaagggaaatamttttttcctctgacctcatgcctggggtacactgcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtccttgtagagacaacagcatcgtgatcgtggttgg

SEQ ID NO: 146723 - DNA, 601 bp, Human
gcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtccttgtagagacaacagcatcgtgatcgtggttggggagacggggagtggtaagaccactcagctgacrcagtacctgcatgaagatggttacacggactatgggatgattgggtgtacccagccccggcgtgtagctgccatgtcagtggccaagagagtcagtgaagagatggggggaaaccttggcgaggaggtgagtgggcgtgggggctgagccatgtagttattccctagtagcttccacccatttttgctaaagggtgtgatctgctaagactcggaccccagtacggggtgtgctggtggtgagccggtggccagggcatctgagccatctctctgacctccaggtgggctatgccatccg

SEQ ID NO: 146724 - DNA, 601 bp, Human
ttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgcmctggctgtgctgcccatctactctcagctgccttctgacctccaggccaaaatcttccagaaggtgtgtcagcaggaatgtccaggagtggctcttggagttctctaaaggaagcgagaggggatgtgactgtcctggcagggggtgggctaggaggtaggcttttccccctcgcggagcctttcctgtctcgagggactcatttttccctccctgtatgtcctgctctaggctccagatggcgttcggaagtgcatcgttgccaccaatattgccgagacgtctctcactgttgacggc

SEQ ID NO: 146725 - DNA, 601 bp, Human
gctttctggggcagcgctggggttgctgagcgtggagcccgggcgggggcgggcaggatgctggctctagagctggtccccaaggctggaagctgctggcagggctgccacttgttagtcctttcatcctatgctactgagtggaaggaaggagtggctttccagggatttcagaggtctgaggccaacctacgtggatgtaggtacacatgcaggtaattacagcctgcctcccttcagagggtaggtctggacagatgatgccattggttctttttatttctattgttctctttccccmttttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccac

SEQ ID NO: 146726 - DNA, 601 bp, Human
tttctggggcagcgctggggttgctgagcgtggagcccgggcgggggcgggcaggatgctggctctagagctggtccccaaggctggaagctgctggcagggctgccacttgttagtcctttcatcctatgctactgagtggaaggaaggagtggctttccagggatttcagaggtctgaggccaacctacgtggatgtaggtacacatgcaggtaattacagcctgcctcccttcagagggtaggtctggacagatgatgccattggttctttttatttctattgttctctttccccattttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccactc

SEQ ID NO: 146727 - DNA, 601 bp, Human
gtaattacagcctgcctcccttcagagggtaggtctggacagatgatgccattggttctttttatttctattgttctctttccccattttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttrcccaggctggtattgtgaactcctggcttcaagcgattcttctgtcttggcctcccaaactgttggcattataggtgtgagccactctgcctggctctcttccccttttttgttccaattaaaaaaattaatgtattcactatagagcgttagtgaatatagaaaaatatcaagaaaataaaacccagccatgattctagtcccaggcccattggttctagaaatgaaacagatggctgggtgtggtggctcatgcctgtaatcctggcactttgggaggccgaggcgggccgatcacaa

SEQ ID NO: 146728 - DNA, 601 bp, Human
tgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccactctgcctggctctcttccccttttttgttccaattaaaaaaatyaatgtattcactatagagcgttagtgaatatagaaaaatatcaagaaaataaaacccagccatgattctagtcccaggcccattggttctagaaatgaaacagatggctgggtgtggtggctcatgcctgtaatcctggcactttgggaggccgaggcgggccgatcacaaggtcaggagtttgagaccaccatggccaatatggtgaaaccccatctctactaaaaatacaaaaatcagctgggcgtggtggcggatgcctgtagtcccagctactcgggaggctgaggcaggagaatc

SEQ ID NO: 146729 - DNA, 601 bp, Human
aggaagtgttggggaggggaatggcttctctctgtattactgaaatggaacagagggcagaatcagagtttctgaagaatgattttgctgttctcggttaagcaggttggggtaggggaaaggaagggctgggccagtggttctcagggaatgctttggaaatttgcaagagcattttttatcttctagtatggttgctcttgagccctcatgttttagagtagacctttttaaaaattattttaatttttctcaaattgtcagggcaacctattgacatgtttgaagttctatgtgtggktaggtggtagtgttagaacctctgggatgtgcttagtgggcctggacccccctgtacttagagtgaaggttctttttcccttcctagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagg

SEQ ID NO: 146730 - DNA, 601 bp, Human
tattactgaaatggaacagagggcagaatcagagtttctgaagaatgattttgctgttctcggttaagcaggttggggtaggggaaaggaagggctgggccagtggttctcagggaatgctttggaaatttgcaagagcattttttatcttctagtatggttgctcttgagccctcatgttttagagtagacctttttaaaaattattttaatttttctcaaattgtcagggcaacctattgacatgtttgaagttctatgtgtgggtaggtggtagtgttagaacctctgggatgtgctyagtgggcctggacccccctgtacttagagtgaaggttctttttcccttcctagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctagg

SEQ ID NO: 146731 - DNA, 601 bp, Human
atgggcttccgccaaaggctgtgtcaagagtgttaagggatggggtcgctgcccaaatgggtgttgttttcctgatgtggctgcctgttgtgtctcctccctagggaatcggggagtacgtgaacatccgcacagggatgccctgccacttgcaccccaccagctccctttttggaatgggctacaccccagattacatagtgtatcacgagttggtcatgaccaccaaggtgagtcttttccaaggcacttgcataatgcaggccccctgtctggccaggctttgaaacccttcactgcsttctggcatgagcttttagcctgggagccttgaggccacatgcattgttttgcggggcatgtgaggttggttttcatttggggacttggggaagctctgcacagggttgacctctagactgcattgacctcagctgcatgggcacgattgttccccacttgctgcttgggatgagcaacccctcttggtgtcattagaaggattttcggaggggttgggccttttcttttagatactgggggcattttctcaagtgtggaggagtttggatgggagtatctggggtttttcctttccttt

SEQ ID NO: 146732 - DNA, 601 bp, Human
actcataaaaaaatgaatacttaatgtcacctaagtctccagtccgcatttggatttctccatttatctcaaagataacttcttatgatcgatttgcttgaattaggatccaggcattgcaactgcttatgtgtgttaactgtttcattctagaacaggctccaccccacgctttttttcatgacattgatttattggagcagccaggtcatttgtcctgtcgaatagtccatatgatgtatttgcctcattgcttgctcacagcggtgtttaacctgtgcctgtgtttcgtgcacttgcygtaagctggcgatgagtccaaccgctcaattagatcccggctgagctgcgtgtggcagagatgcctgcatgtggcactgtgaacctcctcttagatgccttcaggaggcatgtgaggtctggtggccccacctttgctgatgggaggatggatgaggggccccagtggtggcagcctgcctcttccctgataggtttccactgctcctccatcttgaggttttagcgtctgttgatggccattgcctagatccatatttagggttgcaaaatggtgctgggctttggcttaccccttttc

SEQ ID NO: 146733 - DNA, 601 bp, Human
taggtttccactgctcctccatcttgaggttttagcgtctgttgatggccattgcctagatccatatttagggttgcaaaatggtgctgggctttggcttaccccttttcgtagcataattctccccacaccaggctcccttgcatcttatgcctgtctcttccagccagcaggtaatcacatcttccctgtttttctgtacttcctagcatagttgtgaacttgatttttcaaaaaagaaggaaatgtaagtacttcctggactgagggatgactgagttaggactgattgtccagtgtgttgagtcagtgaaaaaagcaggcctcagctgcagaagagaaggcggctttggtactggggcaggcagccatgtggagcactggcctggtggatgcagcacctggtttgtggcagggacttgggtgccgacgaggcctccttccttagtggtccccagtaggctcagccaggtctgtccctcttcaataggagaaccgtcgtcgggccaaagaggaagcctctgccatggaggaggagatggcgctggccgaggagcagctgcgagcccggcggcaggagcaggagaagcgcagccccctg

SEQ ID NO: 146734 - DNA, 601 bp, Human
taaattgattattttaacaggacttccaagacaataaggggaagtttgtttaaaatttcctctgtcagtgggaggaagggttctttccccttctcaatgctgtgtgaaccataggacctgaaatgtttatgctcaagatgagaaaaaaatagaccttctccatttttgttaaaatgatataatactaaaccatttagctattgtcctaggcctagacttcaagaggtcttctgaatccattcaatcatcattgccttttaaatcacaaattcagaatggtctaaggtagagcttgctagcrttttattttaaatgttctttatggaattaaaaaaaattaaaaaaaaacagtaagaaccccaaagttggcaatggagaaacaggagtgtagaggagcaggtcaggccaaaaaagtcctggaggtgctgggctccctggcctaggtcccttggtgggaaacctggctaaggccacacaaggaggggagcaggatcctgctccttccatcccagtcctggcccgggctctgctgactcccagtgtcaaggctaaagctggcccctgtaggaagctggcatggagcctccctcgggacacaact

SEQ ID NO: 146735 - DNA, 601 bp, Human
aataatgtgcataaaacatactcggccccaggcctggcccaagatacagtctctttctctttcttgctctgacactcacaagccaggatttttctatcctagcctagatccgttgtgtaaaagcagcagctatagccaaatgttgagatgcagagagacaggtttatacaaaggtgtgacatggacatacaccgattgtgtcaaatatctaggcgctaaatggctggtaaagctacaaactgtttgccataacaaaagaaagggtatcctgtacaagctcagccatacacgacattaaactcttcccagatttcctgggccagcaatgaaatcacttccagactggccacagacttctccagccttttcaaatcagataagatacacattttagacagacagatagcaatgccatcttcaaagttctctgcttggaaagcagtcttggttgttctatctgatgacaatattattgcaatgcagagccaatgtggacaggagctgtgatttatagacaatctaattagtaataacaggataatgtgctgcttctctatatctttgctgaggatctgggtatcagcagggttaaagtattaca

SEQ ID NO: 146736 - DNA, 601 bp, Human
gtctgcttatctgaaggagtagaaactgagtcgtactctggttagtgcctgaatcctgttatttgtcttttattagctatagaagatggggttagttcagcggtattccatccagggtgagtctgtaccccccaccccccgccaggagacattcagcaacagctggagatatatttatgtcacgactgctggggtgggggtgctcctggcatccgatgtgtaaaggctgggaagctgctcaacgtcctacaatggacaggacagacccacaaccaaaaattatcccactcaaactgtcaayaccaccaagtggaaaaagcccgggctggttggtttcttccactgtataatagatattacaataatgtgcataaaacatactcggccccaggcctggcccaagatacagtctctttctctttcttgctctgacactcacaagccaggatttttctatcctagcctagatccgttgtgtaaaagcagcagctatagccaaatgttgagatgcagagagacaggtttatacaaaggtgtgacatggacatacaccgattgtgtcaaatatctaggcgctaaatggctggtaaagctacaaact

SEQ ID NO: 146737 - DNA, 601 bp, Human
ccagcctgggcgacagagtaagactctgtctcaaaaaaaaaaaaaagaagatatgcaagaaagataatcatacaagaaggtaattattattctttaataattactggagatgcaaatatattctacacagatactaggaataacaaggaataacaggagaagagccagtccatctatctatatggtggaatatttaaagcactctgtccttgtatattttaatttcataatgaaaacatggctaaaactatgtctattgttacccatgtgtaaattagaggaaagatcatggaaataaatwtatttataaattgaagattattgaattctccaaaaatacaaataaagtacagtccctgtctcaaaaaggaatttcatctaagatttaattacaactatgaaaataccctaaatttatgatcttaggaaaaagtgagtcccataccttaaaggtaatgttagattctaaggcactttgacaattgttacaatatagcacaaaaacgactagaatgttgtagatgatgtgtttaaaaccagcatgcaagctcaagcctaaactccttatcacgtagacattgcaatgtctctggcaatggga

SEQ ID NO: 146738 - DNA, 601 bp, Human
aaacgcctgtgtccttggaacctcttcccgtttccatcccggaggaaacatctgttgacatcctaaagatggtctgatgatcatattttgggaaaggctaaactagacactattgtctctcaggaatattcaaaacatgtataaacaaaggcattcaattgatctcaaaaaattagtaatctcaaatatgcttaatgcactacctaaacaaagcttatatttattttttaaatccccctagtattgtacactaaggaacactttttaatgcgttttgattttatggtatatatttcacacsttataagtaagaaaattgaatttctttttaaatagactagatttgaaattctcactaagtcaaatctggcacagtgcgtctcacatattaagtacttaataaattactgttattattaataactcaccattattagttcaaatgaatgaacttatccaaagtttcaaagagtctacacaaaaatatttgctttcatgtgcttgagtaaagaatttagtatctaagaagcataacacctttaacgtttaaaacaatggttaatataatttataggaaaaattttttaatattctgttaaaa

SEQ ID NO: 146739 - DNA, 601 bp, Human
tgtccatttaacctgaactcagttttccccaaacgcctgtgtccttggaacctcttcccgtttccatcccggaggaaacatctgttgacatcctaaagatggtctgatgatcatattttgggaaaggctaaactagacactattgtctctcaggaatattcaaaacatgtataaacaaaggcattcaattgatctcaaaaaattagtaatctcaaatatgcttaatgcactacctaaacaaagcttatatttattttttaaatccccctagtattgtacactaaggaacactttttaatgygttttgattttatggtatatatttcacaccttataagtaagaaaattgaatttctttttaaatagactagatttgaaattctcactaagtcaaatctggcacagtgcgtctcacatattaagtacttaataaattactgttattattaataactcaccattattagttcaaatgaatgaacttatccaaagtttcaaagagtctacacaaaaatatttgctttcatgtgcttgagtaaagaatttagtatctaagaagcataacacctttaacgtttaaaacaatggttaatataattta

SEQ ID NO: 146740 - DNA, 601 bp, Human
aactctggggaatttccaggtcagggcataacttggtcaaaacaacttggtgaaaaacagtgggtagatgggggaacttacactagaatcaaggttttatccactgatgcactctttcacaaaggccgttcctggcttcagaaataaaaagggtcagaggctcggtacagtggctcacgcctgtcatcccagcactttgggaggccgagacagcaaatctcttgaggtcaggagttccagaccagcctggccaacatggtgaaaccctgtctctactaaaactacaaaaattagccaggtkggggggtacacgcctataatcccagctacttgggaggctgaggcgtgagaatcacttgaacccaggagatggaggttgcagtgagccgagatcgtgccactgtactccagcctgagtgacagagtgagactccatctcaaaaaagaaaaagaaaaaaaaaggggggcgttcaaataagtgtggggaactgtatatgacgcagcacccacggaaggtccagatgatacactatcttattacaggctctgagacatcccagggcaaaacaacaaatgtccatttaacctgaactcagttttc

SEQ ID NO: 146741 - DNA, 601 bp, Human
cacactacctaattatctagcatcacaacttgctgtctagaaacgtgtttgaatgctcaaaatattctaccaacaaacaggaggaaaatcccattgcccagttttcatttgtcagggtttgttttatgttaagtctttgatcttgaattaaaatatacactctcattttgctcccctgaaaagaaagctattttcctgccagccaatgttttgtcaagatcatatttacaaaaaaatattttttcccataaatagtcgggacagaggctgccggtgctgggccacaccaatgacagcctgyactcctggagagtgctctgggctttaaaagtcatggcatgtgatctgccattcgagatacttcattttctgctgctccttctgaacttggaaacagaatcggctccctatttttaaagctgcactagattcggtaagctccagatacagctgcaaatcaagagccatcaatttgtatgatggtctctcctgagtctaacaggtcccacagcgcatggcaaaagggcagattttacggtgggcagaactaggaagtggagctggaaacgagaatgtgcagctcactctccctgttcgggaa

SEQ ID NO: 146742 - DNA, 601 bp, Human
tgttcacttgggggttcagttgtgctattactggctagcatcttccatcatgaacctgtagggcaggctccaggactgccgctggccactacccaggcccacgggtacagcaggagcccacaggacaaggaggcactgggatgagtggacattggttctccagctcaaggaatttactggctctactatagacagatgtcattcctttaccaatcttctagggaaaaccacttcaaaatcaagcatgtcaccacatgccacagacttgggtactcaagtcttagggttgtggatttctcayctaggagggcaaactaacctaaggccctaacatgctacagcgggacgcccacagaaaattctctggttaagtcctcaagctctagcaagacgtgtgtaagaaattcacatctatcattcattaccttcaggtatttgtccaaatatctaataaaggagaaaccgtaccaagggtctttaacccttctgatttcactacagctttttagaaattagccaggaatcactgttagcttctcgtgtcagattctcatgtgaggaaatccagaatcattgaatttggggccagttagcattaaac

SEQ ID NO: 146743 - DNA, 601 bp, Human
agccctgactcagaaaaacacacagcatttccagcccgcgtggtgaggagacagtcagtgtgggaacaagatccaccgaggtgcctcttgcccttgcccaggacatatcgatgagactggggagccccacatggggacacagagagtcaaacagcgacaaacagtttcacactcatggagatgtgtcctttaacattctggagtcttgtatgtggaagtgagaagggggaggtgaggaggcacagttgtccatggacatttctcaaagcaccaacatttccaaatcgggaaaaacctgacrtcaaacagggaaatggaatttggaggcgtaaatcatgggccaccgcacctgagcggctgcctgagcttttggggcctgcgaatgaccgttcggtttgcccttccctgccccctgcagatcaatttcttcccattggacatccattctcgcagccgtgccttctccctccctggaggtcttagcagagtgttcacttgggggttcagttgtgctattactggctagcatcttccatcatgaacctgtagggcaggctccaggactgccgctggccactacccaggcccacgggtacagcag

SEQ ID NO: 146744 - DNA, 601 bp, Human
gggagcctccccagcctcctgcagaagccactgcacctccggcccccaccacaccctgcccaggtccctatcaaaggcccccaaagaagaaaacaccactctgctttctgccccagtcacgccagcgtgctgttcctcacgtttgctggaagtccccccgtggtatgttcctctgccctgacaggcaggacacctgtggagccacggtctcctgtgaagaaatgcaggttccacgtgcagaggcggaagcaaggaggcctccagccgcccggaacctctgctcccagggctcctgatgtgyggtccaggcaggacagggcacacccgtttacccagggcctctacattcagattcagggcagggcacccagcccctcctcccaatcaggaggcagaacccaacacctgccacccacatcagccccgtcaggatgattaatgacgttgcatccataaaactccaagaacctggagacagggtgctgcctcccaaagccctgactcagaaaaacacacagcatttccagcccgcgtggtgaggagacagtcagtgtgggaacaagatccaccgaggtgcctcttgcccttgcccaggacatat

SEQ ID NO: 146745 - DNA, 601 bp, Human
tgtatgtgatatgtgcatgcacgtgatgtgtgcatgcacacatgtgaagtagagaggacaaagcacacaggtggcaggcgcgggtcatcagggctcgtcgtgacaccctggaaaatcacacaggtgtacatgagccctgaacagagagaaaggaaaagtggatgggaaattgtggtgggaggaacagaaagggcagaaattttataaaggaaagaagggtaaagggggcgagtgaggtgggacgggatggtgcacctcctctaagaccacggggagcctccccagcctcctgcagaagccwctgcacctccggcccccaccacaccctgcccaggtccctatcaaaggcccccaaagaagaaaacaccactctgctttctgccccagtcacgccagcgtgctgttcctcacgtttgctggaagtccccccgtggtatgttcctctgccctgacaggcaggacacctgtggagccacggtctcctgtgaagaaatgcaggttccacgtgcagaggcggaagcaaggaggcctccagccgcccggaacctctgctcccagggctcctgatgtgtggtccaggcaggacagggcacacccgttt

SEQ ID NO: 146746 - DNA, 601 bp, Human
tccttgggccccacttccgacgttcaccctcttgtgggtgacttctgccggctggccttggctctcactccacggtaactgccctcccagcttggcccaccagctctcctgtccccttccacagcatcaaatccacactgagtgcccaagggcagcgccctccaaaatcccccactcaggaaaaaggagcagaaccaagcccaaaacaggtggacgaggagggctccattcaggccacgtggtggagggggagggctgggaggttcctgaagaaagtgcgtgtgtgtgtgagtgtgtgccygtggtgtgggtgtgcacggtgtgtgttccatgtatatgtaagtggtgtgtgtggtatgtatgtgtgtgtggtgtgtgtatatgttatgtgtgtggtgcgtgtatatgtatgtgtgtggtgtgtgcgtgtatgtgatatgtgcatgcacgtgatgtgtgcatgcacacatgtgaagtagagaggacaaagcacacaggtggcaggcgcgggtcatcagggctcgtcgtgacaccctggaaaatcacacaggtgtacatgagccctgaacagagagaaaggaaaagtggatgggaaattgtg

SEQ ID NO: 146747 - DNA, 601 bp, Human
gccctgtaaaatgtcagtaatttccttgggccccacttccgacgttcaccctcttgtgggtgacttctgccggctggccttggctctcactccacggtaactgccctcccagcttggcccaccagctctcctgtccccttccacagcatcaaatccacactgagtgcccaagggcagcgccctccaaaatcccccactcaggaaaaaggagcagaaccaagcccaaaacaggtggacgaggagggctccattcaggccacgtggtggagggggagggctgggaggttcctgaagaaagtgygtgtgtgtgtgagtgtgtgcccgtggtgtgggtgtgcacggtgtgtgttccatgtatatgtaagtggtgtgtgtggtatgtatgtgtgtgtggtgtgtgtatatgttatgtgtgtggtgcgtgtatatgtatgtgtgtggtgtgtgcgtgtatgtgatatgtgcatgcacgtgatgtgtgcatgcacacatgtgaagtagagaggacaaagcacacaggtggcaggcgcgggtcatcagggctcgtcgtgacaccctggaaaatcacacaggtgtacatgagccctgaacagagagaaag

SEQ ID NO: 146748 - DNA, 601 bp, Human
cagcaggcggctcctgcgccccctccaagtggcagggagaacagggaagccttggaagggaacacgtgacccagaatgcgaatgagcagcctccaggctgggggactcttctttgaaacacagggaagacacacatttaggattaacgatataacttcctaaaggcaaatgagtgagacaggaaaggaaacggatgcttataccaactcccatgttcctaaattatcatctatttccccctccctttgggttcacggccttatccaataggaagcccaaagaaatggcatctggtcaattktctctagaggaggacagaaatcagaacagctagttaagaaagtcaggcaagatttaaatagagtgacttcaagtactagcgtccacttcacatgcccagataaaatgattttaggaataaaatatggagaatcaaattgattagcgaatggaaaaaaccacagacagtgaggaaaatgtaacaaaatttcccagctatgattgcttcaacttggaacgtgatttttcagaaaagaaaaaggggaggaaaaccagatggcattggggattccacaaactttggttttcccatcagcagatg

SEQ ID NO: 146749 - DNA, 601 bp, Human
actacccacttctggcccgtcgcacccagcaggcggctcctgcgccccctccaagtggcagggagaacagggaagccttggaagggaacacgtgacccagaatgcgaatgagcagcctccaggctgggggactcttctttgaaacacagggaagacacacatttaggattaacgatataacttcctaaaggcaaatgagtgagacaggaaaggaaacggatgcttataccaactcccatgttcctaaattatcatctatttccccctccctttgggttcacggccttatccaataggaagsccaaagaaatggcatctggtcaattgtctctagaggaggacagaaatcagaacagctagttaagaaagtcaggcaagatttaaatagagtgacttcaagtactagcgtccacttcacatgcccagataaaatgattttaggaataaaatatggagaatcaaattgattagcgaatggaaaaaaccacagacagtgaggaaaatgtaacaaaatttcccagctatgattgcttcaacttggaacgtgatttttcagaaaagaaaaaggggaggaaaaccagatggcattggggattccaca

SEQ ID NO: 146750 - DNA, 601 bp, Human
aaagattaaacttacagtatcatttcctgcctttttttcttaactacttaatgtcaatagactaaaatattgagatcttcggctagaaactaagatgtggaaacagaccaactgggttacagtttgcaaattatgaggtataaactttctaataaaaatagattgtagagtatataaacatgttacactttcccacgtatatggatttttttttaagttacatcaattgggcgatagatgaccaagtatgggtacggtagacacacacacacacacacacacacacacacacacacacaaccacacacaaacacagaatcagaaagagagagagaaacgaagagacagagacagagagacataaagagagagaagcttcactaagaggcaggttgggggcacctggttcccacgcccccagacctcccactcccagggtctgaggtctgggacacatcactgaggcaatttgtctttggcaagagagggccagtcagccatgcaccctgaaatggccttcccttgattcccaaatatacaattgccaacttggtggaaactgagctctcatgggaattctaaacctacaggtgcccaccct

SEQ ID NO: 146751 - DNA, 601 bp, Human
ggtattacaggtgtgagccaacgctcctgacctaattttttttcttataaagacactttgctttattttcattagctccaaagcaaggcccctgagggttcgaaagacatgttctacattaacagaaatgttgaaaaatgccaattagtgcctaagtacttagacagccgaggatgttattaacgtgaacttaataatgtatgtgggtgtggggcagcgttgtggaacaaaacgaggacacagcaaaggcaggaaacaccacaaggtaggtgatggattttttttttctttttttggtctrtgataaaagtaaacttgaaaattgcagatgaaatactctgaagataagaattatagttaataatacaaaagcatgcaagacagtcttcaggtttaaaccttgagagaattgctcattggcaattaagaaaaacctttcttttttttttccttaaaaatgtgttagatataattatttatcaaaattgggttttacaggtgccctgccaggggacatccagggtccccatcctctgagtggttccgtagtccctgcggttcccttgccagggtgtgcagagccgcgtacatagcacctcca

SEQ ID NO: 146752 - DNA, 601 bp, Human
tgtaacctccacctcccaggttcaagcgattcttgcgccttggcctcccaagtagctgggattacagacgtgcaccatcatgcctggctaatttttgtatttgtagtacagacaaggtttcaccatgttggtcaggctggtcttgaactcctgacctcaggtaatccgccagcctcggcctcccaaagtgctggtattacaggtgtgagccaacgctcctgacctaattttttttcttataaagacactttgctttattttcattagctccaaagcaaggcccctgagggttcgaaagacrtgttctacattaacagaaatgttgaaaaatgccaattagtgcctaagtacttagacagccgaggatgttattaacgtgaacttaataatgtatgtgggtgtggggcagcgttgtggaacaaaacgaggacacagcaaaggcaggaaacaccacaaggtaggtgatggattttttttttctttttttggtctgtgataaaagtaaacttgaaaattgcagatgaaatactctgaagataagaattatagttaataatacaaaagcatgcaagacagtcttcaggtttaaaccttgagagaa

SEQ ID NO: 146753 - DNA, 601 bp, Human
ctaacccagggcaggggctgaaatgcccagtcaccactgccaacactttggttaacttttggttttggattttacttactccattaaaaaaaatatatatggaatactatcctcaaagacctagaaatgcacatggcataaatgaatgcttccaacttgagctccagccattgcaggaatgatcacacttaggaggtgctgagagtctgcacatgaaatcacgcctctgctcaccagcacaaccgtctttttttttgaagttccatgaaatttatcacaattctaggtcatgacttagttaaaagatttggggtaagaagaaagactgcaggaacataaataattgataacaaaatatcaataagaggttagctctcttctgagtttgtataagaaaaaaatatatatgtttttgagatggagtcttgctctgtcatccaagctggagtacagtggcatgatcttggctcactgtaacctccacctcccaggttcaagcgattcttgcgccttggcctcccaagtagctgggattacagacgtgcaccatcatgcctggctaatttttgtatttgtagtacagacaaggtttcaccatgtt

SEQ ID NO: 146754 - DNA, 601 bp, Human
tctttggtcttcttccactataagtttatagaaaacttatgcattaaggtaatttagtccattctcctgagttttgccaattctaaaagaaaaaaaaatctatccagttttttggatcccaaaaaagatgataacattctctcctttgcttaacctatcagcatgaacactcattaaaaccaaaatcacagatgcctctttctaaacctactacctaacattctgtttctcaaatatatatttttaaaaatatcttcaaaacgagaaaaacagtacagaaaacaagtgttatgctacaggmttggaacctcacttgctgcagctatggacggtgtggatggttgtgcatgttgcacactgcagcaatcagaggccaaaatcagccaccgaagctaggtgttggcacagcaggaggcctttatctaatatgacaaagctggaaaaagcccagtggtagcaaaaccatcctccaaataagttgcacagagctctctgggggttcctgcctgggtgacaccccaaggatggcaggacacaccaagcaagaggcagcctccgtgtagactttagaggcttggtactgacctgccaagagttggga

SEQ ID NO: 146755 - DNA, 601 bp, Human
cccaggattcttgagtggaaaatcccaagccctcacgataaggtccatgtgatgaagaaggtccaccctgtgctcagcgaaagcctgcctgcagctatagcatttaatgcagaattgtctccaggtgtccatgttcaaggagagatttctattggacaaatcctgatgttgaaacattatctgagcccatgatgaattctggcacaattctaggctcaagtattctaatatgaattttaacattcactatgaagttgactgacagagctgaacactcaagtcatatgtaatccaaagctasaaggcgatggttacaaaggagatgcacagtgaatatttctgatagatccacatttacaaagaaataaaaccatagatattttctgatccatgaaaatccactttgcacatcagcttaaaagaaaaaaatgaattaaaaagagtccttcagaaaatactttctaaagaactatcattcaacacaagaataactcaagggggccctcagtatggtcttcttataaacaatttaaaagttccccgaaagccatccaaaagcaaacaaaccatctgacgtccccgatccagtaaaaatgttcta

SEQ ID NO: 146756 - DNA, 601 bp, Human
cttttgtccagataaaagtgcacacgaataatctaatactctgtaccctgtccaaggttattatgggaaccagagcagagcaaacggacagaataagcacttaaacagctatacagttagctggcgaccagcatgcagtatggggccaaattattcctccaagattttagcacatttccaccaggattgtaagaagagcaaagagctggacatgttgtgcaaaggttattggagctagcagggtccaagccagactttgcagctgcaactggcaatgctactaacgtgaccacagtgaccycccacttccactggagctcaaggcagaatgtgcacagttagagtcagggagcaacaggaccctcgatcatctgtttcccatggtgtgctcaaggcaaggtccaaaaatccatggcggccacagacttcatgtcaggcaaaaatgaaaaccacaaccattgtctgtcacagcaaagactatttaaaatggaagaaagaaacgagaaacttgaaaaatactacacagaaagttttcgtgcagctgaaccttgtgctctcattcctgaacatcagtgcaatgcagagcactgatcaaaaaagg

SEQ ID NO: 146757 - DNA, 601 bp, Human
aacttcatgtcagcccaaggtaccgacccttctatgtccatttcacagatagggaaattaagattccgatgcttaactgacttgtcgtacgtcactgggtgacccctcgtgctgctgggaacagaacacagaaatccaaattcccagaccttgcttttaccgcaagaacacattctttcccaaatgtcaccagaaagtttaagcaatctgtgtatccccagagctttgaaatgaaggagctaagaaggaagtgactcctccatggacatggttcttgccattccccacatatttttttaaygttcttaatcttttgtccagataaaagtgcacacgaataatctaatactctgtaccctgtccaaggttattatgggaaccagagcagagcaaacggacagaataagcacttaaacagctatacagttagctggcgaccagcatgcagtatggggccaaattattcctccaagattttagcacatttccaccaggattgtaagaagagcaaagagctggacatgttgtgcaaaggttattggagctagcagggtccaagccagactttgcagctgcaactggcaatgctactaacgtgacc

SEQ ID NO: 146758 - DNA, 601 bp, Human
aggacgttatgaacctgggactcagccgccacacctccatagagctgtgtttcgttgaaaggatatgtcaggagtctagacacagtatgtggataaatatgggagagattgtttcaaaccctaaagaattgaatcaaacagtaaatggattaaagaacctcaagccccatactgtggcactgccccttcaggccagcagcatccagggagtcggccagaagcacagacgtgactccacgagggccctgatcccaaggtttgacagggaaggctggctccttctccctgaggcctgtgacartgaggaaggaaaaacattcccagaccaggacttgttcaaatgaagagctccttaaatacaccctgcagtgatggccccaggacacaatggcagaaaatcctgctgtaaggagttacagtgcacaaggtcaccaatctggggcacccagttttcggatataggaaaagtctgctcaaaccagaataggactgaactccaaacagcggctaaaataaataaataaatatggacttgtgtagccccaagtaacccaacatcagacaggaaggaaatgagaaaggcaggtccatgtagaagctt

SEQ ID NO: 146759 - DNA, 601 bp, Human
ataaacatccaaagtcgtccttctttccaaaccactcagccagtcctggcacttaactggtgaattaactgcctgctccatttttacaaacgcaggaaggacgttatgaacctgggactcagccgccacacctccatagagctgtgtttcgttgaaaggatatgtcaggagtctagacacagtatgtggataaatatgggagagattgtttcaaaccctaaagaattgaatcaaacagtaaatggattaaagaacctcaagccccatactgtggcactgccccttcaggccagcagcatcmagggagtcggccagaagcacagacgtgactccacgagggccctgatcccaaggtttgacagggaaggctggctccttctccctgaggcctgtgacagtgaggaaggaaaaacattcccagaccaggacttgttcaaatgaagagctccttaaatacaccctgcagtgatggccccaggacacaatggcagaaaatcctgctgtaaggagttacagtgcacaaggtcaccaatctggggcacccagttttcggatataggaaaagtctgctcaaaccagaataggactgaactccaaacag

SEQ ID NO: 146760 - DNA, 601 bp, Human
gtgcggtggctcgctcatgcctgtaatcccagcactttgggagatagaggcgggcagatcaccagaggtcaggagttcgagaccagcctggccaacatggcaaaactctttctctactaaaaaatgcaaaaattagttgggtgtagtggtgcacgcctgtaatctcagttactcaggaggctgaggctggagagtcacttgaacctgggaggcagaggttgcagagagccaagatcatgccactgcactctagcctgggagacagagtgagactctgtctcaaaaaaaaaaaaaaaacaacaacccataaccattgtaagaaatcaagaaaacctatttactttacagcatgtggacttcagtgcagccttaccatacgaattgggtagattcagtaaccattgttagctgatttaaaaacataaggcagacagtttggagatcacaggcaggattacttagtgttcagtgcctttctcaaagttgcattagttgaaagtaaaaatcaaccgacaagctacacaccacataacataaacatccaaagtcgtccttctttccaaaccactcagccagtcctggcacttaactggtgaattaa

SEQ ID NO: 146761 - DNA, 601 bp, Human
tgggtgcggtggctcgctcatgcctgtaatcccagcactttgggagatagaggcgggcagatcaccagaggtcaggagttcgagaccagcctggccaacatggcaaaactctttctctactaaaaaatgcaaaaattagttgggtgtagtggtgcacgcctgtaatctcagttactcaggaggctgaggctggagagtcacttgaacctgggaggcagaggttgcagagagccaagatcatgccactgcactctagcctgggagacagagtgagactctgtctcaaaaaaaaaaaaaaaamaacaacccataaccattgtaagaaatcaagaaaacctatttactttacagcatgtggacttcagtgcagccttaccatacgaattgggtagattcagtaaccattgttagctgatttaaaaacataaggcagacagtttggagatcacaggcaggattacttagtgttcagtgcctttctcaaagttgcattagttgaaagtaaaaatcaaccgacaagctacacaccacataacataaacatccaaagtcgtccttctttccaaaccactcagccagtcctggcacttaactggtgaat

SEQ ID NO: 146762 - DNA, 601 bp, Human
gggtgagcaggtgtcattgttagttgaggcccggatagaacaaaaaggcagaagagaggccaattctctctcttctggagctgggcacccatcttctcctgcccttggacatcagaactctgggttctctggccttcagattcagggacttgtaccactagccccttgggctctccagccgctggccttggacccagttacacttcaggagtcctgagttcccaggcttgcaggcggcagatcatggaactcctcagcctctataatcctatgagccacttcccataataaatctaagcakcatccagccttgcgcaagtccacagtgagtgtctggaaacagatagcaacgactacttcaggtggttttgctctactgtgttttaaactcttgagggcaggaaatatttatatctcattcctagcacaatcctttatatgtacttaatgccaaataatttcttgggtaaatagagtaacaaatagcgaggtgtttttcactgaactggttataatttcgctcaatcaatggaactctcttgttagcaacagcctcagtgctgagattctgtgatggagcctccaagacgtcttcctcttt

SEQ ID NO: 146763 - DNA, 601 bp, Human
ggtggtccctgtggcccctcaggtccttgcattccaggaaacccaatgacaccttgtaaccccgggaggcctctttcaccctacagaagaggaacatcagtcaggcaaaaggcagcagtaaagaacagaggaaggaattggtgaccaactgtgatggctatatatatattttttttgagatggagtctcattctgttgcccaggctggagtgcatgcacgatctcggctcactgcaaagtccactgcctgagtcaagggattctcctgcctcagcctcccgggtagctgggattacaggcrtgcgccaccacgctggctaatttttgtatttttagtagaggcagggtttcaccatgttggccaggctggtctcgaacttctgatctcaggtgatccacccacctcggccaccaaaagtgctgggattacaggcatgggctaccacgcctggcccgtgatgcctaattttaggtgccaagttgactgggtcacaggataatcagagagctggtaaagcatgacttctggatgtgtttttgagggtgtgtttctggaagagatgggcatttgaatacatggacagtaaggaagatctgccct

SEQ ID NO: 146764 - DNA, 601 bp, Human
gctgctcctcactgcctgcctcgcgcctgcctgcccgtgctgtgtgagctgggagaggagatggaggacgagggcaaggagaaaggagggaaaaggtgcccggctctggaagcgggcctgtcccacgcatggaatcatcgattgtgagtagcaactgtactcactcttgtcccttttgttccaggtagtcctggttctccagtatcaccctggaacagaatagaaatgccattgtcattgatcaccgctatctcaagaatgcgggcaatcttacatccacccacccccaatcccacagccrtgcttaccttttgtcctggtggtccctgtggcccctcaggtccttgcattccaggaaacccaatgacaccttgtaaccccgggaggcctctttcaccctacagaagaggaacatcagtcaggcaaaaggcagcagtaaagaacagaggaaggaattggtgaccaactgtgatggctatatatatattttttttgagatggagtctcattctgttgcccaggctggagtgcatgcacgatctcggctcactgcaaagtccactgcctgagtcaagggattctcctgcctcagcctcccggg

SEQ ID NO: 146765 - DNA, 601 bp, Human
ttccagcgaaaccaggcaagccaggaggcccgagcggccctctctccccctggggagacagcagagcatcattcatacgcactgtgtgtggcagacacatcagccctgacatcgcatgcatcactctgccctacccttcatttgttggttaaaatcatttcctaaaaacagtttgtcacaagctgtgctactgggtaccactttatgaaagaagaaatagacttgatagtatcattaatagggacaaaggcccataatggcattttcttacgtgatgtagtaaatgattataggtaataastttcgtgcttaaatgcaattttaggataaaagtctacaaaaaagaaaggaacaattatatctttctggtacactaaatatgggaaaactgtatttccttactaaataaagcaaactttaagacaagcaactttccaattgtggcaaataaaactctattaacagaatcacactacctgactccttaatatgcaaaaattacgtaaacacacacaaaaaggagggtctcggttctggatttacctttgtgccattgcatcctggaatacctggggggcctggcgggccgtcttggccagga

SEQ ID NO: 146766 - DNA, 601 bp, Human
gaaagaaaaggaaatggaatgaaaagagagaagtcataactaaaagaaagaagttctgccctaaataacctctactcacgggatttccagcgaaaccaggcaagccaggaggcccgagcggccctctctccccctggggagacagcagagcatcattcatacgcactgtgtgtggcagacacatcagccctgacatcgcatgcatcactctgccctacccttcatttgttggttaaaatcatttcctaaaaacagtttgtcacaagctgtgctactgggtaccactttatgaaagaagaartagacttgatagtatcattaatagggacaaaggcccataatggcattttcttacgtgatgtagtaaatgattataggtaataactttcgtgcttaaatgcaattttaggataaaagtctacaaaaaagaaaggaacaattatatctttctggtacactaaatatgggaaaactgtatttccttactaaataaagcaaactttaagacaagcaactttccaattgtggcaaataaaactctattaacagaatcacactacctgactccttaatatgcaaaaattacgtaaacacacacaaa

SEQ ID NO: 146767 - DNA, 601 bp, Human
ttctatggcacttgttgtaaacagattccctgtaatgaatccaataaagcaaaataaaataaaatgtaccttcatccctggtaagcctggtggtccctaaaaaagaaagttttggtgttagttttgtttttctcaaaatatcattagcattaaaattgttatcatgtaatattatatataaaatataagttattaaaacataagcaaagaaagaaagaaaaggaaatggaatgaaaagagagaagtcataactaaaagaaagaagttctgccctaaataacctctactcacgggatttccwgcgaaaccaggcaagccaggaggcccgagcggccctctctccccctggggagacagcagagcatcattcatacgcactgtgtgtggcagacacatcagccctgacatcgcatgcatcactctgccctacccttcatttgttggttaaaatcatttcctaaaaacagtttgtcacaagctgtgctactgggtaccactttatgaaagaagaaatagacttgatagtatcattaatagggacaaaggcccataatggcattttcttacgtgatgtagtaaatgattataggtaataactttc

SEQ ID NO: 146768 - DNA, 601 bp, Human
cctggaggaagagggaattctgcccacacaccaccttcagacccaagactacaactccaccccttctctggtgtctggcctgcccacctcactctgcaggttttgagtttgccggcccccacaatcatgagaaccaatgctttagaagcagtttctcctctctctggccacacacacacatgctcctggttctgtgtctctggagcatgctaacacacagggctattatgaggatctatttcctacgtgttctgaatcacaggagcgagcacagggactctcaccttcatccaggtaagcrgttatctctactgcagctgctgagacctgtaagcctccctttgacaaggctgatcccaacatccagatgcccgaggtccccgccctgtgcccaagcacagccgacacattacatgactgcacagtctgaggtcgggctgatgccagcagccgagccccaagacatcaacaccccgcctgggaaaagctgccccaggttccctcctgggaagtctgagaggcacccagggagccccattctcccatctgcctccccagtttgggtgaagtgagccttcgccaccacaccaggcctccttcc

SEQ ID NO: 146769 - DNA, 601 bp, Human
tctcttttgagaaaaggctcaggatgaatacttttataaaagcacggcgtaatggtaaattttatctgccaacttggctaggccacattattgggttaaacaccagaccagatgtttctgtgaagggatttttaaaatgagcttaacacttaaatcagtagactctgaataaggcaaatggccctccataatgctggtgggcctcatcccatcagttgaaggtcttacaggataaaagactgacctccctggaggaagagggaattctgcccacacaccaccttcagacccaagactacarctccaccccttctctggtgtctggcctgcccacctcactctgcaggttttgagtttgccggcccccacaatcatgagaaccaatgctttagaagcagtttctcctctctctggccacacacacacatgctcctggttctgtgtctctggagcatgctaacacacagggctattatgaggatctatttcctacgtgttctgaatcacaggagcgagcacagggactctcaccttcatccaggtaagcagttatctctactgcagctgctgagacctgtaagcctccctttgacaaggctga

SEQ ID NO: 146770 - DNA, 601 bp, Human
cctctgcagaaaatcaaatttcaataggaagatgatacaacaagtatctaaacccaggaggagaatttcacttcttctatgggtggccactagctcaggaataaccatggaatctgaacacctgcaagacacctccggacttgcgtgcccctgtatagtgtatactggcttctgatggcacggaggaaaggaatacaaactacctaatagagcttgagaaaaaagaaggcattttaggtaaccccagaataagacaaccatcaagagtctccctcctcgggcatcctaactgccgggtacrcctaaaaattacaactgcatacatttcagagtcactatatttcaaagtttatgaaaagactgggccaaaatcttgggtggcaagcagaggccacctgcacatccagatccatccaggccccactgtattgggcgctctggttgtaattgcctccaccagcttggatgtcagaggagaatctggccttccacaggctggctacagcaatggcaggcatcccttcttagccagtgcctgcttcattggtctgatccagggaaactcctggagaggatcagggacccaccacttgcctcctct

SEQ ID NO: 146771 - DNA, 601 bp, Human
gccaacatggcgaaatcccgtctccactaaaaatacaaaaattagctgggtgtggtggcaggtacctgtagtcccacctacttgggaggctgaggcaggagaatcacttgaacccaggaggcggaggttgcagtgagccgagatcacaccattgcactccagcctgggcaacagagtgagactctgtctcaaatatatatatatgtatatatatataataacggatataacaccaaagctctgattcagatagcttaatatgttgtctctcctatgaaacacaagcaaggtaaatgagggytctatgtaagttgacaataccacaataataagtaatattgtatatgatgaataattatgaaacagttacaatataagagaactccatttttaaagagcagagtccgatgagctacaagtcttctaaaatatgattgtatcttggtagcaaagctaacattagagaagtttgcctattggcagctgagtatttgcaagcttatgcaaatgcttcatttaatgcaggtttctgcatgctccttccaggtagaaaccagaaccatcccagctgactggcagtggggtgggtctcacgccacca

SEQ ID NO: 146772 - DNA, 601 bp, Human
attgaatgttttgatttttcttatatgaataccagaagattttagaaatatctagaggacataaatatcttagccactatattctaaatatatctaccatttaaaatgtacaggattttacttcctcaaaaaattacagccaagggtttcttccttttgtccctggctttaataaattaaccgtaggctactgaggccctccccgcagctttccattcgcctttggtgatgactattccaaaattatctcttatattagtaaagacttacattacctagtctcatattaagagagaaaaataaagcaataatgaggttttttttttctgcctgtcagattgacaaatattttttagattttttttttttttttagttagttccccaactaaaagggccctggtctggcagaaggactttctggggcaatttggttgcatgtggcaaaaatttcaaaacaagtgtctgactgtggaccccaatattacgcttttaggaatttgacagagaaatgaccagacaagtgagcaaaaatacttgtaagcatacaaatttggaaatggcctaaataccacgcaacaaaaggcatggatgttcacatc

SEQ ID NO: 146773 - DNA, 601 bp, Human
cattttatatgatgtttttaggtgaagattttctcaaatttgcattggaggtcataatgtaaaatctaatattaactgaaaacattagtggataaattctgatcactttaaggtttaatctcatccatagtagatgaaaaactcaaagaaattaaccctttcatatcaaatatttttatataaacgtcatcgtaatgatttaaacagtccaaagatatgtacattttaccatgaatgtatatattttccttttaaattaaggcagtaaacaagaattgaatgttttgatttttcttatatraataccagaagattttagaaatatctagaggacataaatatcttagccactatattctaaatatatctaccatttaaaatgtacaggattttacttcctcaaaaaattacagccaagggtttcttccttttgtccctggctttaataaattaaccgtaggctactgaggccctccccgcagctttccattcgcctttggtgatgactattccaaaattatctcttatattagtaaagacttacattacctagtctcatattaagagagaaaaataaagcaataatgaggttttttttttc

SEQ ID NO: 146774 - DNA, 601 bp, Human
attttaaaaagagaaatgaaataaaataatataaaagcatgatttccaaatacattttcttaaataaatcattttatatgatgtttttaggtgaagattttctcaaatttgcattggaggtcataatgtaaaatctaatattaactgaaaacattagtggataaattctgatcactttaaggtttaatctcatccatagtagatgaaaaactcaaagaaattaaccctttcatatcaaatatttttatataaacgtcatcgtaatgatttaaacagtccaaagatatgtacattttaccaygaatgtatatattttccttttaaattaaggcagtaaacaagaattgaatgttttgatttttcttatatgaataccagaagattttagaaatatctagaggacataaatatcttagccactatattctaaatatatctaccatttaaaatgtacaggattttacttcctcaaaaaattacagccaagggtttcttccttttgtccctggctttaataaattaaccgtaggctactgaggccctccccgcagctttccattcgcctttggtgatgactattccaaaattatctcttatatta

SEQ ID NO: 146775 - DNA, 601 bp, Human
gaaaacagaatcattgatgagcggaactggcaaccagggtttttcaattttaaaaagagaaatgaaataaaataatataaaagcatgatttccaaatacattttcttaaataaatcattttatatgatgtttttaggtgaagattttctcaaatttgcattggaggtcataatgtaaaatctaatattaactgaaaacattagtggataaattctgatcactttaaggtttaatctcatccatagtagatgaaaaactcaaagaaattaaccctttcatatcaaatatttttatataaacrtcatcgtaatgatttaaacagtccaaagatatgtacattttaccatgaatgtatatattttccttttaaattaaggcagtaaacaagaattgaatgttttgatttttcttatatgaataccagaagattttagaaatatctagaggacataaatatcttagccactatattctaaatatatctaccatttaaaatgtacaggattttacttcctcaaaaaattacagccaagggtttcttccttttgtccctggctttaataaattaaccgtaggctactgaggccctccccgcagcttt

SEQ ID NO: 146776 - DNA, 601 bp, Human
ggaaaacagaatcattgatgagcggaactggcaaccagggtttttcaattttaaaaagagaaatgaaataaaataatataaaagcatgatttccaaatacattttcttaaataaatcattttatatgatgtttttaggtgaagattttctcaaatttgcattggaggtcataatgtaaaatctaatattaactgaaaacattagtggataaattctgatcactttaaggtttaatctcatccatagtagatgaaaaactcaaagaaattaaccctttcatatcaaatatttttatataaaygtcatcgtaatgatttaaacagtccaaagatatgtacattttaccatgaatgtatatattttccttttaaattaaggcagtaaacaagaattgaatgttttgatttttcttatatgaataccagaagattttagaaatatctagaggacataaatatcttagccactatattctaaatatatctaccatttaaaatgtacaggattttacttcctcaaaaaattacagccaagggtttcttccttttgtccctggctttaataaattaaccgtaggctactgaggccctccccgcagctt

SEQ ID NO: 146777 - DNA, 601 bp, Human
aactttccttgcatattcttactataaagattgtcttgcagaaagcagattaaacatttcttctggtaaaatagagtgtgcctacagtaaattaaaactatttttctctctttaatatctctcattctgtgacgattacaacaaaaatgaatagatttcattttgctttgcacacgcatgacacatgaaaataaagatctctgcaaaatataagttgggggctaattattctccttacaaaagcccagatacttgtcccatcaactgcacacttcctcggaaaacagaatcattgatgagyggaactggcaaccagggtttttcaattttaaaaagagaaatgaaataaaataatataaaagcatgatttccaaatacattttcttaaataaatcattttatatgatgtttttaggtgaagattttctcaaatttgcattggaggtcataatgtaaaatctaatattaactgaaaacattagtggataaattctgatcactttaaggtttaatctcatccatagtagatgaaaaactcaaagaaattaaccctttcatatcaaatatttttatataaacgtcatcgtaatgatttaaacag

SEQ ID NO: 146778 - DNA, 601 bp, Human
agggtcctctccttcctcccccagcgctctcacagacccagggacagcactcttactcacaattccaggtgggccaggaggacctgcttcacccttttctccctacaaaagaaaaaataactttccttgcatattcttactataaagattgtcttgcagaaagcagattaaacatttcttctggtaaaatagagtgtgcctacagtaaattaaaactatttttctctctttaatatctctcattctgtgacgattacaacaaaaatgaatagatttcattttgctttgcacacgcatgacmcatgaaaataaagatctctgcaaaatataagttgggggctaattattctccttacaaaagcccagatacttgtcccatcaactgcacacttcctcggaaaacagaatcattgatgagcggaactggcaaccagggtttttcaattttaaaaagagaaatgaaataaaataatataaaagcatgatttccaaatacattttcttaaataaatcattttatatgatgtttttaggtgaagattttctcaaatttgcattggaggtcataatgtaaaatctaatattaactgaaaacattagt

SEQ ID NO: 146779 - DNA, 601 bp, Human
cttcctctcccagcgctctcacagacccagggtcctctccttcctccccccagtgctctcacagacccagggtcctctccttcctcccccagcgctctcacagacccagggacagcactcttactcacaattccaggtgggccaggaggacctgcttcacccttttctccctacaaaagaaaaaataactttccttgcatattcttactataaagattgtcttgcagaaagcagattaaacatttcttctggtaaaatagagtgtgcctacagtaaattaaaactatttttctctctttartatctctcattctgtgacgattacaacaaaaatgaatagatttcattttgctttgcacacgcatgacacatgaaaataaagatctctgcaaaatataagttgggggctaattattctccttacaaaagcccagatacttgtcccatcaactgcacacttcctcggaaaacagaatcattgatgagcggaactggcaaccagggtttttcaattttaaaaagagaaatgaaataaaataatataaaagcatgatttccaaatacattttcttaaataaatcattttatatgatgtttttag

SEQ ID NO: 146780 - DNA, 601 bp, Human
gccacaggcgagcccagggcaggactggacagagaggagcgcagcgactttgggagggggacgtgggtaactcctccagccagagcaacttcaatggctttttatcaagcgtctgggttaagagaccactaagggttagataaaaggctgtagacagtaaacaaggcttctgtgaggagacatgaagtcacacatttccgagaatccaagaattaagaagagacaaaagggatgcttttaagggtagagtcagagtttttacagaaaagagagaaagtgggagtggacgaaggccctgccytgagccaggcgtgggctgtgtggggtgtcgtctgttcccaataaaggaaaaaagggggctctgcaagaacttagaccagctggaaaggaaacaaatataaaataataaacggggataaaaacaaaaataaatgtaaacatcaaaaacaaagcaaaaagcgtaaaggctgcgaacactccgttgtgtgccaatgctagggcacgtgagcgtttccatcagacgcttatcgggtcagctctgggacctgggagaataccacaggtgcacacgcacacacgtggacacacgtgcatctgcgca

SEQ ID NO: 146781 - DNA, 601 bp, Human
gaactacccgggcacgaggccaaccagaccctcagggtgaggaggacggtcagggagctgggggcgggcagaggcaatggtcaaggccacaggcgagcccagggcaggactggacagagaggagcgcagcgactttgggagggggacgtgggtaactcctccagccagagcaacttcaatggctttttatcaagcgtctgggttaagagaccactaagggttagataaaaggctgtagacagtaaacaaggcttctgtgaggagacatgaagtcacacatttccgagaatccaagaattargaagagacaaaagggatgcttttaagggtagagtcagagtttttacagaaaagagagaaagtgggagtggacgaaggccctgccctgagccaggcgtgggctgtgtggggtgtcgtctgttcccaataaaggaaaaaagggggctctgcaagaacttagaccagctggaaaggaaacaaatataaaataataaacggggataaaaacaaaaataaatgtaaacatcaaaaacaaagcaaaaagcgtaaaggctgcgaacactccgttgtgtgccaatgctagggcacgtgagcgtttcca

SEQ ID NO: 146782 - DNA, 601 bp, Human
ggccggacgcagggcttgagagagtggtggtgcaggaggctgcatggagaaagctctgctgcttctgtgagggacgcaccagcttctgctcccagcatcaggctatgatgaggagagtgtgagaaaaaggacagtcgagggaaacaggacgcaggaagacttggcaggaatgaagagcagcatggagaggagagggaagagcgctgaccaaaggggcacagagcctgagacatccagcctgtcactggggagaaaagccacaagcacaacgtgctccaaggcagccaagagccccgagggrcggcccctgtgggcttccacaaaatactgtgtgcccttcctgagtggtgaatgaggggcagcatgtctaatggagaggaaaatgaaggaactacccgggcacgaggccaaccagaccctcagggtgaggaggacggtcagggagctgggggcgggcagaggcaatggtcaaggccacaggcgagcccagggcaggactggacagagaggagcgcagcgactttgggagggggacgtgggtaactcctccagccagagcaacttcaatggctttttatcaagcgtctgggttaagagacca

SEQ ID NO: 146783 - DNA, 601 bp, Human
agctgaggccggacgcagggcttgagagagtggtggtgcaggaggctgcatggagaaagctctgctgcttctgtgagggacgcaccagcttctgctcccagcatcaggctatgatgaggagagtgtgagaaaaaggacagtcgagggaaacaggacgcaggaagacttggcaggaatgaagagcagcatggagaggagagggaagagcgctgaccaaaggggcacagagcctgagacatccagcctgtcactggggagaaaagccacaagcacaacgtgctccaaggcagccaagagcccygaggggcggcccctgtgggcttccacaaaatactgtgtgcccttcctgagtggtgaatgaggggcagcatgtctaatggagaggaaaatgaaggaactacccgggcacgaggccaaccagaccctcagggtgaggaggacggtcagggagctgggggcgggcagaggcaatggtcaaggccacaggcgagcccagggcaggactggacagagaggagcgcagcgactttgggagggggacgtgggtaactcctccagccagagcaacttcaatggctttttatcaagcgtctgggttaag

SEQ ID NO: 146784 - DNA, 601 bp, Human
ggactcattacgtagatattaaaatctgtgaatttctctcagtgcaaatagtattcccaacatattttaaaaaggctgtagagggtgcactgcatttctacttggccaatgagggcatagaaatgtcattcaacaaagctaaagtggacctggagcaaagggatggtcagtgggttggcaatctagaagaaagagcagaaaatcacaactaaggacacacaagatggttctgtaaaagggtttgaagtcagagtagccattaggtgtgaacatatcaggtcaggttcagccactgtaactytgtaagggtaagaccatgtgcccctgggagagctgaggccggacgcagggcttgagagagtggtggtgcaggaggctgcatggagaaagctctgctgcttctgtgagggacgcaccagcttctgctcccagcatcaggctatgatgaggagagtgtgagaaaaaggacagtcgagggaaacaggacgcaggaagacttggcaggaatgaagagcagcatggagaggagagggaagagcgctgaccaaaggggcacagagcctgagacatccagcctgtcactggggagaaaagccacaag

SEQ ID NO: 146785 - DNA, 601 bp, Human
tgtcttgccatttcatgctgacagtcaaatgtttcctacaaattaacttcaaagaacagggactcattacgtagatattaaaatctgtgaatttctctcagtgcaaatagtattcccaacatattttaaaaaggctgtagagggtgcactgcatttctacttggccaatgagggcatagaaatgtcattcaacaaagctaaagtggacctggagcaaagggatggtcagtgggttggcaatctagaagaaagagcagaaaatcacaactaaggacacacaagatggttctgtaaaagggtytgaagtcagagtagccattaggtgtgaacatatcaggtcaggttcagccactgtaactctgtaagggtaagaccatgtgcccctgggagagctgaggccggacgcagggcttgagagagtggtggtgcaggaggctgcatggagaaagctctgctgcttctgtgagggacgcaccagcttctgctcccagcatcaggctatgatgaggagagtgtgagaaaaaggacagtcgagggaaacaggacgcaggaagacttggcaggaatgaagagcagcatggagaggagagggaagagcgct

SEQ ID NO: 146786 - DNA, 601 bp, Human
acagcccccaacctgggtctgcccggcaccctggcgtctgcttgcaccccacattaaaccatttctgagggaactcacttgtgtagccaggctgcccagggggcccaggggaaccaggaggacccgggagcccatctcttccacttggtcctggcagagatgtaccaggaaatcctcggtcacctttttctcctctttcaccagggaagccaggggcaccagcctgcccaggtacagggaggcctgcaaccagacagaagctcacatcagtaacctcagggccacttagcaactacagcayaaactcattctcctaactctgttcaaggtaaaaatccaaccagaccatcactgaaaagggaactgctttagacatgtaaaaccaaattaagctggcaggtgtcttgccatttcatgctgacagtcaaatgtttcctacaaattaacttcaaagaacagggactcattacgtagatattaaaatctgtgaatttctctcagtgcaaatagtattcccaacatattttaaaaaggctgtagagggtgcactgcatttctacttggccaatgagggcatagaaatgtcattcaacaaagctaa

SEQ ID NO: 146787 - DNA, 601 bp, Human
actctggctgtgggggactatcacagcccccaacctgggtctgcccggcaccctggcgtctgcttgcaccccacattaaaccatttctgagggaactcacttgtgtagccaggctgcccagggggcccaggggaaccaggaggacccgggagcccatctcttccacttggtcctggcagagatgtaccaggaaatcctcggtcacctttttctcctctttcaccagggaagccaggggcaccagcctgcccaggtacagggaggcctgcaaccagacagaagctcacatcagtaacctcasggccacttagcaactacagcataaactcattctcctaactctgttcaaggtaaaaatccaaccagaccatcactgaaaagggaactgctttagacatgtaaaaccaaattaagctggcaggtgtcttgccatttcatgctgacagtcaaatgtttcctacaaattaacttcaaagaacagggactcattacgtagatattaaaatctgtgaatttctctcagtgcaaatagtattcccaacatattttaaaaaggctgtagagggtgcactgcatttctacttggccaatgagggcatag

SEQ ID NO: 146788 - DNA, 601 bp, Human
tgctttttaactttagatgccaggagtctcagaggtggttaacgtgttatttactccgttaaaccagctttattttgaaattttaactattgctttttgtagcatggttcattctctgaagattcccttagaggaatatggatgattagaagaatccacgcctttctattacactctggctgtgggggactatcacagcccccaacctgggtctgcccggcaccctggcgtctgcttgcaccccacattaaaccatttctgagggaactcacttgtgtagccaggctgcccagggggcccrggggaaccaggaggacccgggagcccatctcttccacttggtcctggcagagatgtaccaggaaatcctcggtcacctttttctcctctttcaccagggaagccaggggcaccagcctgcccaggtacagggaggcctgcaaccagacagaagctcacatcagtaacctcagggccacttagcaactacagcataaactcattctcctaactctgttcaaggtaaaaatccaaccagaccatcactgaaaagggaactgctttagacatgtaaaaccaaattaagctggcaggtgtcttg

SEQ ID NO: 146789 - DNA, 601 bp, Human
acaggttggcttaaatccttggagattttcttcgaatttgctttggtattgtattgggaccacacggccatcttaattgagtcaagacttccatgttacatgttcaccttttctggaataaaagctggcttttctggactttactaatgtaatctttacccatgtaatcctgtcttccttgtttctggggtgtgtgtgtgtgtgtgtgtgtgtgtgtgtgtgtgtgtgtcctagtattcatttgtatctctagatgaagaagaatgcattctgttttcaataaaaattacataactcaacwgttttgctttttaactttagatgccaggagtctcagaggtggttaacgtgttatttactccgttaaaccagctttattttgaaattttaactattgctttttgtagcatggttcattctctgaagattcccttagaggaatatggatgattagaagaatccacgcctttctattacactctggctgtgggggactatcacagcccccaacctgggtctgcccggcaccctggcgtctgcttgcaccccacattaaaccatttctgagggaactcacttgtgtagccaggctgcccagggg

SEQ ID NO: 146790 - DNA, 601 bp, Human
cacactcccattgcacaggttggcttaaatccttggagattttcttcgaatttgctttggtattgtattgggaccacacggccatcttaattgagtcaagacttccatgttacatgttcaccttttctggaataaaagctggcttttctggactttactaatgtaatctttacccatgtaatcctgtcttccttgtttctggggtgtgtgtgtgtgtgtgtgtgtgtgtgtgtgtgtgtgtgtcctagtattcatttgtatctctagatgaagaagaatgcattctgttttcaataaaaaytacataactcaacagttttgctttttaactttagatgccaggagtctcagaggtggttaacgtgttatttactccgttaaaccagctttattttgaaattttaactattgctttttgtagcatggttcattctctgaagattcccttagaggaatatggatgattagaagaatccacgcctttctattacactctggctgtgggggactatcacagcccccaacctgggtctgcccggcaccctggcgtctgcttgcaccccacattaaaccatttctgagggaactcacttgtgtagcc

SEQ ID NO: 146791 - DNA, 601 bp, Human
accattggctccctcacccccttcatgtctttgtaaatcactctgcttaaaaccacaatcccctgcccaccccccaccccagaaccctctgttgactctcctgcttaagtttatccctggacttatcatctcctgcattcatgagaattcccttgtcttgggtaacccctgtcagccccatggaatacttgctccaggacagcaggatctgttgagtcttgtcaccactgctagatctctgcctcccaggcactcccttccccgctgaatgaatctggaacccaaaggccccttggtcagrgctcacaaccttctctcagacacacagagaaaaggagcctctggattgagtgtctccaggactgcaatattttatcttcatttcccatgtttcacacaatcacaagagcagaggagaaaagttccccaaagtcacacatgatctgttctttctcctacccaaattcatgtagatcacattccccatcgaagctgccaggctggaatccatggctccatctagtcctggcccagcccccaacagtggcctcatccatgagaactccctttcgtaaagatttgcttgaattctagcaaataa

SEQ ID NO: 146792 - DNA, 601 bp, Human
tccctgacaaaaaaacaaaaaacaaaaaacaaacaaacaaaaaaaaaatagtacatcctcaccaaagtccatttaaattcattttatgcagtgattatttctgaggagttctaaagtgcaaatctagagtttacattttacaacgccttctcatcaagggtatctgcagccacagatggtttagagctggctgtacccacttgagacaagaatgcagtggcagaacttacatgcacaaatggctgcattgtgtggttaatgctctatcgataagtcctgaggtagcaatggctttaagatrtagcctctttaacatacattataaatcttagtacaaatctcatttctaaattattactcgatactctgtgattgagaattacttaatttacgtggactaaaaaggccacctagaaaacctggaatagtaaatattacaatgtgctcagctaacacatcccattcaattaacaagagtgtaaagttcatatttttacatgacgtgtgtttatatttcatcacttgcaaaattacgaacatccaaaagaatgtccttttcccagatttccccaccattggctccctcacccccttcatgtct

SEQ ID NO: 146793 - DNA, 601 bp, Human
ttccagagcataactcctgcctgcttcagctcaaccagaatcccttcatatccctgacaaaaaaacaaaaaacaaaaaacaaacaaacaaaaaaaaaatagtacatcctcaccaaagtccatttaaattcattttatgcagtgattatttctgaggagttctaaagtgcaaatctagagtttacattttacaacgccttctcatcaagggtatctgcagccacagatggtttagagctggctgtacccacttgagacaagaatgcagtggcagaacttacatgcacaaatggctgcattgygtggttaatgctctatcgataagtcctgaggtagcaatggctttaagatgtagcctctttaacatacattataaatcttagtacaaatctcatttctaaattattactcgatactctgtgattgagaattacttaatttacgtggactaaaaaggccacctagaaaacctggaatagtaaatattacaatgtgctcagctaacacatcccattcaattaacaagagtgtaaagttcatatttttacatgacgtgtgtttatatttcatcacttgcaaaattacgaacatccaaaagaatg

SEQ ID NO: 146794 - DNA, 601 bp, Human
actgttatactccttttccagagcataactcctgcctgcttcagctcaaccagaatcccttcatatccctgacaaaaaaacaaaaaacaaaaaacaaacaaacaaaaaaaaaatagtacatcctcaccaaagtccatttaaattcattttatgcagtgattatttctgaggagttctaaagtgcaaatctagagtttacattttacaacgccttctcatcaagggtatctgcagccacagatggtttagagctggctgtacccacttgagacaagaatgcagtggcagaacttacatgcamaaatggctgcattgtgtggttaatgctctatcgataagtcctgaggtagcaatggctttaagatgtagcctctttaacatacattataaatcttagtacaaatctcatttctaaattattactcgatactctgtgattgagaattacttaatttacgtggactaaaaaggccacctagaaaacctggaatagtaaatattacaatgtgctcagctaacacatcccattcaattaacaagagtgtaaagttcatatttttacatgacgtgtgtttatatttcatcacttgcaaaattacga

SEQ ID NO: 146795 - DNA, 601 bp, Human
cgttagcccttcgacattggtgcagctggcaccatcgtcttaaacaaagtggactccatgtttatgcttcaaagagcagcccctaaattacttcactgaaagaacccacatctctcatccctgtgagcctagggtatactaattccttgactctagaaatgtatgctcaagaatattgagagacatgtaactgttatactccttttccagagcataactcctgcctgcttcagctcaaccagaatcccttcatatccctgacaaaaaaacaaaaaacaaaaaacaaacaaacaaaaaaaacatagtacatcctcaccaaagtccatttaaattcattttatgcagtgattatttctgaggagttctaaagtgcaaatctagagtttacattttacaacgccttctcatcaagggtatctgcagccacagatggtttagagctggctgtacccacttgagacaagaatgcagtggcagaacttacatgcacaaatggctgcattgtgtggttaatgctctatcgataagtcctgaggtagcaatggctttaagatgtagcctctttaacatacattataaatcttagtacaaatctcatttc

SEQ ID NO: 146796 - DNA, 601 bp, Human
gctcagcagaacaagttagcttccgctgtgtaggaactatgggggaggtgcttttgctttgcttgttgcttatgtgcttatgtgtctttccctgagtttctccccacaaagcacaggaggcaagaaagcccaagtggggtcaccatgggtcccccacagccactgctagggacctgctcctggtgactctggtcctgcctggctcctcgttagcccttcgacattggtgcagctggcaccatcgtcttaaacaaagtggactccatgtttatgcttcaaagagcagcccctaaattacttyactgaaagaacccacatctctcatccctgtgagcctagggtatactaattccttgactctagaaatgtatgctcaagaatattgagagacatgtaactgttatactccttttccagagcataactcctgcctgcttcagctcaaccagaatcccttcatatccctgacaaaaaaacaaaaaacaaaaaacaaacaaacaaaaaaaaaatagtacatcctcaccaaagtccatttaaattcattttatgcagtgattatttctgaggagttctaaagtgcaaatctagagtttacatttta

SEQ ID NO: 146797 - DNA, 601 bp, Human
gaaccagaatgcctaaaaagatcccacaccttgtttgatgacttggtttagagctcagcagaacaagttagcttccgctgtgtaggaactatgggggaggtgcttttgctttgcttgttgcttatgtgcttatgtgtctttccctgagtttctccccacaaagcacaggaggcaagaaagcccaagtggggtcaccatgggtcccccacagccactgctagggacctgctcctggtgactctggtcctgcctggctcctcgttagcccttcgacattggtgcagctggcaccatcgtcttraacaaagtggactccatgtttatgcttcaaagagcagcccctaaattacttcactgaaagaacccacatctctcatccctgtgagcctagggtatactaattccttgactctagaaatgtatgctcaagaatattgagagacatgtaactgttatactccttttccagagcataactcctgcctgcttcagctcaaccagaatcccttcatatccctgacaaaaaaacaaaaaacaaaaaacaaacaaacaaaaaaaaaatagtacatcctcaccaaagtccatttaaattcattttatg

SEQ ID NO: 146798 - DNA, 601 bp, Human
ggccccagggtgtggagtggggctgtggggccctccctcgggcttgaatatattaaccaaggtcaactctccagctcgcccaccccagctagaaccagaatgcctaaaaagatcccacaccttgtttgatgacttggtttagagctcagcagaacaagttagcttccgctgtgtaggaactatgggggaggtgcttttgctttgcttgttgcttatgtgcttatgtgtctttccctgagtttctccccacaaagcacaggaggcaagaaagcccaagtggggtcaccatgggtcccccacrgccactgctagggacctgctcctggtgactctggtcctgcctggctcctcgttagcccttcgacattggtgcagctggcaccatcgtcttaaacaaagtggactccatgtttatgcttcaaagagcagcccctaaattacttcactgaaagaacccacatctctcatccctgtgagcctagggtatactaattccttgactctagaaatgtatgctcaagaatattgagagacatgtaactgttatactccttttccagagcataactcctgcctgcttcagctcaaccagaatcccttc

SEQ ID NO: 146799 - DNA, 601 bp, Human
atgcaccagcactgaaggccctcccctctcccttacagggtcttcacctaatgacaaagtcatgggcagtctctgttcagctgtcacctggacgccctgagtcccagactatagaagggccccagggtgtggagtggggctgtggggccctccctcgggcttgaatatattaaccaaggtcaactctccagctcgcccaccccagctagaaccagaatgcctaaaaagatcccacaccttgtttgatgacttggtttagagctcagcagaacaagttagcttccgctgtgtaggaactatrggggaggtgcttttgctttgcttgttgcttatgtgcttatgtgtctttccctgagtttctccccacaaagcacaggaggcaagaaagcccaagtggggtcaccatgggtcccccacagccactgctagggacctgctcctggtgactctggtcctgcctggctcctcgttagcccttcgacattggtgcagctggcaccatcgtcttaaacaaagtggactccatgtttatgcttcaaagagcagcccctaaattacttcactgaaagaacccacatctctcatccctgtgagcctaggg

SEQ ID NO: 146800 - DNA, 601 bp, Human
attgtttattgttttatgatttggatacacactgagatggagtttatatttccttccccaagatccttgaagaaaaaagacacagtgaacaacttggtatccagcatccctgcccaggcataaccctaacactcatgcaccagcactgaaggccctcccctctcccttacagggtcttcacctaatgacaaagtcatgggcagtctctgttcagctgtcacctggacgccctgagtcccagactatagaagggccccagggtgtggagtggggctgtggggccctccctcgggcttgaatrtattaaccaaggtcaactctccagctcgcccaccccagctagaaccagaatgcctaaaaagatcccacaccttgtttgatgacttggtttagagctcagcagaacaagttagcttccgctgtgtaggaactatgggggaggtgcttttgctttgcttgttgcttatgtgcttatgtgtctttccctgagtttctccccacaaagcacaggaggcaagaaagcccaagtggggtcaccatgggtcccccacagccactgctagggacctgctcctggtgactctggtcctgcctggctcct

SEQ ID NO: 146801 - DNA, 601 bp, Human
ccctctaacccaatttacagcaaaactaatcattattttagagctgcagactgcccacgaggaaatgcctcaaattgttcacattcaattctgagcatcatttatgtaaagaggcataaaaataaactgcagtaatgtacacaccatctgtcctaggttctagtaaaaaatatcagtattgtttattgttttatgatttggatacacactgagatggagtttatatttccttccccaagatccttgaagaaaaaagacacagtgaacaacttggtatccagcatccctgcccaggcataaycctaacactcatgcaccagcactgaaggccctcccctctcccttacagggtcttcacctaatgacaaagtcatgggcagtctctgttcagctgtcacctggacgccctgagtcccagactatagaagggccccagggtgtggagtggggctgtggggccctccctcgggcttgaatatattaaccaaggtcaactctccagctcgcccaccccagctagaaccagaatgcctaaaaagatcccacaccttgtttgatgacttggtttagagctcagcagaacaagttagcttccgctgtg

SEQ ID NO: 146802 - DNA, 601 bp, Human
attttcttccttttttccccctctaacccaatttacagcaaaactaatcattattttagagctgcagactgcccacgaggaaatgcctcaaattgttcacattcaattctgagcatcatttatgtaaagaggcataaaaataaactgcagtaatgtacacaccatctgtcctaggttctagtaaaaaatatcagtattgtttattgttttatgatttggatacacactgagatggagtttatatttccttccccaagatccttgaagaaaaaagacacagtgaacaacttggtatccagcrtccctgcccaggcataaccctaacactcatgcaccagcactgaaggccctcccctctcccttacagggtcttcacctaatgacaaagtcatgggcagtctctgttcagctgtcacctggacgccctgagtcccagactatagaagggccccagggtgtggagtggggctgtggggccctccctcgggcttgaatatattaaccaaggtcaactctccagctcgcccaccccagctagaaccagaatgcctaaaaagatcccacaccttgtttgatgacttggtttagagctcagcagaac

SEQ ID NO: 146803 - DNA, 601 bp, Human
ctcctccagacagctctctgctaatgggtggaaactgcagtcaaacgcacgtccctgtctgtcaatgaacgggcccactgcccccagcacgcgtcacgtgtgaccacagacgcactgcttaaagatccaagttcttctcccagcgaaaagacagggctgcctcagtaaaaagtggtccagaaattcaactgtgcctatcagcctgaaaagacttgacttttgtaatttgtctgtaatgtgaaaactacccatcccctttctctttggttgagtgcttagtccagttcatggacttcactgrttggtggacttgggaataagaagccacaaaagcaagaacacatatgtgatccaggacagaagaggagagagactgcagccctgaaaaaggagaggagatgctcttctttggaaattctaacatctgaagtcttgattttcaagccaagctcagagaccttacattgtcttagctattcctgtgtcttaaatattgaaatgtctggtttctaggcacaaatcaggcataatacagagcaaaaagtgctcgcagagaagcccatgccagggacatcgaggcggcgtggccatgttcttccca

SEQ ID NO: 146804 - DNA, 601 bp, Human
ggcaatggctcctccagacagctctctgctaatgggtggaaactgcagtcaaacgcacgtccctgtctgtcaatgaacgggcccactgcccccagcacgcgtcacgtgtgaccacagacgcactgcttaaagatccaagttcttctcccagcgaaaagacagggctgcctcagtaaaaagtggtccagaaattcaactgtgcctatcagcctgaaaagacttgacttttgtaatttgtctgtaatgtgaaaactacccatcccctttctctttggttgagtgcttagtccagttcatggasttcactggttggtggacttgggaataagaagccacaaaagcaagaacacatatgtgatccaggacagaagaggagagagactgcagccctgaaaaaggagaggagatgctcttctttggaaattctaacatctgaagtcttgattttcaagccaagctcagagaccttacattgtcttagctattcctgtgtcttaaatattgaaatgtctggtttctaggcacaaatcaggcataatacagagcaaaaagtgctcgcagagaagcccatgccagggacatcgaggcggcgtggccatgt

SEQ ID NO: 146805 - DNA, 601 bp, Human
gggaggcccccgatatccgtctatatcacagatgaggcaactctctcctttttgacctaaaaaagaaaacacaaaggtgcttacgtgtaacatgtgaccagaagtctccgcagtgcactgagagaacagaaaaaggcaaggctgtcactaacatattacatccaaacttaggtttgctcagtggcaatggctcctccagacagctctctgctaatgggtggaaactgcagtcaaacgcacgtccctgtctgtcaatgaacgggcccactgcccccagcacgcgtcacgtgtgaccacagaygcactgcttaaagatccaagttcttctcccagcgaaaagacagggctgcctcagtaaaaagtggtccagaaattcaactgtgcctatcagcctgaaaagacttgacttttgtaatttgtctgtaatgtgaaaactacccatcccctttctctttggttgagtgcttagtccagttcatggacttcactggttggtggacttgggaataagaagccacaaaagcaagaacacatatgtgatccaggacagaagaggagagagactgcagccctgaaaaaggagaggagatgctcttctttg

SEQ ID NO: 146806 - DNA, 601 bp, Human
aatgtggacaaatcctggaagtggggcccaacattcttctgattatgctttaggattggctgccgaaaatcaggccttctatggagtgaaatccctttcacaggaaagatgccaacacaccaaagcaaactctgacctggtccttttcacatgtgggtcttacctatttctcccgggggtccctgtggcccgggaggcccccgatatccgtctatatcacagatgaggcaactctctcctttttgacctaaaaaagaaaacacaaaggtgcttacgtgtaacatgtgaccagaagtctccrcagtgcactgagagaacagaaaaaggcaaggctgtcactaacatattacatccaaacttaggtttgctcagtggcaatggctcctccagacagctctctgctaatgggtggaaactgcagtcaaacgcacgtccctgtctgtcaatgaacgggcccactgcccccagcacgcgtcacgtgtgaccacagacgcactgcttaaagatccaagttcttctcccagcgaaaagacagggctgcctcagtaaaaagtggtccagaaattcaactgtgcctatcagcctgaaaagacttgacttt

SEQ ID NO: 146807 - DNA, 601 bp, Human
gagtaataactaaaatgcccaagacggactcagaaagggaataggtgacccgacgcacatgtacacccggaagcaggaatgcttccagcaccccacacctgcccccctgcccacacacccagggaccacttaaaggaaaaacatgaattccattaactgcttgtgagataacagaatctgtggcatggagggaactgttatgctgctgtcttttattaggaaatctttatgaggccatcttgatcattcccagcaatgtggacaaatcctggaagtggggcccaacattcttctgattatrctttaggattggctgccgaaaatcaggccttctatggagtgaaatccctttcacaggaaagatgccaacacaccaaagcaaactctgacctggtccttttcacatgtgggtcttacctatttctcccgggggtccctgtggcccgggaggcccccgatatccgtctatatcacagatgaggcaactctctcctttttgacctaaaaaagaaaacacaaaggtgcttacgtgtaacatgtgaccagaagtctccgcagtgcactgagagaacagaaaaaggcaaggctgtcactaacatat

SEQ ID NO: 146808 - DNA, 601 bp, Human
cttggataatccaaagagagtaataactaaaatgcccaagacggactcagaaagggaataggtgacccgacgcacatgtacacccggaagcaggaatgcttccagcaccccacacctgcccccctgcccacacacccagggaccacttaaaggaaaaacatgaattccattaactgcttgtgagataacagaatctgtggcatggagggaactgttatgctgctgtcttttattaggaaatctttatgaggccatcttgatcattcccagcaatgtggacaaatcctggaagtggggcccracattcttctgattatgctttaggattggctgccgaaaatcaggccttctatggagtgaaatccctttcacaggaaagatgccaacacaccaaagcaaactctgacctggtccttttcacatgtgggtcttacctatttctcccgggggtccctgtggcccgggaggcccccgatatccgtctatatcacagatgaggcaactctctcctttttgacctaaaaaagaaaacacaaaggtgcttacgtgtaacatgtgaccagaagtctccgcagtgcactgagagaacagaaaaaggcaa

SEQ ID NO: 146809 - DNA, 601 bp, Human
tcttaagactcaaaagcataaaaatctgtataggaagtggatgattgcttggataatccaaagagagtaataactaaaatgcccaagacggactcagaaagggaataggtgacccgacgcacatgtacacccggaagcaggaatgcttccagcaccccacacctgcccccctgcccacacacccagggaccacttaaaggaaaaacatgaattccattaactgcttgtgagataacagaatctgtggcatggagggaactgttatgctgctgtcttttattaggaaatctttatgaggccrtcttgatcattcccagcaatgtggacaaatcctggaagtggggcccaacattcttctgattatgctttaggattggctgccgaaaatcaggccttctatggagtgaaatccctttcacaggaaagatgccaacacaccaaagcaaactctgacctggtccttttcacatgtgggtcttacctatttctcccgggggtccctgtggcccgggaggcccccgatatccgtctatatcacagatgaggcaactctctcctttttgacctaaaaaagaaaacacaaaggtgcttacgtgtaaca

SEQ ID NO: 146810 - DNA, 601 bp, Human
ccagagggctcgacacagcaacacttaccagctcccacacaaggcagaagccatgcttgcaaatgcaaaacgacacaactctgtccacgtgcttggtggcaacttctgatatgtacatgaactcagacaggtttacttactggcactcctgcaacaccatctctgccaggcaaacctctgtcgcccttggcccctggctgccctgggaaacctttcgtgagagagagggaaaaagacagcaacacagcattcatgagacacttctcaaaaccttttcttaagactcaaaagcataaaaatytgtataggaagtggatgattgcttggataatccaaagagagtaataactaaaatgcccaagacggactcagaaagggaataggtgacccgacgcacatgtacacccggaagcaggaatgcttccagcaccccacacctgcccccctgcccacacacccagggaccacttaaaggaaaaacatgaattccattaactgcttgtgagataacagaatctgtggcatggagggaactgttatgctgctgtcttttattaggaaatctttatgaggccatcttgatcattcccagcaatgtgga

SEQ ID NO: 146811 - DNA, 601 bp, Human
gtgcaatggcgccatctcggctcaccgcaacctccgcctctcaggttcaagagattctcctgcctcagccttccgagcagctgggattataggcatacgccaccacacccagttaattttgtatttttagtggagacggggtttctccatgttggtcaggccggtctcgaactcccgacctcaggtgatccgcccgcctcggcctcccaaagtgctgggatttcaggcgtgagccaccgtacccagcagtgactgcatttcaaagactcaacagccaccactggccagcagctgccagatsagatggcactgacgtagcacgctcctgtcatggcagaagcttctcatggacgactaccagtggtctgagctggccccgcactctaatgccccttatgacctgggacacttcacttggatctactcaggaaaggtggaacacacccagtctatttgctctgggtcccaggaaaggcaacaaattatttctatgagccacctgccagaaattgtagcagagagtcatggaaaatttgttatttacttgaaaggtgttgtgggatttttaaactgtttctcttgagttaatattagctcctat

SEQ ID NO: 146812 - DNA, 601 bp, Human
cacagggggagaggtggggcttgaaggacttctgtgtcctgctcaaagtcaaacaaacagcaaatgtgggactaacctaaatggagcagacttgctttcctgcctgaattgcttcctaacagctgaaacatcgcaggctaaggaacgggagaagctgctctgcctcccattccatcttccataccaaccacgatgcactgactcctggcccaatcccatcaagcaggcttccagaagtatggagagagtcggcagcaactctctgcactgttcaatatgacttggaaagttaaattaaataacacaaaaaatgcagttcctccattacagtgactacatttgtttttgttttttgttttgttttgttttttgcttgttttgttttgttgagacagattttcgctcttgttgcccaggctggagtgcaatggcgccatctcggctcaccgcaacctccgcctctcaggttcaagagattctcctgcctcagccttccgagcagctgggattataggcatacgccaccacacccagttaattttgtatttttagtggagacggggtttctccatgttggtcaggccggtctcgaactcccgac

SEQ ID NO: 146813 - DNA, 601 bp, Human
taaaatgagttatgttgagtcagcagagtcaaattgactttcccaagagactcacactagaacgttgctcagttcctggaaagttaaaactgcaaagaacacccatacccaccaatggcttctcctccagcatcctgagacttgggtttcacaagaaaaacagaaaatgtttccaacaattgtcccattgacttgttcacttaggcctgagaaaggcatcttcagactccctgtcgacttggcagaattttaactctggcacaattcacttaatgtgaattttttttcataaacttccttkcagaaggttcttagatatgtatgaatccctcacatgcacacgcttctgtgtgtacagatgctatgtgcttctcaaaggaagaagttggtcaaccaaggacagaccaacatttgcccaatctttagactgaaaatatggctagcattggttaccagcctgctaggcactatgacccattctatagcatctctgacccttattgcagctctgcaaggaaaacatggaaaccaggacatagcagaggaagaagctgatactcaaagaagtgagctgatagatccaagactactcagccagaaa

SEQ ID NO: 146814 - DNA, 601 bp, Human
ctgcctcagccccaccggcagcacgcagaagccttttctccagcttctgggcccactgagctacccgtcagcacctcctggccagtgctgaatactcctgtgcatattgaacaggcttccttttatgctcatgcccagaattccagaagagataaggacttccagggcaccagtgagagatgaaactctgggagtgggcactgggccagctctaaaatgagttatgttgagtcagcagagtcaaattgactttcccaagagactcacactagaacgttgctcagttcctggaaagttaaawctgcaaagaacacccatacccaccaatggcttctcctccagcatcctgagacttgggtttcacaagaaaaacagaaaatgtttccaacaattgtcccattgacttgttcacttaggcctgagaaaggcatcttcagactccctgtcgacttggcagaattttaactctggcacaattcacttaatgtgaattttttttcataaacttccttgcagaaggttcttagatatgtatgaatccctcacatgcacacgcttctgtgtgtacagatgctatgtgcttctcaaaggaagaagttgg

SEQ ID NO: 146815 - DNA, 601 bp, Human
ccagtgtgactgtaacacaagcaaccatagaatcaagaagccaccttcttgaaaatggtcatgcattcatgcctcatcattgattttctagatgcaagccaggagctctgtgacaaagccctggtctgctgcacttcttgtgtttttcttaaaaacacttatcttaattagatatttcaagcaaagacctggatggggcagagggagttatagtgtggctttgggcacccagctctcctccaggagttttcttaccctaacaactgctcaacattcataggaacacacagcacctgtcagraggttctgattgatgtgtggttcattgtgcagcttcagtaacagacagactcaaagaacaatcgctgtcctcagctctgcctgctgcctcagccccaccggcagcacgcagaagccttttctccagcttctgggcccactgagctacccgtcagcacctcctggccagtgctgaatactcctgtgcatattgaacaggcttccttttatgctcatgcccagaattccagaagagataaggacttccagggcaccagtgagagatgaaactctgggagtgggcactgggccagctctaaaa

SEQ ID NO: 146816 - DNA, 601 bp, Human
ctttagagaatgagatgttgatacctggaatcttttgaaaacaatgacatgaatactattaactttagatttcacctcccatccaaagcaaaaagatacacaaacacatctgttcagttcccccaaatgcatcagaagacactgatctgttatcacctaattatttgtcaataataactggcaatgcctaggtttatagacttaagttgttccatgaaccatgaatcatgaaacaagttcatttgtgccatcatcaaggagatagaaatacatcaatatgattcaaattactcatttctcratgctttgcagatccacactgtaaaatgcacattcaaagtctggagataaacataccggcgagcccttggggccaggaagacccggatggccatctcttccaggagaacccgctctccctggcatgccgggctgtcctggaaagcctgggtctcctttgtcacctttgagccgcaagtcgaaataaaactcaccaggctcccccttggctcctggctggcctatcagccctggtgtaccttgagggccctgtaagaacaaagccttgtgatccacagaagaacccatccatgaagcacac

SEQ ID NO: 146817 - DNA, 601 bp, Human
agccaaatgggtaaggagaggaaaatgacttgacctcggtgtgacttctatacaaaggctgactttagctggtgcgtgctgtgtacttacttatgaggactgtaaacccaagttctccacctgcatattacctggcccatcacatacatgaggaaagggaggcacaaaaggctgaaggcttgcccaggtcctgccccaattcctggaagaatcaaagccaagtgtgcgccctggcctatgcgaaccccaggcctctgtgtgcacccgaggtgcctgccctaacctccgtttacaacttcaygctgcatcacgagtttctcaggcctcacctggcaggcctggggatccagggcctccaggaaagcctgcttgtcctttgtcaccaatgggaccagcaggaccatatcctggaggcccaggggggccggtgtcaccacgactgcctgggaatccaactcctccaggggggccacgctctcctttcaatcctacagaaccctgatgtgagaagaagaaaaagacaccgttatcagagacacaccaacaccctgtccttatcgcattcttctgacatttgtggtcaataagtactagagttaac

SEQ ID NO: 146818 - DNA, 601 bp, Human
gtggagatcacaccactcgggatgcacagaagccaaaatgggctgctcatcggggaaagccaaatgggtaaggagaggaaaatgacttgacctcggtgtgacttctatacaaaggctgactttagctggtgcgtgctgtgtacttacttatgaggactgtaaacccaagttctccacctgcatattacctggcccatcacatacatgaggaaagggaggcacaaaaggctgaaggcttgcccaggtcctgccccaattcctggaagaatcaaagccaagtgtgcgccctggcctatgcgarccccaggcctctgtgtgcacccgaggtgcctgccctaacctccgtttacaacttcatgctgcatcacgagtttctcaggcctcacctggcaggcctggggatccagggcctccaggaaagcctgcttgtcctttgtcaccaatgggaccagcaggaccatatcctggaggcccaggggggccggtgtcaccacgactgcctgggaatccaactcctccaggggggccacgctctcctttcaatcctacagaaccctgatgtgagaagaagaaaaagacaccgttatcagagacacaccaa

SEQ ID NO: 146819 - DNA, 601 bp, Human
ctagcctctcctcttctcattccgggattttctagggaagaacaggcgtgctccatgtctactgggaatcgcagtcagataataaactattagcacctgctgtgtgcaaggcctagcgccacagccccctcccgctggccctgaaaataagcaagtcgtgggagaggagaacgacgagggagcccacactcatccctgctacaggttctctggaaaacctctgaacaggctgtgcaggagggcagggaccacgtctgtggttttgaccatgtgttgtcaatgctcagcatagagcttggcrcgtgattcactccaaaaacagcagacaactaaaaccaccatggaatgaaatcgtcatcgcgctgtaggacctctaaatccattcacaggcgtctgccgactgtgaagaggtggagatcacaccactcgggatgcacagaagccaaaatgggctgctcatcggggaaagccaaatgggtaaggagaggaaaatgacttgacctcggtgtgacttctatacaaaggctgactttagctggtgcgtgctgtgtacttacttatgaggactgtaaacccaagttctccacctgcatattacctg

SEQ ID NO: 146820 - DNA, 601 bp, Human
accttgtgatctgccagcctctgcctcccaaagtgctgggattacaggcgtgagccaccgcacctggccccagctactttataaataactatgttttttaaggtttactagttagatatttttaatcaccttaagtcctttcactcacttttacaacttttgaatgtttcctagcaacgcgcatttacttccctcatctacacacaaggcattcctagcctctcctcttctcattccgggattttctagggaagaacaggcgtgctccatgtctactgggaatcgcagtcagataataaaytattagcacctgctgtgtgcaaggcctagcgccacagccccctcccgctggccctgaaaataagcaagtcgtgggagaggagaacgacgagggagcccacactcatccctgctacaggttctctggaaaacctctgaacaggctgtgcaggagggcagggaccacgtctgtggttttgaccatgtgttgtcaatgctcagcatagagcttggcgcgtgattcactccaaaaacagcagacaactaaaaccaccatggaatgaaatcgtcatcgcgctgtaggacctctaaatccattcac

SEQ ID NO: 146821 - DNA, 601 bp, Human
gtgatctgcccaccttggcctcccaaagtgctgggattacaggcatgagccagcgtgcccagcctatacactgtatattaataaggaaatattagtccctaatgggaataggaattcataaaacaggctcaatatggttattgacataatcagcacacttgcgagccagaacggcatgctgtaattgctccaacgtggttattgttgggtatttcaaatatccagctactttatttatttatttatttatttatttttgagacggagtctcactctgtcacccaggctggagtgcagtggygagatcttggctctctacaacctctgcctcccgggttcaagcgattctcctgcctcagcctccagagtagctgggactataggtgcctgccaccatgcccagctaacttttgtatttttagtagagatggggtttcaccatattggccaggctggtctccaatgtctgaccttgtgatctgccagcctctgcctcccaaagtgctgggattacaggcgtgagccaccgcacctggccccagctactttataaataactatgttttttaaggtttactagttagatatttttaatcacctt

SEQ ID NO: 146822 - DNA, 601 bp, Human
ggctctggatggccaaggagccctacagctgtggggagagaggatcaacagccctgttccccctccccagaagccttcttccccatctgctagggtatatttgtgagtactccagttggtttctctgatggtagtttctcgccaaaagaaaagctaattcccttcgacagctctggaaatctgcagatgtcacaagcacaaagacagcacttgatttgttgattgtggaatcaagagacccaagggaaagtgatcggaagtccctatgcctggctcaccgaagtcctcctccatcaaaccyggtatcccctacctctaatggagtcataaaagagacatttctgggacgcttctaaacaaagaacaaccatcaacagagtcagaacttgatgctaagtactcactgattataccaacagggagaaggataagagtaacagttatgttagcacactacacctgggcttccatcaaacactggctgacatttcccatactggaatgcttaggaactggactgtgtgtgtgtgtgtgtgtgtgttttgtttgtttgtttgtttgtttttgagacagtgtcttgctctgtcatccaggctggaat

SEQ ID NO: 146823 - DNA, 601 bp, Human
acattctttagctacagactgtgggaaacgccaactgaacgaccctaggaaatgcctgctgttggtgacacacaccctgggcaccaggcttttatgattaccacagttacacacagctctggcagatcaaagacatctgttttctaatctcgaagctaattggctctggatggccaaggagccctacagctgtggggagagaggatcaacagccctgttccccctccccagaagccttcttccccatctgctagggtatatttgtgagtactccagttggtttctctgatggtagtttctygccaaaagaaaagctaattcccttcgacagctctggaaatctgcagatgtcacaagcacaaagacagcacttgatttgttgattgtggaatcaagagacccaagggaaagtgatcggaagtccctatgcctggctcaccgaagtcctcctccatcaaacccggtatcccctacctctaatggagtcataaaagagacatttctgggacgcttctaaacaaagaacaaccatcaacagagtcagaacttgatgctaagtactcactgattataccaacagggagaaggataagagtaacag

SEQ ID NO: 146824 - DNA, 601 bp, Human
caagccaggaagcacagccccggccctctgggcactcatgcctaggagagccaccggagtgtcagggtttcgctgttaagaaaggaccaaaggcttcccctccaagaatgcacgcactgaatcttcgtacacctcgtaagagttcaagctatgtggggcctccctagaacagccagcacattctttagctacagactgtgggaaacgccaactgaacgaccctaggaaatgcctgctgttggtgacacacaccctgggcaccaggcttttatgattaccacagttacacacagctctggcrgatcaaagacatctgttttctaatctcgaagctaattggctctggatggccaaggagccctacagctgtggggagagaggatcaacagccctgttccccctccccagaagccttcttccccatctgctagggtatatttgtgagtactccagttggtttctctgatggtagtttctcgccaaaagaaaagctaattcccttcgacagctctggaaatctgcagatgtcacaagcacaaagacagcacttgatttgttgattgtggaatcaagagacccaagggaaagtgatcggaagtcc

SEQ ID NO: 146825 - DNA, 601 bp, Human
cccttttgtgctcacagcaccttctcctcagtcctgaacagaaggtctgtgatgacaagtgtgttgatcaaggtctacctgagggacaagtagacctaagaaatgtgaaaagcagggggaaaagaaattccctcctcacctccttccagttttcagcaggaagtgacggctctaacaccggtaggactcctcccctcggagcaaaggcccctccctgcgactccttgcacctccccctgggcgctcccccaactcccaacccaccctggctgtgttcaggtggactgcgagtcttcctcayggataaaaagcaaacacctggagggtgggtttcagcgggcaccattggtggcagtgcccatgcagcttgcacagccttagcgtcccatcttcccaaccaaaccctacactgcaaggcagctattgcctagaagctcctgaaatcactgggctcagcactgcttgggctcttctgaaagcctccctgaacagcggtcaccagcttctgtggtgttttgatgtctaccacctcctcttttctcacagaagtcacaggtggaccaaaggctcgggtccgtctggcagggttacctttggggcc

SEQ ID NO: 146826 - DNA, 601 bp, Human
agcctgggagcctggaggagatttcaacctaagtgtggctgcgtggtgtgttgtacgaagacaaacttccttacacaacacgtcccttttgtgctcacagcaccttctcctcagtcctgaacagaaggtctgtgatgacaagtgtgttgatcaaggtctacctgagggacaagtagacctaagaaatgtgaaaagcagggggaaaagaaattccctcctcacctccttccagttttcagcaggaagtgacggctctaacaccggtaggactcctcccctcggagcaaaggcccctccctgygactccttgcacctccccctgggcgctcccccaactcccaacccaccctggctgtgttcaggtggactgcgagtcttcctcacggataaaaagcaaacacctggagggtgggtttcagcgggcaccattggtggcagtgcccatgcagcttgcacagccttagcgtcccatcttcccaaccaaaccctacactgcaaggcagctattgcctagaagctcctgaaatcactgggctcagcactgcttgggctcttctgaaagcctccctgaacagcggtcaccagcttctgtggtgttttg

SEQ ID NO: 146827 - DNA, 601 bp, Human
aaaggggctgccgtctcctgttctccaagctagcagcctacagcagtgagggtggatggggcctggagcctctgggtaagaagcctgggagcctggaggagatttcaacctaagtgtggctgcgtggtgtgttgtacgaagacaaacttccttacacaacacgtcccttttgtgctcacagcaccttctcctcagtcctgaacagaaggtctgtgatgacaagtgtgttgatcaaggtctacctgagggacaagtagacctaagaaatgtgaaaagcagggggaaaagaaattccctcctyacctccttccagttttcagcaggaagtgacggctctaacaccggtaggactcctcccctcggagcaaaggcccctccctgcgactccttgcacctccccctgggcgctcccccaactcccaacccaccctggctgtgttcaggtggactgcgagtcttcctcacggataaaaagcaaacacctggagggtgggtttcagcgggcaccattggtggcagtgcccatgcagcttgcacagccttagcgtcccatcttcccaaccaaaccctacactgcaaggcagctattgcctagaagctc

SEQ ID NO: 146828 - DNA, 601 bp, Human
aggcaatggtggaatgtgagggagttgtgagtgtgacgaggcctcagcgcctggccctcctgaacagggatgctctgctgcccgcccagcctgagggaagcagccgtggtgtgggtgggcgttgcgtggctgtcagaggaaaggggctgccgtctcctgttctccaagctagcagcctacagcagtgagggtggatggggcctggagcctctgggtaagaagcctgggagcctggaggagatttcaacctaagtgtggctgcgtggtgtgttgtacgaagacaaacttccttacacaacaygtcccttttgtgctcacagcaccttctcctcagtcctgaacagaaggtctgtgatgacaagtgtgttgatcaaggtctacctgagggacaagtagacctaagaaatgtgaaaagcagggggaaaagaaattccctcctcacctccttccagttttcagcaggaagtgacggctctaacaccggtaggactcctcccctcggagcaaaggcccctccctgcgactccttgcacctccccctgggcgctcccccaactcccaacccaccctggctgtgttcaggtggactgcgagtcttcct

SEQ ID NO: 146829 - DNA, 601 bp, Human
ttagaaatgcagaccccaggggtctataaggcaggcccacttttcaagatcccacaggatctgtcactgaaggacacctgcccactgtctgggccccgctctggaagctctgatgggctatgaagctggccagccactagttcagaccctttgtatgcaacactgaggtctccgatgtccagtaatttgtaagtttgcagtggcacacacccgaatcacatcttctgtgaggctgctgcacagatagggtctgtcctcctcactgccacaaagccaagcaactccatgtcacatgggtcayggcctcaggtgaaggaggcactgtgtgaggcaatggtggaatgtgagggagttgtgagtgtgacgaggcctcagcgcctggccctcctgaacagggatgctctgctgcccgcccagcctgagggaagcagccgtggtgtgggtgggcgttgcgtggctgtcagaggaaaggggctgccgtctcctgttctccaagctagcagcctacagcagtgagggtggatggggcctggagcctctgggtaagaagcctgggagcctggaggagatttcaacctaagtgtggctgcgtggtgtgttg

SEQ ID NO: 146830 - DNA, 601 bp, Human
gcgcctgcaggtgagaagggcactttattcatctactcaaggtgtggttgggggggcaggtcaccaccatcacttcattagaaatgcagaccccaggggtctataaggcaggcccacttttcaagatcccacaggatctgtcactgaaggacacctgcccactgtctgggccccgctctggaagctctgatgggctatgaagctggccagccactagttcagaccctttgtatgcaacactgaggtctccgatgtccagtaatttgtaagtttgcagtggcacacacccgaatcacatctyctgtgaggctgctgcacagatagggtctgtcctcctcactgccacaaagccaagcaactccatgtcacatgggtcacggcctcaggtgaaggaggcactgtgtgaggcaatggtggaatgtgagggagttgtgagtgtgacgaggcctcagcgcctggccctcctgaacagggatgctctgctgcccgcccagcctgagggaagcagccgtggtgtgggtgggcgttgcgtggctgtcagaggaaaggggctgccgtctcctgttctccaagctagcagcctacagcagtgagggtggat

SEQ ID NO: 146831 - DNA, 601 bp, Human
ctccccaaacaaaacaaatataccccttggcgcctgcaggtgagaagggcactttattcatctactcaaggtgtggttgggggggcaggtcaccaccatcacttcattagaaatgcagaccccaggggtctataaggcaggcccacttttcaagatcccacaggatctgtcactgaaggacacctgcccactgtctgggccccgctctggaagctctgatgggctatgaagctggccagccactagttcagaccctttgtatgcaacactgaggtctccgatgtccagtaatttgtaagtytgcagtggcacacacccgaatcacatcttctgtgaggctgctgcacagatagggtctgtcctcctcactgccacaaagccaagcaactccatgtcacatgggtcacggcctcaggtgaaggaggcactgtgtgaggcaatggtggaatgtgagggagttgtgagtgtgacgaggcctcagcgcctggccctcctgaacagggatgctctgctgcccgcccagcctgagggaagcagccgtggtgtgggtgggcgttgcgtggctgtcagaggaaaggggctgccgtctcctgttctccaa

SEQ ID NO: 146832 - DNA, 601 bp, Human
ggtgcgttgctgtctcttccagcacctctgccctcctctttctctctcctttccttttcttctgctctcttcaaacttttctttcccatcctactctccccaaacaaaacaaatataccccttggcgcctgcaggtgagaagggcactttattcatctactcaaggtgtggttgggggggcaggtcaccaccatcacttcattagaaatgcagaccccaggggtctataaggcaggcccacttttcaagatcccacaggatctgtcactgaaggacacctgcccactgtctgggccccgcyctggaagctctgatgggctatgaagctggccagccactagttcagaccctttgtatgcaacactgaggtctccgatgtccagtaatttgtaagtttgcagtggcacacacccgaatcacatcttctgtgaggctgctgcacagatagggtctgtcctcctcactgccacaaagccaagcaactccatgtcacatgggtcacggcctcaggtgaaggaggcactgtgtgaggcaatggtggaatgtgagggagttgtgagtgtgacgaggcctcagcgcctggccctcctgaacagggatg

SEQ ID NO: 146833 - DNA, 601 bp, Human
ttgatctccctgcaagtaaaagtcaggcatattaactttacatttgtccatgggcatgcatctgtaggcatgttatagataatggtatacattttggtgcaatgaatattgcattgcaaaactccatttccagatttctcatcaaagaatcaaagtccacttctgaatggagaggaaaacttaagagcagtagagccaaccatctggtttctacctgccattcctcttcgtcctccatcctctctgttttatcccactgacagctgtctcccaccttagcctctcaccagtctctagattsttccttgggggagaggtagtgaatacaaggggaaggagaggcgacttgtgctgccttatgggactccctgtgtgttatggctcattgagtgtgctgagatatttgctgagcatttctcaggcagcatctccactgagctgggagaaggggacctttccacgcagagcgctggttaccttttcacctcgcagccctgggatgcctatgccaggtgggcctgcctgccctttctctccttttgcacctttgtctccaggtaagccaggtgaaccttgtgggccagggatgccaggcacacct

SEQ ID NO: 146834 - DNA, 601 bp, Human
gcattcctgggatcccaatgcttcctttttctcccttctctccagggcttcctgggaaacccgctatcccttgatctccctgcaagtaaaagtcaggcatattaactttacatttgtccatgggcatgcatctgtaggcatgttatagataatggtatacattttggtgcaatgaatattgcattgcaaaactccatttccagatttctcatcaaagaatcaaagtccacttctgaatggagaggaaaacttaagagcagtagagccaaccatctggtttctacctgccattcctcttcgycctccatcctctctgttttatcccactgacagctgtctcccaccttagcctctcaccagtctctagattcttccttgggggagaggtagtgaatacaaggggaaggagaggcgacttgtgctgccttatgggactccctgtgtgttatggctcattgagtgtgctgagatatttgctgagcatttctcaggcagcatctccactgagctgggagaaggggacctttccacgcagagcgctggttaccttttcacctcgcagccctgggatgcctatgccaggtgggcctgcctgcccttt

SEQ ID NO: 146835 - DNA, 601 bp, Human
ggcctggggaccctggcattcctgggatcccaatgcttcctttttctcccttctctccagggcttcctgggaaacccgctatcccttgatctccctgcaagtaaaagtcaggcatattaactttacatttgtccatgggcatgcatctgtaggcatgttatagataatggtatacattttggtgcaatgaatattgcattgcaaaactccatttccagatttctcatcaaagaatcaaagtccacttctgaatggagaggaaaacttaagagcagtagagccaaccatctggtttctaccygccattcctcttcgtcctccatcctctctgttttatcccactgacagctgtctcccaccttagcctctcaccagtctctagattcttccttgggggagaggtagtgaatacaaggggaaggagaggcgacttgtgctgccttatgggactccctgtgtgttatggctcattgagtgtgctgagatatttgctgagcatttctcaggcagcatctccactgagctgggagaaggggacctttccacgcagagcgctggttaccttttcacctcgcagccctgggatgcctatgccaggtgg

SEQ ID NO: 146836 - DNA, 601 bp, Human
gcagggcatgtttttgtctcgtggtgtgtgctacatactgtcctgcattcacataagtataaccagttctagaaagtcagaatttcaatattctgatgaccttctaggcataaaaatgacaggggtctcgcctctctgctggatttttacaaaattagtccaagtaaaagataattctgatcatgagtgtactgcacgccattttgatccattaattagaagggaaccacatgtgtcttgcaggcattgccctctgggctcagcacccatcctccatcccgttgctgcctggccaacaggsatggggcttcatcctgaagacactgccccttgttctgctaatcaggcagcagcggttggttgaaaaggaagagcacagtgagcaaagattacctttgtctcctttggcccctggaaaccctgggaatcctcttcctggtagacctataagatgagggtaaaatgccacgtttctctttacttaaacaatccatctgcaggtacaacacaaagcactatcaactctgcaataatactacgtatattgtggagtacatagatattagttaattgcacccttgtaataaaatgatattcctac

SEQ ID NO: 146837 - DNA, 601 bp, Human
tctcttcagtgtcgtgcagctcacatgccttgtattttctgtgtcccctttgctttcccatgaaatgctcagctctctgagagaagagactgccttcccaagctcctggccaactctcagctgcacttagtactgagcacatcgtggctgcgcagggcatgtttttgtctcgtggtgtgtgctacatactgtcctgcattcacataagtataaccagttctagaaagtcagaatttcaatattctgatgaccttctaggcataaaaatgacaggggtctcgcctctctgctggatttttayaaaattagtccaagtaaaagataattctgatcatgagtgtactgcacgccattttgatccattaattagaagggaaccacatgtgtcttgcaggcattgccctctgggctcagcacccatcctccatcccgttgctgcctggccaacaggcatggggcttcatcctgaagacactgccccttgttctgctaatcaggcagcagcggttggttgaaaaggaagagcacagtgagcaaagattacctttgtctcctttggcccctggaaaccctgggaatcctcttcctggtagacctataa

SEQ ID NO: 146838 - DNA, 601 bp, Human
gatatgtctctgctgctgatgagcagttcaaagctttccctttaagggagaacatgtgttgacttacagaagaaccccacttgctccaacataactgcagaggtctgtctcaaatccctcctattcctgatctcccctgatatactctctctttctcctaatgtgtgttagagagagacagagagacagacagatggagacagatagaggaaacagagagacagacacagagaataaagctctgctaatccagctatttgaatgagcgagccacgtaaacacaatcctttagccatggacrtggttaagctaaaaatcaaaccaaagatccatgaccaccactaagaagggctatatattcaggtgcagcaaagagccaaagtcacacacacacacacagaaatacacaaggctgctggtcacttattgcaccctgagatgtgctcttctgaaggcttgtctaagtcaccacttagactctgtatctggatcaggtcagtaaagaaagatggaatattgctggttatcttttatgacttgaactgttcaactgcaattccctgtcctcctgccagtcctaagagatggctgggctagtttt

SEQ ID NO: 146839 - DNA, 601 bp, Human
atagccagttctgcataattatttataagcatttcataacttactgattcagaagtaaatcagcaccacgtattgttttgcacccagcaagcttagctattctgtatccatccttgagaaagtagtctgatgactctaagatatgtctctgctgctgatgagcagttcaaagctttccctttaagggagaacatgtgttgacttacagaagaaccccacttgctccaacataactgcagaggtctgtctcaaatccctcctattcctgatctcccctgatatactctctctttctcctaaygtgtgttagagagagacagagagacagacagatggagacagatagaggaaacagagagacagacacagagaataaagctctgctaatccagctatttgaatgagcgagccacgtaaacacaatcctttagccatggacatggttaagctaaaaatcaaaccaaagatccatgaccaccactaagaagggctatatattcaggtgcagcaaagagccaaagtcacacacacacacacagaaatacacaaggctgctggtcacttattgcaccctgagatgtgctcttctgaaggcttgtct

SEQ ID NO: 146840 - DNA, 601 bp, Human
gtttcttagccttattttaaaagtgtcaaaccaaaataacatgaacaaatatatatgtatataaacatatatacaaacacatatttatacataagtatgtatacagagacagacagacactgactggcaccaggaatggggtgtatttctttttcttcctcttttttttttgagacagagtctcgctctgtcatccaggctggagtgcagtggcaccatctcggctcacttcaatctctgcctcctaggttcaagcaattctcctgcttcagccttccaagtggctgggattacaggcatragccaccatgctaacttgtgcatttttagtagagacagggttttgccatgttggccaggctggtctcgaactccccacctcaggtgatctgcccacctcggcctcccaaagtgctaggattacaggcgtgagctaccaggcccagccgggaatggggtatatttctatgttactgaggaataaaaatgagaatacataaatatttgacaaattacctaggcttacattactggaaaactgcaatatagcaataggggcccaaaaatacattcacatacacatttgctatactgtggagat

SEQ ID NO: 146841 - DNA, 601 bp, Human
cttttctgaaaactttccccttaatcctcaagtgcaatcagttttctttagaattagtttcatgtcttatctgaaaactgattttaaatatgcaaagaaaattaagaaatgctaaggaacgagtattttcctttatactgtggcaatattcgtgtattttaaaataggggctcattttctttccatttcaacaagtcgttcctttctcaagtcgtggacagcaacatgtaacaagttgttttatttcttacgtagatttgtttcttagccttattttaaaagtgtcaaaccaaaataacakgaacaaatatatatgtatataaacatatatacaaacacatatttatacataagtatgtatacagagacagacagacactgactggcaccaggaatggggtgtatttctttttcttcctcttttttttttgagacagagtctcgctctgtcatccaggctggagtgcagtggcaccatctcggctcacttcaatctctgcctcctaggttcaagcaattctcctgcttcagccttccaagtggctgggattacaggcatgagccaccatgctaacttgtgcatttttagtagagacagggt

SEQ ID NO: 146842 - DNA, 601 bp, Human
cactgtttttggtcccgatctgattcacacatgtccccagttggaccacaagacaccttgaggctgcgacctgttttattcgcctttcacgtgtatctgactcagcagtaaaaactgcagtgcctggggagctggtaagcagcccaaaaatgtgtgtttaatatatgaataaattaatgaatagcccaaatccatgacttcttattgagatattaatgatccactgattcttaataagaaaatcagaatgtctttacactggcatccataagattatacaaattgggctgccacacagaartgccatttttaatttgaagagaacagtatctcgtgctataatggcagcggtgctatcagtgctaaggtgcccgaggttagcaagctcttcacacagcatctgctgctgcaaaggctgtgcagcaaggtctgtgctgtcttaccttgaaatcctggaactcctggaggccccatatcacccttagagcctgtgattcctggagagccaccaataccctagacacgcaaagaggaggttgggaattgctcaggatatgtaggttaagtctctccagtaacctgctagttggaaaatggaaac

SEQ ID NO: 146843 - DNA, 601 bp, Human
ctgaaacctgccttactgtatagtatcacactggtcctgatctttgagtgacgaatgaacttaatccttcttctgcatggcaagtcttggcatgtggtaagaaccacacaaagtgcgagttcccctcagcctccccgttttcagcccaataccctcaactctccctccccttccacataccctccctccccttccacacaccctccctcaccttccacacaccctccctcccctctccttccttgggttccacttctcagggcatgtggtttctcattctctctcccaaaacatggtttgraaaattaaatgatgccctagaagtatggtctgctgtaaagaggaagcaggatgaatactgtgcttaaaccattcccttttgagatgatgtggttttcggcgactttcatgctgtaggctcccaccggtggagaagccaacagcacctttcccaggaagaattctttactgtgcagcaggaatgcactccgtctctaagtgcaagattgattttctttcctattataactttcagtggttgatttcaggctaacttgagagccttgggaagtttctgaattctgagcctgtcagtgagaac

SEQ ID NO: 146844 - DNA, 601 bp, Human
atttcactgtccacatactggggcggaaacaactttagaaggagaatcccgggtgaagctatccaaatggaacgtacttctcaaaggtaaagtcattatcaaaacccaggtaatcagatcttcacaaaacatgtccaatctgcacatctttattatttaacctgaaatcctgaactctcgggcaaaggcattggggcatcagcgtaacttcccactgcattctgggctctgggacccctgacaactgccctgcagcctcatgccagccctcccagcagggagagaagcttgttcttcccargcagcccccgcttctgacgtggagagtgccactctgcgattaggacatttttcccacactcatctgaaacctgccttactgtatagtatcacactggtcctgatctttgagtgacgaatgaacttaatccttcttctgcatggcaagtcttggcatgtggtaagaaccacacaaagtgcgagttcccctcagcctccccgttttcagcccaataccctcaactctccctccccttccacataccctccctccccttccacacaccctccctcaccttccacacaccctccctcccctctc

SEQ ID NO: 146845 - DNA, 601 bp, Human
cgttttctcggacagccaggagttgcttcccacaaagtcgagtacagactttgcagaagcagctggatattcataagggggtgtgtgtttgggcacctcgttctgagttctccctggtttcttgctgtttggcagattggtttggaaaaggcaggtgatgtggagggaatgagagactggataactttccctctcagccatatactggggtctcaatttttaggcaacagatataccaacatggatagtttttttgttttcatgtacatagcttgttcttcttctttctttctctctctcttttttttttttttttttttttgagacagggtctcgctctgtcacccaggctggagtgcagtggtgtgaccaccgctcactgcagcctcgacctcccgggctcaagcgattctcctacctcagcctctcgagtagctgggactacaggtatgcactaccacacctggctaattttatcattattattttgtagagacagactctccctatgttgcccaggctggtcttgaactcctgggctcaagtgatcctcccacctcagcctcccaaaaagccggcattacataggtgtgacccagtg

SEQ ID NO: 146846 - DNA, 601 bp, Human
ttaatatgtaaaaagtaaaattacggaatagcttcttagtcaaatgaatttgttcactggccactttcctattatttctgaatatttctaagaaataaacttttttttttttttttttttgagacagagttttgctcttgtcgcctaggctggagtgcaatggtgcgatcctggctcactgcaacctccgcctgctgggttcaagcaattctcctgcctcagcctcctgagtagctgggattacaggcatgtaacaccacacccagctaatttttgtatttttagtagagatgggatttcrccatgctggccaggctggtctcgaactcctgacctcaggtgattcacctgccttggcctcccaaagtgctgggattacaggcgtgagccactgtgcctggccagcaataaacttttaattagaaggaaagaggcaaagagaggacagtcatgttattttcagtggtaataatttcagttttccatcttacttcctatcagggaggctcctggggcctgaaaacgtacttcagatattagtgcggataaacactcaagggagatcgctcagtccaacacatgcattttcgatgggtacaat

SEQ ID NO: 146847 - DNA, 601 bp, Human
aggagttgggctaaaggcacagcctggggcagctgggcaggagctccaggggtgactccaagcatttgcttcccttttcccttttctgttgaatgtagggcacttcctacctgatactgctacatctttcttcatattcaaagactgctgatttctttaaagggaatataaaaaactttgtatctttttttatcattatcttaatatgtaaaaagtaaaattacggaatagcttcttagtcaaatgaatttgttcactggccactttcctattatttctgaatatttctaagaaataaacttttttttttttttttttttgagacagagttttgctcttgtcgcctaggctggagtgcaatggtgcgatcctggctcactgcaacctccgcctgctgggttcaagcaattctcctgcctcagcctcctgagtagctgggattacaggcatgtaacaccacacccagctaatttttgtatttttagtagagatgggatttcgccatgctggccaggctggtctcgaactcctgacctcaggtgattcacctgccttggcctcccaaagtgctgggattacaggcgtgagccactgtgcctgg

SEQ ID NO: 146848 - DNA, 601 bp, Human
ggcatgttcatctaatgaaaggagttgggctaaaggcacagcctggggcagctgggcaggagctccaggggtgactccaagcatttgcttcccttttcccttttctgttgaatgtagggcacttcctacctgatactgctacatctttcttcatattcaaagactgctgatttctttaaagggaatataaaaaactttgtatctttttttatcattatcttaatatgtaaaaagtaaaattacggaatagcttcttagtcaaatgaatttgttcactggccactttcctattatttctgartatttctaagaaataaacttttttttttttttttttttgagacagagttttgctcttgtcgcctaggctggagtgcaatggtgcgatcctggctcactgcaacctccgcctgctgggttcaagcaattctcctgcctcagcctcctgagtagctgggattacaggcatgtaacaccacacccagctaatttttgtatttttagtagagatgggatttcgccatgctggccaggctggtctcgaactcctgacctcaggtgattcacctgccttggcctcccaaagtgctgggattacagg

SEQ ID NO: 146849 - DNA, 601 bp, Human
tggcagccactcacacaggtgaagtattgcctgcattctgaaaagtgccattctggaagtgtaatgaatgatattctccattttaagacctataaaataagttttcttatagctcaaaaaaaatcaaagaaaactgtcagtagatattttaatgtaaggggatcaaagatctaagattttcctacataggaggcaccttccagccctctggtccatggtcccacgtggcatagctctctcactaaattgtcatctgccaggaattgcctggcacgtaaccctggtcttcccccaaacaggrcatgttcatctaatgaaaggagttgggctaaaggcacagcctggggcagctgggcaggagctccaggggtgactccaagcatttgcttcccttttcccttttctgttgaatgtagggcacttcctacctgatactgctacatctttcttcatattcaaagactgctgatttctttaaagggaatataaaaaactttgtatctttttttatcattatcttaatatgtaaaaagtaaaattacggaatagcttcttagtcaaatgaatttgttcactggccactttcctattatttctgaat

SEQ ID NO: 146850 - DNA, 601 bp, Human
ctacctgttgtgtaaaagaagctaaaaaaagaaacccacaaaagttgttacttttccttctagttatcaggcatggttctgagcaagaaaagtctcaaaacagtcaatatctggcagccactcacacaggtgaagtattgcctgcattctgaaaagtgccattctggaagtgtaatgaatgatattctccattttaagacctataaaataagttttcttatagctcaaaaaaaatcaaagaaaactgtcagtagatattttaatgtaaggggatcaaagatctaagattttcctacatagraggcaccttccagccctctggtccatggtcccacgtggcatagctctctcactaaattgtcatctgccaggaattgcctggcacgtaaccctggtcttcccccaaacagggcatgttcatctaatgaaaggagttgggctaaaggcacagcctggggcagctgggcaggagctccaggggtgactccaagcatttgcttcccttttcccttttctgttgaatgtagggcacttcctacctgatactgctacatctttcttcatattcaaagactgctgatttctttaaagggaatataaa

SEQ ID NO: 146851 - DNA, 601 bp, Human
tgcttagactctaaggtttagcacctccccgttggctttagaagctcatctcaggatcaaaacatacagagacttagactcttggtgctcaaagaccaggggtgttttactgagaggaatgcatcacacagaaatgctggtctcagacacacagcttctctgagacctgtttttggactaccaccagggcatgccagagctcctgtcaaggagctctgaatcaaggtcaaatgtcaacattgccaagaaagtaaacaggaaacctatcaatgaatagtctttttctacctgttgtgtaaargaagctaaaaaaagaaacccacaaaagttgttacttttccttctagttatcaggcatggttctgagcaagaaaagtctcaaaacagtcaatatctggcagccactcacacaggtgaagtattgcctgcattctgaaaagtgccattctggaagtgtaatgaatgatattctccattttaagacctataaaataagttttcttatagctcaaaaaaaatcaaagaaaactgtcagtagatattttaatgtaaggggatcaaagatctaagattttcctacataggaggcaccttccagccc

SEQ ID NO: 146852 - DNA, 601 bp, Human
ggaaacctgcttgctcagagacagggacaaaggggcagcctctctacgagagggaagtagaggcagacttgatgcaaaagcagcagcttcaagtacatgcctgggaaggtcccttcatgctgagcttcgatgtgtcaactaacaggaagacataaaaatctggaaatgtaaagtcctgggacatttcaggactttctggtccaatgacatgttaagtgggaaatgctgtgccccattgcttagactctaaggtttagcacctccccgttggctttagaagctcatctcaggatcaaaacayacagagacttagactcttggtgctcaaagaccaggggtgttttactgagaggaatgcatcacacagaaatgctggtctcagacacacagcttctctgagacctgtttttggactaccaccagggcatgccagagctcctgtcaaggagctctgaatcaaggtcaaatgtcaacattgccaagaaagtaaacaggaaacctatcaatgaatagtctttttctacctgttgtgtaaaagaagctaaaaaaagaaacccacaaaagttgttacttttccttctagttatcaggcatggttctg

SEQ ID NO: 146853 - DNA, 601 bp, Human
tccttgctctcaatccagcggtcttttcgtcagagcaattagcaatcagtatttatttcgtgagtcttgtctgcagaaagctagaaagtacttagaaaattgtgccctactatcggatgaaagctggaaaactgccaccttttctgctcaaaacgaaggcttttgtgtcatttgctgtttctaaaatttagctttcggacctccctaaagggaagagctgagaaggaacctgtaagtcctgagaagtcgtggaaaccactaagttcagtaaccgtggaaacctgcttgctcagagacaggracaaaggggcagcctctctacgagagggaagtagaggcagacttgatgcaaaagcagcagcttcaagtacatgcctgggaaggtcccttcatgctgagcttcgatgtgtcaactaacaggaagacataaaaatctggaaatgtaaagtcctgggacatttcaggactttctggtccaatgacatgttaagtgggaaatgctgtgccccattgcttagactctaaggtttagcacctccccgttggctttagaagctcatctcaggatcaaaacatacagagacttagactcttggtgctc

SEQ ID NO: 146854 - DNA, 601 bp, Human
agacattacaacagagccccgtgactattatttcagatataggaaatgtgaactctagaattttggagacacaagggacctttgaggacaaggctaactccactgattcccagctgaggacattctcggatctgaccaggatcacatagcttcaaggcggagcagaggcaaggacggggtctccagacctccagatcagagccaccgtcctgagaactcagaggaggtgctggaagacactgttctctagaacgtcactattttcgtttgctcctgatttagacaaattatgggcaatcaytgtttcaggccttttgacacccggacaagggttggtggtgacaacagctttcctgtgggtcctcaatgcaactgtgggctttctctgacacacagagattccactcagtatttcttatgattatggagtggcgaatccaatctaccttttaatgaacatggcaagcttacatcattgttagtgtcctgatttctctatacagcattttcaacctttctggctctctcgataaagtagttacaatgcagcacttcgaattattgcaacaacctgttaatctggtggttgcaacatgaagag

SEQ ID NO: 146855 - DNA, 601 bp, Human
aggtctgcctttgaaaatcgtctcggtcatctgcccatgtcgaacagcatcaaatattcattgctaaccatctttgagactttgcattggaaggtgttacggatcgcggatgattaaaaaataaagtcacaaaggggccagcagcctgcaaaaaagcagtgctcccacttacttgaacatctcgctcctctctatggtggcgagccaaaagctgtaagcgtttgcgtagtaattgcaggtcccacggccgtgacactcgatgaatggcgcacttctaaactcctccaggcaggagccgggrgacgccagggcttggccagagccttctgcaccagcgctggtgtgctgcagaacagatgcgagccgtgagtcagaggttccctccccaaacaccaggaaagagatcgatccttcccaggaaggcgccagggtgttccctctggaaagccacacactgcagcctcatgtggtcaccacaggacacactctgtgcccaaattatcgggctggcccgcaagccagtgcctgcatggctggggccccatggtgctcaacatggccccagggatcgtctaatggctgcttcccaaataggtgacca

SEQ ID NO: 146856 - DNA, 601 bp, Human
ccggaagggaaacccctgggtgggcactcagacctctactgcttcacagcaggggagcacagcggacccctaagccagagccagggctcatcagcccaagcagaaactgtgtgacaggaaccctcttggctgtgatcctggccctacaatgacatcgcaggccaagccaaggcaagccatccccacccccacctggagaagaaagggtaagtgggcccctggcctggaggctgcgaatcctcttttggatgtagcagcagctgtggcctggatgatcactcgggccactcagctgactcgrgcggtggacacctgttctccacattagccctggggctgccaggtctggggcctccacttgccaatgtgtctgctgtcagtgttgccccacaaaacaaggggaatgacccagcacacatagctgagtggtgatacagtgctctggcaccccacagccattcgggccctccagggccaggcaggaactggccaggtagaggggagaagtctaaggcaggagcacaggctatggggggaacgcgccccactctcccacaaaggggctgccccacaggtccacaggacaccatggcaaccatct

SEQ ID NO: 146857 - DNA, 601 bp, Human
aacatgcaatctttttttgagatggggggtctcgctgtgtgcccaggctggtctcctcagcctcctgagtagctgggcccacaagtgcatgtcaaagcataagctcatcagcccactggctgtcataggtaagcagtcagtgttaaaatatcaccctcctgccatagagagcatcatctccgtttcctcctccctgtttgctccatttctggtggaggaccacccgttcctagcccagtcctggatgccaggtgcaggacaaggttaagaagcagcccctcttctttttctttttttttttgagatagagtctcactctgttgcccaggctggagtgcagtggcgtgatctcggctcactgcaacctccgcctcccaggttcaagcgattcttccacctcagcctcccgagtagccggacttacaggcacccgccatcatgccccgttaatttttttttttttgaatttttgtagagacaggggtttcaccatgttggccaggctagtctcgaactcctgacctcaggtgatctgcagaagcagcccctcttctgcctgctcctcctccagcaggcccaacgccaccttgtcaaatcctcc

SEQ ID NO: 146858 - DNA, 601 bp, Human
caaggtgagctgtgtctgcccccagccccatcactgctgctgaccatgtgttctaaagagaagccaggaaaaattcaaagctgacaagtcacaggtgctcagctgtctccgggttgagggtgggtggcacagatgaggtgagaaccagcccctatctgaaaggaaagtcaacccagaacatgcaatctttttttgagatggggggtctcgctgtgtgcccaggctggtctcctcagcctcctgagtagctgggcccacaagtgcatgtcaaagcataagctcatcagcccactggctgtcrtaggtaagcagtcagtgttaaaatatcaccctcctgccatagagagcatcatctccgtttcctcctccctgtttgctccatttctggtggaggaccacccgttcctagcccagtcctggatgccaggtgcaggacaaggttaagaagcagcccctcttctttttctttttttttttgagatagagtctcactctgttgcccaggctggagtgcagtggcgtgatctcggctcactgcaacctccgcctcccaggttcaagcgattcttccacctcagcctcccgagtagccggacttaca

SEQ ID NO: 146859 - DNA, 601 bp, Human
actcggcaggatagagagagctgagtactgcctggggtcattccggtcaaggtgagctgtgtctgcccccagccccatcactgctgctgaccatgtgttctaaagagaagccaggaaaaattcaaagctgacaagtcacaggtgctcagctgtctccgggttgagggtgggtggcacagatgaggtgagaaccagcccctatctgaaaggaaagtcaacccagaacatgcaatctttttttgagatggggggtctcgctgtgtgcccaggctggtctcctcagcctcctgagtagctgggmccacaagtgcatgtcaaagcataagctcatcagcccactggctgtcataggtaagcagtcagtgttaaaatatcaccctcctgccatagagagcatcatctccgtttcctcctccctgtttgctccatttctggtggaggaccacccgttcctagcccagtcctggatgccaggtgcaggacaaggttaagaagcagcccctcttctttttctttttttttttgagatagagtctcactctgttgcccaggctggagtgcagtggcgtgatctcggctcactgcaacctccgcctcccag

SEQ ID NO: 146860 - DNA, 601 bp, Human
acagctggtcgagtcaaaagtgacctttctcattctctcatcagtacagcagcccagtcctaaagccagtacccatggaggaaacagcagggggtgccttgagcccacctgctaccaggagtccccaaagccaaggtcaagaaactcggcaggatagagagagctgagtactgcctggggtcattccggtcaaggtgagctgtgtctgcccccagccccatcactgctgctgaccatgtgttctaaagagaagccaggaaaaattcaaagctgacaagtcacaggtgctcagctgtctccrggttgagggtgggtggcacagatgaggtgagaaccagcccctatctgaaaggaaagtcaacccagaacatgcaatctttttttgagatggggggtctcgctgtgtgcccaggctggtctcctcagcctcctgagtagctgggcccacaagtgcatgtcaaagcataagctcatcagcccactggctgtcataggtaagcagtcagtgttaaaatatcaccctcctgccatagagagcatcatctccgtttcctcctccctgtttgctccatttctggtggaggaccacccgttcctagcc

SEQ ID NO: 146861 - DNA, 547 bp, Human
tgtgttaaccaagttctcctccactcctgaaagtcacgtatttagaaagggcttccctcacccctccataagtcctcctgacagctacaccagcgcggagttagaaacttgatgctttcttgatgcagaaagctgcctcacacagtcctcagatttaaagaagcaatgcctaaaagtttctgagccagtggtgtggaaggtgcctggggtctgtggcccaggcccagagtccaggggaagccagcagaggtgtgtcctcaagcctcgacccttttttaaatgtttttgagatggcttctcrctctgtcacccaggctggagtgtagtggtgcaatcttggctcactgcaacctctgcctcctgggttcaagcgattcttctgcctcagcctcccaagtagctggaattacaggcatgcaccaccactcccagttaattttttgtatttttagtagagataaggtttcaccatgttggccaggctggtctcgaactcctgacttcaggtgatctgcccacctcagcctcccaaagtgctgggattaca

SEQ ID NO: 146862 - DNA, 601 bp, Human
agttcgcaaccagcctgactaacatggtaaaaccccatctctactgaatacaaaaaaaattagccgggcgaggttgcgtatgcctgtgatccgagctacttgagagtccaagacagaagaatcacttgaatcagggaagcggaggttgcggtgagccgagatcgcaccatcgcactccagcctgggcaacaagagcgaaactaggtctcaaaaaaataaaaaatttaaaaaaaaaaacctcatcaaaaacaaaaaacctcagtatgtgttaaccaagttctcctccactcctgaaagtcaygtatttagaaagggcttccctcacccctccataagtcctcctgacagctacaccagcgcggagttagaaacttgatgctttcttgatgcagaaagctgcctcacacagtcctcagatttaaagaagcaatgcctaaaagtttctgagccagtggtgtggaaggtgcctggggtctgtggcccaggcccagagtccaggggaagccagcagaggtgtgtcctcaagcctcgacccttttttaaatgtttttgagatggcttctcgctctgtcacccaggctggagtgtagtggtgcaatct

SEQ ID NO: 146863 - DNA, 601 bp, Human
tgaagtcaggagttcgcaaccagcctgactaacatggtaaaaccccatctctactgaatacaaaaaaaattagccgggcgaggttgcgtatgcctgtgatccgagctacttgagagtccaagacagaagaatcacttgaatcagggaagcggaggttgcggtgagccgagatcgcaccatcgcactccagcctgggcaacaagagcgaaactaggtctcaaaaaaataaaaaatttaaaaaaaaaaacctcatcaaaaacaaaaaacctcagtatgtgttaaccaagttctcctccactcstgaaagtcacgtatttagaaagggcttccctcacccctccataagtcctcctgacagctacaccagcgcggagttagaaacttgatgctttcttgatgcagaaagctgcctcacacagtcctcagatttaaagaagcaatgcctaaaagtttctgagccagtggtgtggaaggtgcctggggtctgtggcccaggcccagagtccaggggaagccagcagaggtgtgtcctcaagcctcgacccttttttaaatgtttttgagatggcttctcgctctgtcacccaggctggagtgtagt

SEQ ID NO: 146864 - DNA, 601 bp, Human
gcccatcttcccctcctgccacactactgctacagatgctcagaggacaggttgagtacacacagcagtggctgactccacttcaccaagaccccatcaaaaaccaggctgctgatccagtcctacagggctgggaagagggcatggctggcaagcatgtgacccgacacacccatcaccctcctgggcaggatggccacagcgttccctacaccccagacactggcaccaccagccacctgctcctcacaggcccactcaccactgccagtaggggccccccagagtgctcctagcagcrccctcactgcattaccacaggcaggcaagtgggtcccaatggccatttagagccaactgaccctcgtggacgagggctcacaccctgcctgcccagggcagtttcccggagggcatgcactgaaccgtcaagaccgccttgcaccctctggcatgtcactcagtccctctgacatggaagagagccgggcacagcaccagcagggtccccgcctccccacaacaggcacctttaggtaggagccaaagtagcgggtgatgtaggggctgtcgcactgactgaggacagtgatctcctgct

SEQ ID NO: 146865 - DNA, 601 bp, Human
tgctaccccaaagtccgccagcttcacgtcaccctgctccgagagtagcacgttggcagctgcttgacacaggacaggcaggcgtcatcccaggctccacgtggctccaccccgggccccctgagaagggccagggtaccatccacctggcctcctagggcacagcagggctgtcctcaggacctcagccctccttgccactctcaaacccagggccacctagggccacaggggcactgccagcaggagcccaacggctccactccgagctccagggctcttcctgcatttggcttttacracaaatcccaacgacaagcgacttcgcccactgggggctaccgcagaggtgaccctgaccaagggtgtagccaacacgggcctgccaggaagccccctgctccaccagaatcgtcccctacatgacagagatggctcgttgccagtggcaagtccctccccatgggctggcccagcctcccgtctgctctcagcagggccagaccacacgctggggctactcaattctacacctgctgctgtgccgtgcaccacagggaaccaacaactccagccaagtgtggccctttcctacactcag

SEQ ID NO: 146866 - DNA, 601 bp, Human
tcggctgcctcttgacgggctccgcaggctgcaaaggagtggaggcccagggtgagcagggcagtgcaggtgacaggcagggcactcccatccctgcccaggctctagccttgaagagacagaggctgggagcagcctgtcggggcacatgtccagggccggccccaaaaccatcaagccacccggatggcctgactctgagggcgactcccaccctctcctgactctgagggcctgtgactcccaccctctcctgactctgagggcctgtgactcccaccctctcctgactctgagggcytgtgactcccaccctctcctgactctgagggcctgtgactcccaccctctcctcacaaatttggctccaaacaggccctcatcttcccggcacatgctggggctcggggtctccacaccaggcctagtgccacagtgggcttcagaccacccctgcctttcccaagctccttgtccaagctccagacactgggtggacaaagctgggtcccgcatccagcccatcccacggccccaggggtgcacagagggcaaaggccaggccaggaacagaccttctgtgaactgtgcagggccgtcc

SEQ ID NO: 146867 - DNA, 601 bp, Human
tgacgggactccaggcccagtcccagccccatcctcacctctccgaagacgggccggaccagcgtggacaggcactgggacctcggctgcctcttgacgggctccgcaggctgcaaaggagtggaggcccagggtgagcagggcagtgcaggtgacaggcagggcactcccatccctgcccaggctctagccttgaagagacagaggctgggagcagcctgtcggggcacatgtccagggccggccccaaaaccatcaagccacccggatggcctgactctgagggcgactcccaccctcycctgactctgagggcctgtgactcccaccctctcctgactctgagggcctgtgactcccaccctctcctgactctgagggcttgtgactcccaccctctcctgactctgagggcctgtgactcccaccctctcctcacaaatttggctccaaacaggccctcatcttcccggcacatgctggggctcggggtctccacaccaggcctagtgccacagtgggcttcagaccacccctgcctttcccaagctccttgtccaagctccagacactgggtggacaaagctgggtcccgcatcca

SEQ ID NO: 146868 - DNA, 601 bp, Human
gctgaaaccaccccacagtgctgtgagggagacatctccgtgcaacagtgtcacagccttgtccttgacgggactccaggcccagtcccagccccatcctcacctctccgaagacgggccggaccagcgtggacaggcactgggacctcggctgcctcttgacgggctccgcaggctgcaaaggagtggaggcccagggtgagcagggcagtgcaggtgacaggcagggcactcccatccctgcccaggctctagccttgaagagacagaggctgggagcagcctgtcggggcacatgtcyagggccggccccaaaaccatcaagccacccggatggcctgactctgagggcgactcccaccctctcctgactctgagggcctgtgactcccaccctctcctgactctgagggcctgtgactcccaccctctcctgactctgagggcttgtgactcccaccctctcctgactctgagggcctgtgactcccaccctctcctcacaaatttggctccaaacaggccctcatcttcccggcacatgctggggctcggggtctccacaccaggcctagtgccacagtgggcttcagaccacccc

SEQ ID NO: 146869 - DNA, 601 bp, Human
cggcaccgccaggcccagatctgacctccatcaggacaccagcatctgagcctcctgtcaccgggtgtcacccaccctcggggggctgtggctggatcagcaggctgcccaggacctggacccgagtggctgcttcccgctggggcctccacatgggctggggccaacgtccctcgaccgtgctcctccctttgccgtcctcaggcaggccctgccttcaccacctctcacccacatcctccatcctccctccccaggctccaggtggggctcctggagggcacacctgggcccaagcccrctggccacgccctgggcacacagatcctggctgtatcacatttctgaggacggtgctgactgcccatcagcaggtgacgttgatgcagggtcacgtgactaaccagggcggcacctgcccggggatggaccccgactaaaccttctctgctttctctatagaaggatcatctgtgtttgcacctgaagaaaaaaaagtcaccctaggaacccagagaaccttggcaggtctgggagtacaaaaggagtcattgcagcagattctgctccttccactcagaaaacccagcccacaatcagc

SEQ ID NO: 146870 - DNA, 601 bp, Human
acacggcaccgccaggcccagatctgacctccatcaggacaccagcatctgagcctcctgtcaccgggtgtcacccaccctcggggggctgtggctggatcagcaggctgcccaggacctggacccgagtggctgcttcccgctggggcctccacatgggctggggccaacgtccctcgaccgtgctcctccctttgccgtcctcaggcaggccctgccttcaccacctctcacccacatcctccatcctccctccccaggctccaggtggggctcctggagggcacacctgggcccaagsccgctggccacgccctgggcacacagatcctggctgtatcacatttctgaggacggtgctgactgcccatcagcaggtgacgttgatgcagggtcacgtgactaaccagggcggcacctgcccggggatggaccccgactaaaccttctctgctttctctatagaaggatcatctgtgtttgcacctgaagaaaaaaaagtcaccctaggaacccagagaaccttggcaggtctgggagtacaaaaggagtcattgcagcagattctgctccttccactcagaaaacccagcccacaatc

SEQ ID NO: 146871 - DNA, 601 bp, Human
ttcctcccagccgagggtcatggaagccactcaatgggtctaatcagacccaaaaacacgaagcccagaaacccccaaagcacacggcaccgccaggcccagatctgacctccatcaggacaccagcatctgagcctcctgtcaccgggtgtcacccaccctcggggggctgtggctggatcagcaggctgcccaggacctggacccgagtggctgcttcccgctggggcctccacatgggctggggccaacgtccctcgaccgtgctcctccctttgccgtcctcaggcaggccctgccktcaccacctctcacccacatcctccatcctccctccccaggctccaggtggggctcctggagggcacacctgggcccaagcccgctggccacgccctgggcacacagatcctggctgtatcacatttctgaggacggtgctgactgcccatcagcaggtgacgttgatgcagggtcacgtgactaaccagggcggcacctgcccggggatggaccccgactaaaccttctctgctttctctatagaaggatcatctgtgtttgcacctgaagaaaaaaaagtcaccctaggaacccagag

SEQ ID NO: 146872 - DNA, 601 bp, Human
cttctctttgagctgtgaaaagaccaccacgcctgaccctggaccccaggacaggccttcagggagcctgctcctttgctcggccacagtgatgccggaggccttcagggctctcgcctaggagccacacccgggagcccttcagcaagccgggaagtgaggtggcccaaggaagcctctgcccctgccctgccaacggggaccctagtggtccttccccacagcacctaccttccccctacactccggggaatctcggacctcggttctcaggaggggaccagatggcttcctcccagcygagggtcatggaagccactcaatgggtctaatcagacccaaaaacacgaagcccagaaacccccaaagcacacggcaccgccaggcccagatctgacctccatcaggacaccagcatctgagcctcctgtcaccgggtgtcacccaccctcggggggctgtggctggatcagcaggctgcccaggacctggacccgagtggctgcttcccgctggggcctccacatgggctggggccaacgtccctcgaccgtgctcctccctttgccgtcctcaggcaggccctgccttcaccacctct

SEQ ID NO: 146873 - DNA, 601 bp, Human
gaacagcagtgcgcttcagcgggtggatgtcaggtggtttctgttgtgtgaaaacctgcagagagaagagcccactgctgcgtgcgtgcacctctgtgcccaggctcctgacggcctcttgggtgtgcagtctgcggtggcagccctgacaagccaccgcaccacgtgggtctgaaggtgtccccaatgcacagggtctcaggagcagcaatgactggcccagaccccacccccagagctgctgcccaggggcgccgggaaggggtccctgtgtgtggaccaggacttggcgcatctgccrgcggcatggcggttggaccctaagtccgttgggcggtggagggcccagcatctgtcctgccctgtctctttgctaaggactcgagtcagcacaggggcagctctgacgttttgccaccagcgtgtcagagtagctcccgggagccaccaggtggaggggcagaggccagctgaggacagccatgtggccactgaggccgggaccctgagacactgcctcagacccttagactggaaaggccctgcccactctctccagccccaaagtctccatggccctgtgagctgggtccaaacaagg

SEQ ID NO: 146874 - DNA, 601 bp, Human
ttgattgtccctgttcaccagcccatcatccccagtacaccaaagtcattttcttacatgcagagccactgtcccatgttccagaccctctctgctgccctcaggcttcactttggccaaccttcgttagctaagcctttgctaacctcacaccactcctcctcttactggggtttttgtgccagattgtcatgcagtagaactttctctccctgagcctggaccaccaagtgacctgtgcctggtggtgactaatttgttatatatctactgcatgtcatgcacgtgctaactgctcttktgccttttctaatttaaccgtgacagcaacttgctgaggcataggtgctatactagctcccttccacagactaggagattgaggctttcaaatggaaacgatttgccaaagctgcatctctagcagcaagatgcaaactcaggaagagcattccagaaatacttttggactcaaaagatcagatttggattttagaattagatcagactctctggcaggggagaataggttaagcagggcaagacaagtcacagagacgagttaggaggcagggcaggagcccaggctgcagctaataag

SEQ ID NO: 146875 - DNA, 601 bp, Human
tggcgtttgcaaaaaggatgtggttttttccaattccactgaaggcaaatcctagcacaaatatgggtactagtatgccgtctgagacagaaccatgacattgttggccagatgcagtggctcatgcctgtaatcccagcactttggaaggccaaggcgggtggatcacgaggtcaggagatcaagcccatcctggccaacatggtgaaaccctgtctctacaaaaaatacaaaaattagctgggcgtggcagcgtgtgcctgtaatcccagttactcaggaggctgaggcaggagaaccrcttgaacccaggaggtggaggttgcagtgagccgagaacacaccactgcactccagcctaggtgacagagggatactccttctcaaaaaaaaaaaaaaaaaaaaaaaaaggaaaaagaaaagaaccgcaatattgttatattaaccatatgtttaggaaatgagattcgaaataaatgttatggctgactgctgtgtttctatgtcctaccatagcaatagaaacctttaatctctgagagaaattatttctgagtcttgccttaccatttttataggcctgaggattgacttctaaagt

SEQ ID NO: 146876 - DNA, 601 bp, Human
agatgcagtggctcatgcctgtaatcccagcactttggaaggccaaggcgggtggatcacgaggtcaggagatcaagcccatcctggccaacatggtgaaaccctgtctctacaaaaaatacaaaaattagctgggcgtggcagcgtgtgcctgtaatcccagttactcaggaggctgaggcaggagaaccgcttgaacccaggaggtggaggttgcagtgagccgagaacacaccactgcactccagcctaggtgacagagggatactccttctcaaaaaaaaaaaaaaaaaaaaaaaarggaaaaagaaaagaaccgcaatattgttatattaaccatatgtttaggaaatgagattcgaaataaatgttatggctgactgctgtgtttctatgtcctaccatagcaatagaaacctttaatctctgagagaaattatttctgagtcttgccttaccatttttataggcctgaggattgacttctaaagtgcctagatgtggccgggcgtaatggcttacgcctgtaatcctagcactttggaaggccaaggcgggtggatcacttgaggtcaggagttcgagaccagcctggccaaca

SEQ ID NO: 146877 - DNA, 601 bp, Human
gcctgacttagtcaccaacagtggagcggtaggagcccccgctatcctcagatgggtgctgctgagacattgggtgtttatggaggacttgagagttggcagagcaagccttgtgtgctttctttccctggctcactagcacaggctaatcatgttgtcatcatgttctgtaagtacaccagtgtggtaatgtgttatagatgaggaaaatgagactctctgcagcttgtccaagggcacacggctacaaggcagaccagctggcctggcctggaaaaatccaagttttttcttcgagatkattagctgattatgaattttctgggaatatgcatttctagcccttagaggagccaagacttgctcctacctgtatttatttaagtcttaaattcaattaaaacaaatttaatcatgtcaactgttaccttctacctattttccttaaattatttttaaaatatgatgaatatataatacactcagaagggcattctaggctggaaaccttgtttcagaggttagctgacattttgagtggtgagcggccagccctgctggctgtattacaaacaagaccccttaaagccatgcgaccgtg

SEQ ID NO: 146878 - DNA, 601 bp, Human
tgctgggctgggtgcagtggctcgtgcctataatcctggcactttgggaggccaaggtgggaggatcacttgaggctaggagttccagaccagcctgggcaacatagcgagaccctgattgtacaaaacatggttttaaaaaattagccaggcatggtagcacacacccgtagtctcagcttcctgggagcctaagacaaggattgcttgagcccacaagttcaaggctgcagtgagctatgatcacaccactatactccagcctgaacagcagagtgagaccctgtctcttaaaaaaaaattaatttaaaaaagttttttaaaagagaaataccatctagtcacaatatacagccttatttggatcataatgcaagtaaactaaggaaagaaatgttaagacagttgaggaaatacgaacactgacaatctttggtgatattgaggaattactgttaatttttttaagtgttttgaggggtgagtgtgcgtgtttgtgtgtctgcatgagtctgtgtataccactgttgtgcatgcgtgtgtctgtgtagtgtgcatacgtgcctgtgtgtctttgtgcatgcgtgtgtgtgtgcatctg

SEQ ID NO: 146879 - DNA, 601 bp, Human
ctatgatcacaccactatactccagcctgaacagcagagtgagaccctgtctcttaaaaaaaaattaatttaaaaaagttttttaaaagagaaataccatctagtcacaatatacagccttatttggatcataatgcaagtaaactaaggaaagaaatgttaagacagttgaggaaatacgaacactgacaatctttggtgatattgaggaattactgttaatttttttaagtgttttgaggggtgagtgtgcgtgtttgtgtgtctgcatgagtctgtgtataccactgttgtgcatgcrtgtgtctgtgtagtgtgcatacgtgcctgtgtgtctttgtgcatgcgtgtgtgtgtgcatctgtgtgtgtcttagtccttttcagcacacatgctgaagtaggttccaatgaaatgaaatgaggaagtgcttaacagggaagctgtcgcctcagcagggagagcagctctctccctcctccgcacagaggatgccggctccggggtagagagtcctcgtgaaatccaatgggcttctctgctggagtgagttcaccagtctccccactgagaagtgtgtttaaattattcagtgagcttc

SEQ ID NO: 146880 - DNA, 601 bp, Human
gagatgcagaggtaatgccgcctgctcagcccagccttgggcgtggtgatggaccaccctgtcaggttatcttgtatgagattagtaagttatttccctagagaggtggcctaagcctcccttggttgagtcagagtcccgtgttcatgtttttcttaccagtgattgttatccccatgtctattcgacccttgaggattgtgtggcagatgagatgcctttgactcatacattgtctgggtctgatgattacattatacatgagggtcccaatggccccaggctgtgtatgactggccastgggcctcctgagcccacagcgtgtctctgatggtgatgggatggggtgcatatcctcagaacctgagcttatgttttgtgcatacaggatctaaggaatgagaaaaagatgtcatgtaccaatcattttaagggccagttttacataaaacttagtcatcactaagccaaagagcccccgcagcacaccttgtcactgacatctgtctgctgcagacccacctggcactgcctcccccactgctgcccacttccaggccgcctcttctaggacgacacaggtctccagccactttgcta

SEQ ID NO: 146881 - DNA, 601 bp, Human
gtgtgagacagcagtcgagggacttgaggcacagccctggggctggctctcctgagcccaggcagccagtgacctgtgactctggcctgcctcggtttctgtgcctgtgttcaattaggcactcgctgacttttacagtcctccgtgcctctcattggaatttgtcaaaattgagcccaccaaaggttcttatgttctgccaggaagtggcagacacccacaccccaggccaacgcctccctccccaactggcctgcttggtggggagcctgcctcctgcctccctttgggttcccgcccwtcctcaggtgtgttaaggaattatagcttagtgcccttgcccacctgcctctcaaaggtcagcacctttctaggaaacagcaggagaatgaagacatgtccttctaccagaaaggcctttcttgtgtcctccagtatcagctgaggccttctcgtggcctcccccttgcctgtgtcaattgtcccttttcccatcccccagactctctgcctccgccaaaatttaattaaatgcattgagaatctggaggagctacagagtcttcgagagctggatctttacgacaaccagatcaagaag

SEQ ID NO: 146882 - DNA, 601 bp, Human
ttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggtaggtgcagacagccctgactagtatattcagggagaggcagctagcgggttgtgtgtggactcagtgggtgtatgtagaatgcatggtgagtctgcatttcttacaatgctgtgatttttttcatgaacaaggaaattactatttttttargaaaaaatgctaactgaaagtcagtatcagtaagtcctgagtggtctagcctttcttccgcacgtagatttcagttgctcttcatccagatcatgaccctgaatcacactgttcccagttacattctgcctgagatgaaccaaccaacctgaatgccttgctcttgaacttcctcatggtcatcttctctggcatgcttcttcgagaagaaagtttcccaagcccagcaaagtggtcacttggagtgaattgatgtacataccggggctttagaaagcctcttgatcatggtcatcttct

SEQ ID NO: 146883 - DNA, 601 bp, Human
gggttgtgtgtggactcagtgggtgtatgtagaatgcatggtgagtctgcatttcttacaatgctgtgatttttttcatgaacaaggaaattactatttttttaagaaaaaatgctaactgaaagtcagtatcagtaagtcctgagtggtctagcctttcttccgcacgtagatttcagttgctcttcatccagatcatgaccctgaatcacactgttcccagttacattctgcctgagatgaaccaaccaacctgaatgccttgctcttgaacttcctcatggtcatcttctctggcatrcttcttcgagaagaaagtttcccaagcccagcaaagtggtcacttggagtgaattgatgtacataccggggctttagaaagcctcttgatcatggtcatcttctctggcatgcttcttcgagatgaaagtttcccaagcccagcaaagtggtcacttggagtgaattgatgtacataccggggctttagaaagcctcttgatcatggtcatcttctctggcatacttcttcgagatgaaagtttcccaagcccagcaaagtggtcacttggagtgaactgatgtacataccggggcttta

SEQ ID NO: 146884 - DNA, 601 bp, Human
gatgaaagtttcccaagcccagcaaagtggtcacttggagtgaactgatgtacataccggggctttagaaagcctcttgatcatggtcatcttctctggcatgcttcttcgagatgaaagtttcccaagcccagcaaagtggtcacttggagtgaactgatgtacataccggggctttagaaagcctcttgatcatggtcatcttctctggcatgcttcttcgagatgaaagtttcccaagcccagcaaagtggtcacttggagtgaactgatgtacataccgggggctttagaaaacctyttgatgctgacacactcccaaaggcagtgctgagttgggccttcctccctggacagctttatactcctggacaccgtccccagcaggattagatctgttctccaggatccatttgaccttgaaaacgtgggacagaatggaaataaaagaattttgaaaagtgatctggtgttccacagaagcaggatcaagtcttcaccagctgactcataaccaccgtcatgtgctggaggggaacttgggagggcgtcccaggaggactgacattggaggtggatctgccaggcagggaggagggag

SEQ ID NO: 146885 - DNA, 601 bp, Human
tgttccacagaagcaggatcaagtcttcaccagctgactcataaccaccgtcatgtgctggaggggaacttgggagggcgtcccaggaggactgacattggaggtggatctgccaggcagggaggagggagggttcccgtgggcaggaaggaggacttctctcagccagaagaacacttgagccccatgcctggctcctaatcagggtcatggcacggagcctttgctcccccggcctggcttagtggctttggcagctgtgtctaagcacatccgcccctgcccatgttcagaatgcccytctacttggcttctggaagtattacagcattctctgtctgtcctgggcccttgagagcttggacaggatacaaaccaagggagggtggttttggcaacagtctcttgacagttattgttagagatgtcatggccacaaatagcaaagcagcacatttaaaactagagagcagcccagatgtccgcattttaccaagtgtctcactatggaactttctagggcaacagtggctcatcacaaattaatgcaggctacagcatgtgaggatgcccctgcccccgccaagtcctgcagtggtgt

SEQ ID NO: 146886 - DNA, 601 bp, Human
gggagggttcccgtgggcaggaaggaggacttctctcagccagaagaacacttgagccccatgcctggctcctaatcagggtcatggcacggagcctttgctcccccggcctggcttagtggctttggcagctgtgtctaagcacatccgcccctgcccatgttcagaatgcccctctacttggcttctggaagtattacagcattctctgtctgtcctgggcccttgagagcttggacaggatacaaaccaagggagggtggttttggcaacagtctcttgacagttattgttagagatstcatggccacaaatagcaaagcagcacatttaaaactagagagcagcccagatgtccgcattttaccaagtgtctcactatggaactttctagggcaacagtggctcatcacaaattaatgcaggctacagcatgtgaggatgcccctgcccccgccaagtcctgcagtggtgtgtggattagcacaccatctcccctcctagagtccccacctggttagcatgcaccttatctggttattttgtgtctgctgaaatatttaaagaatgacttgttctgagagagagtgaactgacagag

SEQ ID NO: 146887 - DNA, 601 bp, Human
ctgtaggcaagtcaccatggggagaccagacagggcagcgtggtcactgcctctggaggtttatggttgaatagaggagcacacgatcacagcaagagtgatgtaggagggtgtggaaactgggcaagaggggcagagtgctgtggtgtgagggccccccaggaatcctaagtgagggtcccaggatttcaaagacttgaggtcagagtgccccgtacctctcttctgtagagactgaggctcttgggaggactttttttttttttttttgagacggagtctcgtgctgttgcccaggctrgagtgcagtggcacaatctcggctcactgcaagctctgcctcctgggttcacgccattctcctgcctcagcctccggagtagctggaactacaggcacccgccgccacgcccagctaatttttttgtatttttaataaagacagggtttcaccgtgttagccaggatggtctctatctgaccttgtgatccacctgcctcagcttctcaaagtgctgggatttccacgcccgacagggggacattttaatgtgtcagctcacaaatttagaactggaagggacttgggaatctactggtc

SEQ ID NO: 146888 - DNA, 601 bp, Human
tctgcatttgggagttggtaagcacttgggtgtgcctaggctcctgtttaccttttgtgttggaagcaaattagcagaattggacccttgaagcgagatggaacagagtgctctggggacgaggcccggtatggttagttgatccctgatcccttcgactgatactgaggggcatgtggaaaccgctcttaacccttggtgaagcagaagtttgtcaggcttctttaagaaagttcttggcctggtacagtggctcatgcctgtaacctcagcacttcgggagatctaggcggtcagatcrcttgagcccaggagttcaagaccagcctgggcaacatagtgagagcccatctctaaaaaaattaaaaatataaaaaaaagctcttaggccaggcgtggtggctcacgcctgtaatcccagccctttgggaggccaaggcaggcggttcatttgaggtcaggagtttgagaccagcctggccaacatggtgaaatctcatctctactgaaaatacaaaaattagccaggcatggtggcgggcgcctgtaatcccagctactcaagaggatgaggcaggagaaatgcttgaatccaggagga

SEQ ID NO: 146889 - DNA, 601 bp, Human
tggagacaggtttcaccatgttggccaggctggtctcaaactcctgacctcaggtgatcctcctgccttggcctcccaaagtgctgggattataggtgagagccactgcacctggcctaacaatgaattctttatataaaaaacatgtaattcccatgcatgaattttagctcagtacagcaggctcaaaattttgatcctctttttctctctacatgagtcccattctagcatgttttttgtttgtttgtttgttcgttttgagacggagtctcgctctgtcacccaggctggagtgcartggtgcaatctcggctcactgcaagctccacctcccaggtttacgccattctcctgcctcagcctcccaagtagctgggactacaggcacccgccaccacgcccggctaattttttttgtatttttttcgtagagacggggtttcaccgtgttagccaggatggtctcgatctcataacctcatgatcctctcgcctcggcctcccaaagtgctgggattacaggcgtgagccaccgtgcccagccctttatatatatatatttttttttgagatggagtctcgctctgttgcccaggct

SEQ ID NO: 146890 - DNA, 601 bp, Human
cagtggcatgatcttggctcactgcaatctccgcctcccgggttcacgccgttctcctgcctcagcctcccgagtagctgggactacaggcgcccatcatcacacctggctaattttttgtatttttagtagagatggagtttcaccacgttagccaggatggtctcgatctcctgacctcgtgatctgccccactcggcctcccaaagtgctgggattacaggcatgagccaccgcgcccggccccattctagcatgttttaagtgaaattctctgttcttagaattcttcaagataacacaaaacctcgtttcctaaaaaccgtttcatttcataccttctgtactgttctgacagctgtgtgctctccctcttgcagagcaaccggctgaccaagatcgagggtctgcagaacctggtgaacctgcgggagctgtaccttagccacaatggcatcgaggtcatcgagggcctggagaacaatgtaagacacccactgtctgtctggggctgtgtgggcggtgggcaccaggcgggcaggcacctggccagccagcacacactggcctctcgggccggtgtcaggaagatgccctgcct

SEQ ID NO: 146891 - DNA, 601 bp, Human
tctgcaacattttcctgcagtcctttttgctctgaacccgccccactgagctccctcgcacactgttgagcctgatactctgtgagcagacctgaccagggcaccgagatggggtggtttgaaggcacctcctaggcagcatgccacgtatagcctgctggagagtggcgtcagacttgacacacgcagctggtgccagctggggtgctgggcgccaaggcagcaagggtggtacagccagaggagctcccaggccacagccatagcgctttcgaattgggaaagctactggctgggtacrtttcaggggagatggggggaggagtatttgcttttgagaaattttttaactttcccttaaaacttagaaggctttggaattggaataccaaaaatgcagtagaaaaccaaggaagggactcaggagggagcagagcgtgagggcagagaagggaatgaactttgtcagaggttctcagacagcttgtaaatgttttccttttgatgagaaacaaaattattactcaggcttagctaacatgtattggaaagtgagtaactgatgtgcattttcagagtagaagatcctaaaaacacactc

SEQ ID NO: 146892 - DNA, 601 bp, Human
ctgcagtcctttttgctctgaacccgccccactgagctccctcgcacactgttgagcctgatactctgtgagcagacctgaccagggcaccgagatggggtggtttgaaggcacctcctaggcagcatgccacgtatagcctgctggagagtggcgtcagacttgacacacgcagctggtgccagctggggtgctgggcgccaaggcagcaagggtggtacagccagaggagctcccaggccacagccatagcgctttcgaattgggaaagctactggctgggtacatttcaggggagatsgggggaggagtatttgcttttgagaaattttttaactttcccttaaaacttagaaggctttggaattggaataccaaaaatgcagtagaaaaccaaggaagggactcaggagggagcagagcgtgagggcagagaagggaatgaactttgtcagaggttctcagacagcttgtaaatgttttccttttgatgagaaacaaaattattactcaggcttagctaacatgtattggaaagtgagtaactgatgtgcattttcagagtagaagatcctaaaaacacactcttgtctcccagtgg

SEQ ID NO: 146893 - DNA, 601 bp, Human
caaaatctttgctttacaagactccgggtgattgcagtacacacaaaggttggagaagccctgatctaggtatgggtagaacctacaattgtcatttgaccaaatggtttgcaaacctcagcagagaggcagacgcattccctacagatatattccagcacaacagaaggaaatgttggatgggtttctgcagttagtcatcttggaatttgccttgtatttgtcttgtcacaggtatggtttcaggagtagtgttgtggagtcagcaggaagagaaacagaatataagaagtttttgcarttcctctaaaggggttgggaaatgatccccgagtggaagtcttcagtgctaggattcccttagagaaatctcctaaggtttattgcctttccgctagcacgtggccctgcagagactgcggcacaggtgtcaccctgtgatgctgggaatgtagtagtgtcctcagatacattcagtctaatccaggattcatgctgagtgtaaggcatcattcttccttgtctctcctctagccgtgctgctgaccctgcttatgtcctgtgctttctcctttccccactttaaaaggtcatccaagtt

SEQ ID NO: 146894 - DNA, 601 bp, Human
cttggaatttgccttgtatttgtcttgtcacaggtatggtttcaggagtagtgttgtggagtcagcaggaagagaaacagaatataagaagtttttgcagttcctctaaaggggttgggaaatgatccccgagtggaagtcttcagtgctaggattcccttagagaaatctcctaaggtttattgcctttccgctagcacgtggccctgcagagactgcggcacaggtgtcaccctgtgatgctgggaatgtagtagtgtcctcagatacattcagtctaatccaggattcatgctgagtrtaaggcatcattcttccttgtctctcctctagccgtgctgctgaccctgcttatgtcctgtgctttctcctttccccactttaaaaggtcatccaagtttccctagaacacaggtggcctgctgcaaatgttccttgccccttattagtggcactgggtcttgagtagtgtcatgatgggataccagagcatgtctgggaagatcagagccagaatttggcaggtgataaagatgtaccaggccagggggagcctcaatgagtccaggtgggtctatgtgcagcccacccttgaaggaag

SEQ ID NO: 146895 - DNA, 601 bp, Human
gcaaaaaattagggagcaggtttgggaaacgagctgatactgaagcaatgttcctgaagcgtaacgattccttctgcatgccctgcctaggaacagagcatggggcacagagtgctgagaccacaggcaggggccaacctgggtaccacagctagcagggaggcaggcaggctggtgatcaatcactaggggccaggtagtgcctgaccctgtaacacagaagaatcctgttccttaggccaccaaagatagtaaaaaatagccagaatttgcacagcgctttatggtgtccatacctctytccattctgatccaattatcacagcaaccatgtggataaggtcatattaccccattttacaggtaaagaattgcattccaggaaggaaagctgcaaaccaggaattctcaaactcagttccatgctcatatcacatttgagaggcacatcattcatctctaaggcagaaatagaaaaccagtcttaacaagtttctgataacccacatactatgtttgttgatttttctgcctatttgttccaattactgagaggagaatgttgaaaccttccaactataattgtcaatggatccatttc

SEQ ID NO: 146896 - DNA, 601 bp, Human
tactgagaggagaatgttgaaaccttccaactataattgtcaatggatccatttctcctttcagttccatcagtttttgtttcttgtattttgaaagtctgttatcaggtgcatacatatttagaattgaggaattcttgatgaattgatccatttatcatatgaaatgttcttctttcttgcttatcctctttatccttgtcctggaagggtatcttgtctgttattaacacagccccttcatctgtcttatgattagcgctctcatggaatctttctccatccatttcctcttaacccrtgcctttataattaaaatgtgtttttcataaaaagtatgtaactagatcttgctttcttctccagtctgagaatctctgccttttaagtggtgtctttagactgcttacatttaatataattacatttaattacattttgtgtaatggttgagtttaagtctatcatcttagtatttgttttttatttgtctcatctattctttgtttactctttcctacctactttttggagtgacttttttttttttgcagtctattttaactctattattggcttatttgctatacctctgtattag

SEQ ID NO: 146897 - DNA, 601 bp, Human
ttatgattagcgctctcatggaatctttctccatccatttcctcttaacccatgcctttataattaaaatgtgtttttcataaaaagtatgtaactagatcttgctttcttctccagtctgagaatctctgccttttaagtggtgtctttagactgcttacatttaatataattacatttaattacattttgtgtaatggttgagtttaagtctatcatcttagtatttgttttttatttgtctcatctattctttgtttactctttcctacctactttttggagtgacttttttttttttgcagtctattttaactctattattggcttatttgctatacctctgtattagtgttttcttgttgattgtttggagggagggttgttttagcgattagaatttaaaaatacatttttaattttcaccatctatatattttacatttaaatatcttacgatccccatgataccttatcttttaaagaaatttaaaaatggccaggcgcagtggctcatgcctgtaatcctagcactttgggaggccaaggcaggtggatcacctgagatcaggagtttgagaccagcctggccaacgtggtg

SEQ ID NO: 146898 - DNA, 601 bp, Human
ttgaatccaggaggcagaggttgcagtgagccaagatcatgccactgtagtccaacttgggcaacagagcaagactttctcaaaaaaaaaaaaaaaaaaaaaaaaggacgggatcttgccatgttgcccagactggtctcgaactcctgagctcagacagtcctcctgcctcagcctcccaaagggctgggagtacaggtgtgagccaccacacacggccctggtttgcattatttctaataagaagccagcagtcatttttatcttttttcctctggctgctttttaatgttctttttartcattgtttcttattttgttttgttttttgcaacttgaatataacgtgccatggtgtagtttattttctgtgatgtgtcagggttaactgggtctgtgaatctatggtcttcatcaaatgtggaaagcttctggagactattttctctagaactgcttctgcccttgctcctcaccccggtttctctctgaaaacccagttatgcatgttcccctggcactagcgaggcccctgaggccattgcctccaccctgctccaccccttgggctttcatcttgctgtgcttgtttgtataattt

SEQ ID NO: 146899 - DNA, 601 bp, Human
aaaggacgggatcttgccatgttgcccagactggtctcgaactcctgagctcagacagtcctcctgcctcagcctcccaaagggctgggagtacaggtgtgagccaccacacacggccctggtttgcattatttctaataagaagccagcagtcatttttatcttttttcctctggctgctttttaatgttctttttaatcattgtttcttattttgttttgttttttgcaacttgaatataacgtgccatggtgtagtttattttctgtgatgtgtcagggttaactgggtctgtgaatytatggtcttcatcaaatgtggaaagcttctggagactattttctctagaactgcttctgcccttgctcctcaccccggtttctctctgaaaacccagttatgcatgttcccctggcactagcgaggcccctgaggccattgcctccaccctgctccaccccttgggctttcatcttgctgtgcttgtttgtataatttctgttgttaaatcttcaagatcatgatcttatcatctgtagtagcctatctgctgttaagcccatgtcatgaattttttatttcagatactgtatttttctc

SEQ ID NO: 146900 - DNA, 601 bp, Human
agcctcccaaagggctgggagtacaggtgtgagccaccacacacggccctggtttgcattatttctaataagaagccagcagtcatttttatcttttttcctctggctgctttttaatgttctttttaatcattgtttcttattttgttttgttttttgcaacttgaatataacgtgccatggtgtagtttattttctgtgatgtgtcagggttaactgggtctgtgaatctatggtcttcatcaaatgtggaaagcttctggagactattttctctagaactgcttctgcccttgctccycaccccggtttctctctgaaaacccagttatgcatgttcccctggcactagcgaggcccctgaggccattgcctccaccctgctccaccccttgggctttcatcttgctgtgcttgtttgtataatttctgttgttaaatcttcaagatcatgatcttatcatctgtagtagcctatctgctgttaagcccatgtcatgaattttttatttcagatactgtatttttctcaactctaaaagaacatttggctttatttttttttttttggtagattatttttctctcttcattagattca

SEQ ID NO: 146901 - DNA, 601 bp, Human
catttttatcttttttcctctggctgctttttaatgttctttttaatcattgtttcttattttgttttgttttttgcaacttgaatataacgtgccatggtgtagtttattttctgtgatgtgtcagggttaactgggtctgtgaatctatggtcttcatcaaatgtggaaagcttctggagactattttctctagaactgcttctgcccttgctcctcaccccggtttctctctgaaaacccagttatgcatgttcccctggcactagcgaggcccctgaggccattgcctccaccctgytccaccccttgggctttcatcttgctgtgcttgtttgtataatttctgttgttaaatcttcaagatcatgatcttatcatctgtagtagcctatctgctgttaagcccatgtcatgaattttttatttcagatactgtatttttctcaactctaaaagaacatttggctttatttttttttttttggtagattatttttctctcttcattagattcatgttttcctttaagtccttccttcttcacgtcttgtaattttttattagatcctgggctttatggtgttcaattgttgaatgt

SEQ ID NO: 146902 - DNA, 601 bp, Human
aaatcttcaagatcatgatcttatcatctgtagtagcctatctgctgttaagcccatgtcatgaattttttatttcagatactgtatttttctcaactctaaaagaacatttggctttatttttttttttttggtagattatttttctctcttcattagattcatgttttcctttaagtccttccttcttcacgtcttgtaattttttattagatcctgggctttatggtgttcaattgttgaatgtctggaatttatgttgttttccttcaaaacatactgaactttatctgacaggcarttaagttacagcttgatccttttgaggcttgtttttaagctttattagagtacatctaaatagtctactccgtaagattaatctagcactgttttgaagctgtggccctcctaggatctctggtgaatatcctgtgtatttaagttctctccactgtggttgacgggaacacaaacatggacctgctatgggtgagctctgggcattctgcatcttggggctgcttagtagttcttcgaccagcctttagcttttcactctgcctagcacagcttcatcttcagtccaggattccacagg

SEQ ID NO: 146903 - DNA, 601 bp, Human
ttcaattgttgaatgtctggaatttatgttgttttccttcaaaacatactgaactttatctgacaggcagttaagttacagcttgatccttttgaggcttgtttttaagctttattagagtacatctaaatagtctactccgtaagattaatctagcactgttttgaagctgtggccctcctaggatctctggtgaatatcctgtgtatttaagttctctccactgtggttgacgggaacacaaacatggacctgctatgggtgagctctgggcattctgcatcttggggctgcttagtarttcttcgaccagcctttagcttttcactctgcctagcacagcttcatcttcagtccaggattccacaggataccatgtggatttctggaggctttttccctacatagctcactcctatctatacattccagctccctttgcctccccaaactacaatcaccatctcaactctgtgtggccaccaggctctgcttgggttccgcctccttgtggtcctgaaagttcctccaggcagaaggccgggatgatcacaccacccacctcatttgtttcctgtctctcaagaatcactgtctgtgt

SEQ ID NO: 146904 - DNA, 601 bp, Human
gttgaatgtctggaatttatgttgttttccttcaaaacatactgaactttatctgacaggcagttaagttacagcttgatccttttgaggcttgtttttaagctttattagagtacatctaaatagtctactccgtaagattaatctagcactgttttgaagctgtggccctcctaggatctctggtgaatatcctgtgtatttaagttctctccactgtggttgacgggaacacaaacatggacctgctatgggtgagctctgggcattctgcatcttggggctgcttagtagttcttcraccagcctttagcttttcactctgcctagcacagcttcatcttcagtccaggattccacaggataccatgtggatttctggaggctttttccctacatagctcactcctatctatacattccagctccctttgcctccccaaactacaatcaccatctcaactctgtgtggccaccaggctctgcttgggttccgcctccttgtggtcctgaaagttcctccaggcagaaggccgggatgatcacaccacccacctcatttgtttcctgtctctcaagaatcactgtctgtgttgcctgt

SEQ ID NO: 146905 - DNA, 601 bp, Human
ttgggttccgcctccttgtggtcctgaaagttcctccaggcagaaggccgggatgatcacaccacccacctcatttgtttcctgtctctcaagaatcactgtctgtgttgcctgttgtctgatgtataaaaacaattatttcatatattttatcctcttttttttttttttgagatagagtctcgctctgtcccccaggctggagtgcagtggcgcgatctcagctcactgcaagctccgcctcctgggttcacaccattctcctgcctcagtctcctgagtagctgggactaccggtgcmcgccaccacgcctggctaattttttttgtattttagtagagacagggtttcactgtgttagccaggacagtctccatctcctgacctcatgatccgcccgccttggcctccccaggtgctgggattacaggtgtgagccaccgcgcccggcctattctatcctattttctagtagcttgtgacaaaggcaggagctcagcaccagctattctgtcatggcttgaaacagaagtcctacttatttatcttacttttgtgtctgtctcccccactgtataatacaaacctcataagggcagg

SEQ ID NO: 146906 - DNA, 601 bp, Human
ctcctgcctgggcctcccaaagtgctgggattacaggtgtgagccaccatgcccagtcagtgcctgaaacatatttgaatgagcagaaggaacatagaaaaggctggccaactgggtggaggccagctacagataacattggaaaatatgttatccacatgtgtcagatgcagggctaacatccttacattaaaaacagctcacacccaggtaccacttgaaaactagggtgttcacagagcaagaagtaacagttgcttgtaaatacataaagcatttcctatctcattaatttttttttctttcttttttttttttttgagatggagctttgctcctgtcgtccaggctagagtgtagtggcacgatctcggctcactgcaacctccacctcccgggttcaagtgattctcctgcctcagcctcccaagtagttgggattacaggtggctgccaccaccatgcctggctaatttttgtatttttagtagagacggggttttgccatgttggccaggctggtcttgaactcctggcctccagtgatctgcctgcctcggcttcccaaagtgttgggattacaggcgtgagccactgtgcc

SEQ ID NO: 146907 - DNA, 601 bp, Human
gatttgcgttgggcctcattcaaagccatcctaggccatttacagcctgcaggccgtgggttggacaagcttggtttaaggcgtgtgtgtgcatcattttcgtgactctccactttaaggggctctttctgttaactgaccagtgaccggccaatcacaggcctggcaggtggatggcttcccctgtaattctagtgttgcaggctctgcactggccacacaaccagcggggcggtgcgagtgtagtaacagagtagcatttaagaaggtacgctcacgtcccgtccacatggaggcactrgtcgggacagcagcagcagggcaccagccctggtggtgcagctcctcccagcaggtgtcagtccctcttcaagggctaagctctaggatttggaattcttggtttcccaaggctggtacgcactagtcccacaaaaggttctgtgaaaatagggtccctcaggccaggcgcagtggctcacgcctgtaatcccagcactttgggaggctgaggcgggtggatcacttgaggtcaggagttcaagaccaggctggccaacgtggtgaaaccccatctctacaaaaatacaaaaattagccg

SEQ ID NO: 146908 - DNA, 601 bp, Human
ggacctggtgcaaaactagccctcctgccacagacagatagaaaaatatgaaacaactctattcaggcagtggacagcaggcagcacgcacctgcaggctctgaggagggagttccagcgcgagccccgtgatcaccccactccttacctgggatgtttcccaagcagaacacagtacttctgagtggaagaggcagagatcaacatctctggcagctagagtgtgccagacagggccccagagagaaggggagctgtgcagagcaggggtccagaagtccatgcagggaccccccagtcrgaccacagctgtgggcagggcagtgggcagtgtgggccccagagtagaacgcccctgcttgccttccgttccacatggacagttcccttcctaacttccctgtaaaaggagtcgaagtctgtcaccctataacgagtgcccctgcctgtgcccattgtaggttcacagtcaagtccagctgcctcttcaggagcagtgcccgtgctcttgccaccgcggtttgcctggcaggccctgaggccgggcagctctgaacatgtgatttctacacacagggtgtttgaaagggagggtcagacc

SEQ ID NO: 146909 - DNA, 601 bp, Human
cttccgttccacatggacagttcccttcctaacttccctgtaaaaggagtcgaagtctgtcaccctataacgagtgcccctgcctgtgcccattgtaggttcacagtcaagtccagctgcctcttcaggagcagtgcccgtgctcttgccaccgcggtttgcctggcaggccctgaggccgggcagctctgaacatgtgatttctacacacagggtgtttgaaagggagggtcagaccaacagggtttgaagctggactggctccccttgttctggagatggcaccactgcactccagccwgggcgacagagcgagactctgtctcaaaaaaaaaaaaaatgcaagagaactcttcctgccaaaggcaggtccctccaactgggcatggcagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttg

SEQ ID NO: 146910 - DNA, 601 bp, Human
cgttccacatggacagttcccttcctaacttccctgtaaaaggagtcgaagtctgtcaccctataacgagtgcccctgcctgtgcccattgtaggttcacagtcaagtccagctgcctcttcaggagcagtgcccgtgctcttgccaccgcggtttgcctggcaggccctgaggccgggcagctctgaacatgtgatttctacacacagggtgtttgaaagggagggtcagaccaacagggtttgaagctggactggctccccttgttctggagatggcaccactgcactccagcctgggygacagagcgagactctgtctcaaaaaaaaaaaaaatgcaagagaactcttcctgccaaaggcaggtccctccaactgggcatggcagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaa

SEQ ID NO: 146911 - DNA, 601 bp, Human
cttgccaccgcggtttgcctggcaggccctgaggccgggcagctctgaacatgtgatttctacacacagggtgtttgaaagggagggtcagaccaacagggtttgaagctggactggctccccttgttctggagatggcaccactgcactccagcctgggcgacagagcgagactctgtctcaaaaaaaaaaaaaatgcaagagaactcttcctgccaaaggcaggtccctccaactgggcatggcagggccaagatggtaaaatgtagcctgcaactcagacctctgaatcccacctgcwcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaatgatggctgagaactggtttgtagaaagtgcagcccaccctgctttgacacttgcctatggacaagtgtagcaggcaggtggccagaactgctttgtccttcctctgctgacctgaatgtggacttggccccgtcatagt

SEQ ID NO: 146912 - DNA, 601 bp, Human
aaaaaaaaaaaatgcaagagaactcttcctgccaaaggcaggtccctccaactgggcatggcagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaatgatggctgagaactggtttgtakaaagtgcagcccaccctgctttgacacttgcctatggacaagtgtagcaggcaggtggccagaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcgccatcttctgagtgggaaggaggagggtggctagtggaccccaccagagtcgagggctggg

SEQ ID NO: 146913 - DNA, 601 bp, Human
cagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaatgatggctgagaactggtttgtagaaagtgcagcccaccctgctttgacacttgcctatggacaagtgtagcaggcaggtggccrgaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcgccatcttctgagtgggaaggaggagggtggctagtggaccccaccagagtcgagggctgggctgtttggttctaaaggcttttctgctgtgtgtgtccccagatgaacgacaatctccttga

SEQ ID NO: 146914 - DNA, 601 bp, Human
ctgtgtcacagtgatggcgcagagtgcagccttgggaatgatggctgagaactggtttgtagaaagtgcagcccaccctgctttgacacttgcctatggacaagtgtagcaggcaggtggccagaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcrccatcttctgagtgggaaggaggagggtggctagtggaccccaccagagtcgagggctgggctgtttggttctaaaggcttttctgctgtgtgtgtccccagatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgt

SEQ ID NO: 146915 - DNA, 601 bp, Human
tgctttgacacttgcctatggacaagtgtagcaggcaggtggccagaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcgccatcttctgagtgggaaggaggagggtggctagtggaccccaccagagtcgagggctgggctgtttggttctaaagscttttctgctgtgtgtgtccccagatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaac

SEQ ID NO: 146916 - DNA, 601 bp, Human
gcctcattgtggttttgatttgcgtttctctaatgagtgatgttgaactttttttcatatgattgttggctgcctgtatgtcttcttttgagaagtgtctgttcatgtcctttgcccacttttctgtggggttgttttttcttgtaaatttaagttcctcatagatgctggatattagacctttgttggatgcatagtttgcaaaaattttctcccattctgttggttgtctgtttactctgttgatagtttcttttgctgtgcagaagctcgttagtttaattagataccatttgtcaattttttttttgcttttgttgcaattgcctttggcgtcttcctcatcaaactctgcttgtgcctgtgtcctgaatggtattgcctaggttgtcttccagggtttatatagtttggggttttatatttgagtctttaatccatctagagttactttttgtatgtggtataaggaaggtatccagtttagatcttctgcatatggctaactagttatcccagcactatttattgaatagggaatcctttccccattgcttatttttgtcaggtttgtcaaagatcagatagttgcaggtgtgtg

SEQ ID NO: 146917 - DNA, 601 bp, Human
gtcttcctcatcaaactctgcttgtgcctgtgtcctgaatggtattgcctaggttgtcttccagggtttatatagtttggggttttatatttgagtctttaatccatctagagttactttttgtatgtggtataaggaaggtatccagtttagatcttctgcatatggctaactagttatcccagcactatttattgaatagggaatcctttccccattgcttatttttgtcaggtttgtcaaagatcagatagttgcaggtgtgtggtcttatttgtgggttttctcttccattggtctrtgtgtctgtttttgtaccagtaccatgctgttttggttactgtagccctgtagaatagtctgaagtcaggtgaggtgatgcttcccgctttgttcttttcacttaggattgccttggctatttaggctcttttttggtttcatatgaattttaaaatagttttttctagttctttgaagaatgtcatcgggagtttaatgggaatagcattgtatctataaattgctttgggcagtttgtatgaatttgcatagccattttaatgatactgattcttcctacacatgaatatggaatgtt

SEQ ID NO: 146918 - DNA, 601 bp, Human
tgacactgaaactgaaggagagatttttaattccttagtgcaatactttggtgacaacttggggcgaaaagttaaagcgatgccattagttgaagaaacttctttactggaagattcgtcagtgacttttcctgtggtaataataggtaagttattgtattttatcttttaaaattatagttaatgacccttaatacttttataaatctacagttagtacaagttcttaagattttattgaaaagtattcttaggtggtttgatatgctaaaaaactaataaccaaatctttggagagtamttggtttatctgattttagcatctgtgttaaaatgcagtatctttttagtgaagaactgatattactacattattttaaaatatctcctacatttgtgttaattatatgacagtgtcatggtaatgtgataatattattagagctctgaagagtattctatgtatattattggataataccttacaactctgcagacttctgatgttggtagggcggatacagacagagaaactgacacagatgttgagtaacgtgcaagttagtaaccggtgctgtattagcaatgacattatagtact

SEQ ID NO: 146919 - DNA, 601 bp, Human
aaaaaaagaaaagagggccaggcctggtagctcacacctgtaatcccagcactttgagaggctgaggcgggcatataacaaggtcaggagatcgagaccatcctggctaacagggtgaaaccttgtctctactaaaaatacaaaaaattagccaggcatggtggcgagtgcctgtagtcagtcccagcttctcgggaggctgaggcaggagaatggtgtgaacccgtgaggcagaggttgcaatgagccgagatcgcaccactgtactccagcttgggcgacagagcgagactccgtctcaaaaaaaaaaagatataaaattagttctaaatattttttatttttctttcagtctttaaggcttcctattctagaattataagttgaaatctttctctgctttctctgtttctagtattcttatggttttacttttcttatatctttgagtatattttatttggggtaacatattaggtaaggaacaggattttttctttgcagctagcaattctctaggttggattaaatttttgaaaggcagatataataagtggtaatccagaataaaggaattattaattcataaatggaagtagtt

SEQ ID NO: 146920 - DNA, 601 bp, Human
ccaggcatggtggcgagtgcctgtagtcagtcccagcttctcgggaggctgaggcaggagaatggtgtgaacccgtgaggcagaggttgcaatgagccgagatcgcaccactgtactccagcttgggcgacagagcgagactccgtctcaaaaaaaaaaagatataaaattagttctaaatattttttatttttctttcagtctttaaggcttcctattctagaattataagttgaaatctttctctgctttctctgtttctagtattcttatggttttacttttcttatatctttgagtrtattttatttggggtaacatattaggtaaggaacaggattttttctttgcagctagcaattctctaggttggattaaatttttgaaaggcagatataataagtggtaatccagaataaaggaattattaattcataaatggaagtagttcaggaaatccagtttggttttagttaaagcatataaacatataggaaagcaatatcaggatttaggactggaaagatggttgagatgtataatcacctggcagtttcttgcctgctgcacagacaaaaccatttcactgagaccatggcgt

SEQ ID NO: 146921 - DNA, 601 bp, Human
ccgtgaggcagaggttgcaatgagccgagatcgcaccactgtactccagcttgggcgacagagcgagactccgtctcaaaaaaaaaaagatataaaattagttctaaatattttttatttttctttcagtctttaaggcttcctattctagaattataagttgaaatctttctctgctttctctgtttctagtattcttatggttttacttttcttatatctttgagtatattttatttggggtaacatattaggtaaggaacaggattttttctttgcagctagcaattctctaggttgrattaaatttttgaaaggcagatataataagtggtaatccagaataaaggaattattaattcataaatggaagtagttcaggaaatccagtttggttttagttaaagcatataaacatataggaaagcaatatcaggatttaggactggaaagatggttgagatgtataatcacctggcagtttcttgcctgctgcacagacaaaaccatttcactgagaccatggcgttgcagtaaagaagttgacacaaggccagcccatgtgagagaactgcagttgttcaaattagtctcctgataa

SEQ ID NO: 146922 - DNA, 601 bp, Human
gttgagatgtataatcacctggcagtttcttgcctgctgcacagacaaaaccatttcactgagaccatggcgttgcagtaaagaagttgacacaaggccagcccatgtgagagaactgcagttgttcaaattagtctcctgataaaactcctgattggttgggcgtgatggctcatacttgtaatcccagcacttggggaggctgtggtgggtggatcaagagatcaagactgtcctggccaacacgctgaaaccccgtctctactaaaaatacaaaaataagctgggtgtggtgtcgtgyacctctagtcctagctacttgggaggctgaggcaggagaatcgcttgaacccaggaggcagaggttgcagtgagccgagatcatgccactgcactccagcctggtgacacagcgagactctgtctgaaaaaaaaaaacacaacgaaaaaaacaaaactcctgatccctcctgatggcttggaggttagggtttttcaaggatagttgggtgaacaggggactagggaataggtgctgctgattggttggggatgccatgctgggggtatcaaaaatggttctctagcactgagtccaact

SEQ ID NO: 146923 - DNA, 601 bp, Human
caaattagtctcctgataaaactcctgattggttgggcgtgatggctcatacttgtaatcccagcacttggggaggctgtggtgggtggatcaagagatcaagactgtcctggccaacacgctgaaaccccgtctctactaaaaatacaaaaataagctgggtgtggtgtcgtgcacctctagtcctagctacttgggaggctgaggcaggagaatcgcttgaacccaggaggcagaggttgcagtgagccgagatcatgccactgcactccagcctggtgacacagcgagactctgtctsaaaaaaaaaaacacaacgaaaaaaacaaaactcctgatccctcctgatggcttggaggttagggtttttcaaggatagttgggtgaacaggggactagggaataggtgctgctgattggttggggatgccatgctgggggtatcaaaaatggttctctagcactgagtccaactctgggtggggggccgcaggactggttcagttgagtcttgggtctgagtcttgaatcttgggaccaatagagtcagacagtcatcagaaatgcaaaagtctgaaaagacatttcaaaaggccaacct

SEQ ID NO: 146924 - DNA, 601 bp, Human
ggggactagggaataggtgctgctgattggttggggatgccatgctgggggtatcaaaaatggttctctagcactgagtccaactctgggtggggggccgcaggactggttcagttgagtcttgggtctgagtcttgaatcttgggaccaatagagtcagacagtcatcagaaatgcaaaagtctgaaaagacatttcaaaaggccaacctcaggatccacagtagcgatgttatctgtaagagcaattagggaagtcacacatcatgtgacctctggctgcgtgactcttcagcagtaarggattatagaaactctgcctacatcttagcagaattccggcacctctcataatccgaaccttgtggcctttcattagttttagaaaggcggtttaattttgggaaggactgttaccatccttgctttaaggttaaactataaattccttccatgattagctttgcctatacccaggagtgagggaagacagccggcctttgaagctagaagcaagatggagtcagccatgttagatttctctcactgtcataatctttgcaaaagttgtttcaaatggagaacactggatagtcagaaac

SEQ ID NO: 146925 - DNA, 601 bp, Human
tacttgatcctacctgcattccatatcttaatcttactgtgcttgcctgtggtactatttatctgtttatgcgaccatctcccctgctatggtttatgtacatcctaattaacctgagttgtgacttaagacgtaaactccttgagtcatcacccctctctcctacttagcttcatatagttctctgtttctcttgtgatctagtttctcatcactcttctctcttccaaactttctgtggccccttgaaccaattttgtgataaacaacttgtttgctttcccacatctttaaccattcwgtcagatgctgcttctgctccctttcttgaaagcttactctttcctaaagataccattcccactgtagccctctgaagtggagcctattcattctcccatagccctatgtcccatcaggttggctagtaaggttggtcttctcttcacacccctatgcacttgtgtaaaaagccctgttccattgaacagatgatgccattttctagcttttctaccattccagactgtctccagactgtctccatttctggcttttttaccattccagactgtctccagttactgaatctgtggcacct

SEQ ID NO: 146926 - DNA, 601 bp, Human
gtttggtcactccttttctgatacctttgtggattcttgtcttttttgttgttgttgtttttgagagagggtctcactctgtcatgcagggtggagtgcagtggtacagtcatagctcactgcagcctcggacccctgagctcaaatgatcctcctgccttagcctcccagtgctgggattgcaggtgtgtgccaccacacccagctgactcttgttctttaaaaattgcttctgtagaccttatcccaagcccaggtcttttcttcatactcttcattctccctgggttatcttacctayttcaatggcttgcatattgatattaattgattcccaaatcagaattcccaaaatcaaaaccagcccagattgctgtttctcatatacccaagtaaatacattcccttgattattctgcaggtgtcctcagactcaacgtacctaaaactaactatctttatcatcaagtcccttcaatttccttgtcattaaatggcattctcatgtagttactcaagccaggaacctgagagtcttccttgatttctctttcttcaactcccatttcaaattaatcaccaaatctttttcatttatgat

SEQ ID NO: 146927 - DNA, 601 bp, Human
agggtggagtgcagtggtacagtcatagctcactgcagcctcggacccctgagctcaaatgatcctcctgccttagcctcccagtgctgggattgcaggtgtgtgccaccacacccagctgactcttgttctttaaaaattgcttctgtagaccttatcccaagcccaggtcttttcttcatactcttcattctccctgggttatcttacctacttcaatggcttgcatattgatattaattgattcccaaatcagaattcccaaaatcaaaaccagcccagattgctgtttctcatatayccaagtaaatacattcccttgattattctgcaggtgtcctcagactcaacgtacctaaaactaactatctttatcatcaagtcccttcaatttccttgtcattaaatggcattctcatgtagttactcaagccaggaacctgagagtcttccttgatttctctttcttcaactcccatttcaaattaatcaccaaatctttttcatttatgatattttgggtccatctactctattttgttgctaatattggtcaccgctgtctttcaccagaattactgcaaaccctttctaaatggtt

SEQ ID NO: 146928 - DNA, 601 bp, Human
ctttcttcaactcccatttcaaattaatcaccaaatctttttcatttatgatattttgggtccatctactctattttgttgctaatattggtcaccgctgtctttcaccagaattactgcaaaccctttctaaatggttttcttactcattgtctcttctccaatccattatccataccaaagccagactcatctttctaaattacatgtctgagatgttacaccaatgcataaaactcttcagttgctctccatctaacatatagtatgtagacttcgtaatgtatctcaccatactccratctagcccttattaggtttcttgtcatattcctctttttatctctgacattctgtgctctagcatgcttttgttggggagtccaagttcattctcagtctcgaagattcaataggattcacaggactcagtaaagatggtgtacttgtggttaaattttactatagtgaaaggatacagattagaatcagcaatgggaaaaggttcacagggcaaagtccaggagaaaccaagtgtaagcttctagatatccactcctagtaaagtcactggtgcgtggtgtcgagggatgttttctgt

SEQ ID NO: 146929 - DNA, 601 bp, Human
caggtacttggcctttgggcttttcttgctttgtattgaacaaagcagaaataagtaggtcaagggagcttgatggcaagcagtagcctcagctcgtttgtttctcaggcatccactgcctatttctgtatccttaagaagagatgctgctgtatccacatcagcctagattttagaattataattgatggaggagggaaaagcttctttgttgctaattaaaagaaagttaataatattaaaatggaaagccatctaaaattttggaacttaatgaacatttttccttttgttcaaaaartgaatatactgaatttttgtttccctgacataatattgtacatctgaattatgttgatcatagaccaaagttatcaacattgtgtaggcattggataatattgtaaatttgttttataaatttataactatatgaaagaaggttgtcgggataatatcaagtgatgaaggtatatgaaagtttattggagtaatgtttttgaggtaagttagccaaccatttaggactgcaggagcgcaccttgtccagagtcataattattgtaaatgagatggatatggttaaaaaacagaccaaaaa

SEQ ID NO: 146930 - DNA, 601 bp, Human
accatgttacttcttgttttttgacggtacatttttttttttaaactctaatagaatatggaaggctccatgttgacaatcagctttggaagttggatggaactacctggacttaaatttaaggactgggtatcaagtaaacgaaggtaaagattgaactgtattaaaattctttggtgtacgttgaaaaagagaatgtggaaaaatttcaaaatatttgtgattttgtcatggctgaagaatataaatgtacgtctttcaaataaaaatgtgtccttgaagcagtgattataatatgctrgttttcatttagagatgttataaaactaagcacagagctaagggattattgcagattggtttcctgtgacttttgttaatcatgggtttatctactgtcttgttacatcactctctgtttagttactttctcatccatccatatattatttttcatactttatttttatgcattgatatataactttatctatgcatatctcttatatgaatacctaaactctgcatacctaaagtgtttgactttcagtataaagattgtatattttatgattgataatttaaaatgatggataagcta

SEQ ID NO: 146931 - DNA, 601 bp, Human
aggcattttgttagatgattttgcccaactgtaggctagtgtaagtgctctgagcacatttaaggcaagctaggctaagctttgatgttcagtaagctagttgttattaaatgcatttttgacttaaaatattttcaacttacaattggtctatcaggacaaaccctactgtaaattgaagagcatccacatcatgaattatgtcaaataatttgcttcttatctctgattggggcaggggattttgcttgttgctttgaactttggaaaatgacatacagactaatgcaagtttttcataacagttatgttttagctctgcttgtgagtaggaaaacacatagagtgaaatgtcatctgttacttaacctagatgtaagatgactttgtttagcaaaagacagatctgaattattttcagctgttaggaaaatagcagtgtactaaaattcatgtcaagatggcatgtataattttaagaagcatagatattagttaggcctgtaatatctcaatgattgccatgaaaataattcagttgataattatagattataattgtgagataaagtagtccaattttcaaatatccacattttaa

SEQ ID NO: 146932 - DNA, 601 bp, Human
ttgcttgttgctttgaactttggaaaatgacatacagactaatgcaagtttttcataacagttatgttttagctctgcttgtgagtaggaaaacacatagagtgaaatgtcatctgttacttaacctagatgtaagatgactttgtttagcaaaagacagatctgaattattttcagctgttaggaaaatagcagtgtactaaaattcatgtcaagatggcatgtataattttaagaagcatagatattagttaggcctgtaatatctcaatgattgccatgaaaataattcagttgatarttatagattataattgtgagataaagtagtccaattttcaaatatccacattttaataccttcatttaatgaaagtttatcaagcagtgtatttgagcagacactatgcatggcactggggaaacagaagtgcattaaatatagtctctgctctcatgggacttcttccaattttttgctaaaaagtaactcatgaagatttttaactaaaaatagttttttttttaagtgttaggataatgtatagctaagacagtccagcagaattaaaaagctataaaagcttactaggtagataag

SEQ ID NO: 146933 - DNA, 601 bp, Human
acttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctcctt

SEQ ID NO: 146934 - DNA, 601 bp, Human
caccattagacaatacagtttgagaaggagaaaatgaactcatttaaaaattaattgtaatctgacaattttgaaattcctttgctgaagaaaaatatggaagttttgaggttcagggttgggaggcaagagaggtacctgttagtgtggtttgtccccttcctagcacatgtagcctcaagtttgaattcctgggagaagaaaagtctttacatctgtgatgtgggaggttgttccagggaacatcatgtttttgtgggcaaatacaagttgttataattaaaacccctaatttgaatakttttgttaccaagaaccaaggcaaatgtttaatttgttataaaacctgtttgtgaagtgctgtgttaaattgtgctgctggctaataggcctcatttcaatttaataaatatttattgaggactggctttatgtctggccctgtgctatgccctgggactcaaaatttaaaaaatacgagccctgctctcaactgttctcaagttgctctcagttctattgaggaaaacattcagtcattcagttgtttatgaggaaacactaattaattaagtacctattaagtattgggcattctttg

SEQ ID NO: 146935 - DNA, 601 bp, Human
gtcaggttgctgggggacagggtatggtgggcttttcttatttatgtagaaaattgagcatttactatttgctaggcaccttactagggatatgaaggtgagaagaagagctgattcctgctgtcaagaagcatagagtccaatggcattatggtatgatgtgccgcatgttaggttgggtgttcttgcttttggatgggatcccaaataaatagcatccgttttttccagtctgaaaaatgagtaaagatggaagccaaagtatcacttttattgtggtttgtgagaggaagctgggccyatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggc

SEQ ID NO: 146936 - DNA, 601 bp, Human
acaaatggctaaaccctgagtaatcctctcatctgttgagaggtgatggtggcctcaacgagggcatgcattgggtttggagacactcaaagttgagtgatatttaggaggtaaaatcagaggccttggtgattggttggtggtgaggatgagagatggggctatgctcagtggtgacatgttgccatcaaaattgtgagcagaaatacgatatcatcaggtaagactggaagtagggagaccaaacatccaaacaccagtgatgagggtctgaactgaggatagcattagagctactggrgactaaaacgaactgggcttggtttgaatgtatggggtaagatgaagcccagatttctgtctttggcccctgagctaaggacagtgccactctcttgagtgaggacattaagtgggggctggagggagaagaggagtaagtgacatcagtcctgaaatgtcagtagggtctgggactcctcaagtggtatatagataaataagctacagaagtagaggagagaatgttaattctccctgggagtgttagggaaagcaccagagctctcacagctgggtttcaatgatgaatgttgggtga

SEQ ID NO: 146937 - DNA, 601 bp, Human
taagtcttgtacttcttttattaaatgtattagtattcttttcaatatgattataaacagaattgttttcttaatttcattttcatcttaatgtatatctttgatcatagctccttctccccctgcttctttcccaaatgaatgagtatttcttttagataaattcctgcatgtggatttgctgggtcaaagagtatttgtatctaacatttaaaaaaatgttgccagattggcctcctaagaagttgccagaattcttatcaacagattgtaagggtggctttaatcaactgtttcttgkattatagatgataaaattttgaaccttgctggtctggtaagagaaaaattatgtctccttttgtttaaatatgcttatttagttataaatatggtcgtatatttgttttttgtttgtgtggagtacctttctaagccctttgcttagtttttctatttgcaagtaactcagtacttgtatagattgatttagattttcttttcttttcttttttttttttttaagagggagtcttgttccgttgcccaggctggagtgtggtggcacgatcttggctcactgcaacctccgccatctggg

SEQ ID NO: 146938 - DNA, 601 bp, Human
ttccgagtagctgggattacaggcgcctgccaccacacctggctaattttttgtatttttagtagagactgggttttgccatattggccaggctggtcttgaactcctgacctcaggtgatccacccgccttggcctcccaaagtgctgggattacaggcgtgagccaccgcgcccagccagtactttcattttctataaaataaacaggtatttcaaaatatctgttattgtgatgaatataggaagggtaagaccatgtggaaggaatttcttcttattaggcatattctggtaccctrtaaactctgttccaaagtctgaggctttagagactggtttaaaaatccaccccttcaccattttgaatggtgtaaaattttaggtaagccaagtagtcatccaaacaacagttactgtgtcatttgcaattgcagattgtccggaatattttttgtttttacattgtaatgtttttaagagtttaaatatattattttcattttaataataatttctattcatagttttttttgtagaatgtgagactgcatgaataaatgtagtctctttgaacccataaatttagtacaaaacctact

SEQ ID NO: 146939 - DNA, 601 bp, Human
ataaacaggtatttcaaaatatctgttattgtgatgaatataggaagggtaagaccatgtggaaggaatttcttcttattaggcatattctggtaccctgtaaactctgttccaaagtctgaggctttagagactggtttaaaaatccaccccttcaccattttgaatggtgtaaaattttaggtaagccaagtagtcatccaaacaacagttactgtgtcatttgcaattgcagattgtccggaatattttttgtttttacattgtaatgtttttaagagtttaaatatattattttcattttaataataatttctattcatagttttttttgtagaatgtgagactgcatgaataaatgtagtctctttgaacccataaatttagtacaaaacctactaacattataccatgaatatattttctttgtaaacctggcttatcaaggaaataatttaaatctgtgagtagataatgttaaagtaaactggtttaaaagtgactaattcaataagttagtatcaaatatataaaaatgatctaaatttgacttttagaaaaaattcacattgatttttgtatataaataacatctatactt

SEQ ID NO: 146940 - DNA, 601 bp, Human
aatatctgttattgtgatgaatataggaagggtaagaccatgtggaaggaatttcttcttattaggcatattctggtaccctgtaaactctgttccaaagtctgaggctttagagactggtttaaaaatccaccccttcaccattttgaatggtgtaaaattttaggtaagccaagtagtcatccaaacaacagttactgtgtcatttgcaattgcagattgtccggaatattttttgtttttacattgtaatgtttttaagagtttaaatatattattttcattttaataataatttctrttcatagttttttttgtagaatgtgagactgcatgaataaatgtagtctctttgaacccataaatttagtacaaaacctactaacattataccatgaatatattttctttgtaaacctggcttatcaaggaaataatttaaatctgtgagtagataatgttaaagtaaactggtttaaaagtgactaattcaataagttagtatcaaatatataaaaatgatctaaatttgacttttagaaaaaattcacattgatttttgtatataaataacatctatactttctcagaaatgcttttc

SEQ ID NO: 146941 - DNA, 601 bp, Human
aaaattttaggtaagccaagtagtcatccaaacaacagttactgtgtcatttgcaattgcagattgtccggaatattttttgtttttacattgtaatgtttttaagagtttaaatatattattttcattttaataataatttctattcatagttttttttgtagaatgtgagactgcatgaataaatgtagtctctttgaacccataaatttagtacaaaacctactaacattataccatgaatatattttctttgtaaacctggcttatcaaggaaataatttaaatctgtgagtagatratgttaaagtaaactggtttaaaagtgactaattcaataagttagtatcaaatatataaaaatgatctaaatttgacttttagaaaaaattcacattgatttttgtatataaataacatctatactttctcagaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggtacattaaaaatcag

SEQ ID NO: 146942 - DNA, 601 bp, Human
aatgtgagactgcatgaataaatgtagtctctttgaacccataaatttagtacaaaacctactaacattataccatgaatatattttctttgtaaacctggcttatcaaggaaataatttaaatctgtgagtagataatgttaaagtaaactggtttaaaagtgactaattcaataagttagtatcaaatatataaaaatgatctaaatttgacttttagaaaaaattcacattgatttttgtatataaataacatctatactttctcagaaatgcttttctttaagctatggattctctrtattcttcaatttatgaaattgaaaaatataatatgaagtcatacaaggtgtttatttctaggaagatggatgttttgaaagctaccgcagaacaaatttcttctcaaactggaaataaggtacattaaaaatcagttatttaatttagatttaggaattataacatgttcaaataatttgttcatgcgtttggtttaagaaagctggaaaatgtcatattctttttgttattttgcaggttcatgcaattcagtgtgatgtgagggatcctgatatggttcaaaacactgtgtcagaac

SEQ ID NO: 146943 - DNA, 601 bp, Human
caagtagctgggaatacaggcacgtgccaccacacccagctaatttttaaaacaaaatttttgtagagatgacgtctcgctttgttgcccagcctggtcttgaactcatcccaaagtgctgggattacaggcatgagccactgcactcagccttagttttcttaataagagaatctaccctaatttaaagacggcttaggattctgaaatttggtaactaacgtaggaggttttcacagactcagactaccaaatctcatggtattgtttcgtaggtagctgtggacttcaactttattgkattatttctattaatacatttcagaaaaaaaaccctgcagggaaaatgtttttcctcatctaaagtttctgtaacttgccttgttcatttattagattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggtatgtttatttgcttttctcatatttatttggcttctgtgtgtgcaaggttctgtg

SEQ ID NO: 146944 - DNA, 601 bp, Human
tggatgtgatttataattggattttggataagtgttttatttgatgttttttttttcagtgaggggcaggaagatggataagagtgggaaggggggacagggaagagtgtgactcctctctcttcccttctctgtccgaggaaccttgatctctgtatctctcctgtgtctctgcctctgtctgattttctctcgccctaccccttgctgatatctccatttcattctctactgctctgcctctgtcagctcctcatttttggttctctgtttctctcttcatctgtctctttcgtttctwtgtccttctttgcctctttgtctcttatttcttccctcgctcatctctgtgaccctcaatttctgtctgactctcccttcttccctcattattgtctttcattttaacatagactctgatctatttttgttcatcacattggattaaaattctatgagcttcattaaaaatatattagataaaatatctttttaaaagatggaagccagtttttattcttccaagattcctgtcagttattgatgctataagctgacagagtttggagaacttggaccactcagctgaggggagtacgcg

SEQ ID NO: 146945 - DNA, 601 bp, Human
taatggcctttctctcttctgatctttgttggtttaaagtctgttttatcagagactaggattacaacccctgctttttttgttttccatttgcttggtagatcttcctccatccctttattttgagcctatgtgtgtctctgcaggtgagatgggtctcctgaatacagcacactgatgggtcttgactctttatccaatttgccagtctgtgtcttttaattggagcatttagcccatttacatttaagatttatattgttatgtgtgagtttgatcctgtgattatagtttttttttwaaaaaaaaatcgtgaataagtattgaatttgttaatataagccttctttctacatttattgagatgggtatatttttaagcctgttaatatggtgaattacattaattaatttttgaatattgaacaccattgcattcctaggctgaatcttccttcattttggtaaattatcctagttatatattgctagatttgttttgctgaaattttcttaatgcttactttgtcattttccaagtgttacttttcattgagcttcttagcttctgtgcttgcttagtttagtgattaggatttga

SEQ ID NO: 146946 - DNA, 601 bp, Human
ttggtttaaagtctgttttatcagagactaggattacaacccctgctttttttgttttccatttgcttggtagatcttcctccatccctttattttgagcctatgtgtgtctctgcaggtgagatgggtctcctgaatacagcacactgatgggtcttgactctttatccaatttgccagtctgtgtcttttaattggagcatttagcccatttacatttaagatttatattgttatgtgtgagtttgatcctgtgattatagttttttttttaaaaaaaaatcgtgaataagtattgaatttgttaatataagccttctttctacatttattgagatgggtatatttttaagcctgttaatatggtgaattacattaattaatttttgaatattgaacaccattgcattcctaggctgaatcttccttcattttggtaaattatcctagttatatattgctagatttgttttgctgaaattttcttaatgcttactttgtcattttccaagtgttacttttcattgagcttcttagcttctgtgcttgcttagtttagtgattaggatttgaggggagtttatatgcagatgttacctcg

SEQ ID NO: 146947 - DNA, 601 bp, Human
accttcttctcatactttatagtacacagtcttactaaataaggcattataggttcccaaattctacatgttgtttgggcccttgtcctttactcatactgacccatatgccttggctgtcttccttctccatctgtattagtccgttctcactctgctatgaagaaatacctgagactgggtaatttataaagaaaagaggtttaattgactcacagtttccacatggctagggaggcctcaggaaacttagaatcatggtggaaggcacctcttcacagggcagcaggaaagagaatgwgttccaagtgaaggggtaagccccttataaaactatcagatcttgtgagaactcactcactatcatgagaacagcatggggaaaactgtcttcaggattcagttatgtctacctggtcccacccttgacatgtggggattattacaattcagagtgagatttgggtggggacacagagccaaaccatgtcaccatcctaccttcttaatctctcagctcctcctttcccctgcctcttgcagcaaactcctaatccttcttcacccatcagctcagaatgttaccttttcagagaagcct

SEQ ID NO: 146948 - DNA, 601 bp, Human
tttaaaattatactttaagttctgggatacatgtgcagaatgtgcaggtttgttacataggtatacatgtgccatggtggtttgcagcacccaccaacccgtcatttacattaggaatttttcctaatgctatccctcccctagctctccaccccttgacagacccagtgtgtgatgttccccttcctgtgtccatgtgttctcattgttcagctcccacttatgagtaagaacatgcagtatttgattttctgttcctgtgttagtttgctgagaatgacagtttccagcttcatccacrtccctgcaaagtacatgaactcatcctttattatggctgcacagtattccatggtgtatatgtgccacattttctttatccagtctatcattgatgggcatttgggttggttctaagtctttgctattaagaacagtgctgcaataaacatatgtgtgcatgtgtctttatagtagaattatttataatcctttgagtatatacccagtaatgggatggctgggtcaaatggtatttctagttctagatccttgaggaatcaccacactctctcccacaatggctgaactaatttacagt

SEQ ID NO: 146949 - DNA, 601 bp, Human
actcttttactcaaataaagcacttgtgatattacagacattgtaatccaatgtacagggctatgagtaaagttataatgaactttgtaactacaagactgaactccagaaaatgtgagggaagggcatgaagcactcacgtttttatgtgaataatgaatacctactctaaaaatgtgtattgacattggacaaaagtatatattctaaactacaaatggtaggtggtgtagcatagtggttaaggacactaaaatgtaaaggttaggttgtacagtagagtgactaagggtacagactraagctagacctcttgagattgacaaattggccatatgacatagagaaaatgatttaacctctctgtgccttagttacattatctgtaatatagggaacaataatagtacctacctgttggggttgtaatctctggcatgtagtaagcatctagtgagtctcagttattactgtctttaacatatggtataatatttcagaatgtatgttgttgattttaatttttaggtctcttgcagctgaatggggtaaatatggaatgcgattcaatgtgattcaaccagggcctataaaaaccaaa

SEQ ID NO: 146950 - DNA, 601 bp, Human
ttattcattatcgaatataagaaataaggaggcgggcaggaatatagcagctatgcaatttcttcataatgtcaatttcagtgtcttaatcgtttgggatcttttataccatcaatgttggcactttgtctgatttgtttcagtggtctgttattgtcctgtatttgttaactttcatgacattttaaaggctcctacattgtctgacatccttttttaaaaaaaatcaaggaaatgtaactatatttttagtttgagagatgctttggtaacttattatataggctttgtcttgttatargtaggtagcattttccttgactcatgcttgtgccctttcactctcagtcaattatgcatgtcatctaacgcccacatgtctctgattataagtccttctgacagcatagatttcacctataagtaataatccttgtggatactcattgcaacttgtaattatctctaatgttgttacagatgttgctcagaatatccacaccttctctgctctctcattatcccaaaataacttcactcacacttctcttggttttcacctaaagcaagtatttataatgccaaccagatgtaatgttga

SEQ ID NO: 146951 - DNA, 601 bp, Human
aggggaagagtcataacttaacatggtggcaggcaatagagataaagagagggagagagagaaaaaagggagacgagagagagagagattgaggattacaattcaagataagatttttttggggacacagccaaaccatatcaagtgataaattaatagatgcaggttaccttggtagatatacctttaagatgatcttcaatattgggtagatatttgaaattgtggagatgttagaaatagaattataaactgagtaaatcaatttaggtttaatcatgagttttatctttaaaatttkggcttgatttaaagtgccaaagagatattccatccaattagtatgggaaaatggctagtggttcagaaactttttaaaaggagttagtttcagagtttaaaaatttgttttttccaggtcattaaatttgacggtggagaggaagtacttatttcaggggaattcaacgacctgagaaaggtaatgcttttgtgtgtataatgtaatatcagcagctaggatactaagctttaaaaacatgtaaaaaggacattaaattgacatcttttttgtgttaggtcaccaaggagcagtgggaca

SEQ ID NO: 146952 - DNA, 601 bp, Human
aaactgagtaaatcaatttaggtttaatcatgagttttatctttaaaatttgggcttgatttaaagtgccaaagagatattccatccaattagtatgggaaaatggctagtggttcagaaactttttaaaaggagttagtttcagagtttaaaaatttgttttttccaggtcattaaatttgacggtggagaggaagtacttatttcaggggaattcaacgacctgagaaaggtaatgcttttgtgtgtataatgtaatatcagcagctaggatactaagctttaaaaacatgtaaaaagsacattaaattgacatcttttttgtgttaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacattcattgaatatgtattatgtgccaggccagtgatagccattgtatattcaaagataaataaaatgaaatatagtccttcaaaacattaaaaaaaaaaaaagga

SEQ ID NO: 146953 - DNA, 601 bp, Human
gcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatckcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcaggg

SEQ ID NO: 146954 - DNA, 601 bp, Human
tgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaagaatttccgaagaaaacagcagaaccttataccaaatatgaggtycttctgagcagggaagaggaagggggcctatgtaactgcacaggtcttatgcccatgaagctagtactggctctcaccccctggacacacaggaagatatttatttatctaagtattctctcattcattaacaatcaagcctgcatttacaataagctagatgtcacacccctgaaatctgaggttcaaaaactagagtagaggggccaggcacagcagagatagagagccactagggtctctttcctttttgttaagactggatccacaccagagacactgaaagttaatccaagtaaa

SEQ ID NO: 146955 - DNA, 601 bp, Human
ttattcacctgcaaggaatcacactgtactcatggtattaaattattcggcctttcatgtcgaattctctgttaaaaaggaagctgatcaatccctgagtgggactcaatgttgatttgaagttttgtttttttggcatctttctattttccaggtagttgtaaccattcattgggtgcatactcacaaatcatccactatatgccaggcctttagaaaacagagacacacaaagatattaaacaaaaaaagatgtttcagtctgttcagtagtgggagacaagcagcccccaggccgacrctagctcttacatatgctttcatccaaaaattttttaaagatttgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaag

SEQ ID NO: 146956 - DNA, 601 bp, Human
ctcatcacatcagcagcagcatgtcctacagccttcaggaaaagaacaaaaaggtcagggaggaaaatgacacatctcagaaccaaagggcaattcattatgaggctaaggaacaaaggagaagtcaaccagggaatatgctgaagaaacggtgattatgaagtcactggggaagactgagaggcattttggctgtagttccaatgactagaatgaaggatgatgtgaaatgcttttggattgggaagatttattattttggaaaaaaaatagctcaaggaaaaacaaatggcaaaattcytgcctgaattttgaagtagtgtcactagcaggatgaggttcaatttatacattctttagaaatgaaatggcccttggaaaagacatagtggtaagattcgcaggacatttccagccttacggaagctgagtagcatgctgatagtaaaattaagtttcagttttagatagactgacatttgaaattaacaaaaaaaaaagtaaagggaaaaaattaaaagaccctgaactgacaaaaaaaaagaaaaaaaaaagcaactactgtcttttttttttaaattaaatgtcatcacaaacaaaa

SEQ ID NO: 146957 - DNA, 601 bp, Human
ctggtgacatctgggcagcccctcagcaggtagcacagttcttcctgagctagctgctccactctgctgtttcctctgactcgcattttctgttaaccttcctcttggaatcctttgacaatgactcacagggttatggggctacttagcaataccacagccctccgcaatagatgctgtgtaggagggacgcagctcagtggattgtagtctgcaccagtattttcctttctgcattcagggaggatttgcttttcagccacatttccctcaaacacagccccgacaggagatgcttagygcagagatttctaaacgatgaaatgatctgagtttggctccttaatcataatgaaactaaaaacagtaagatgagaaaacaacagggggatcatcattcctacaaaaaacaactttatacttgggcaaaatcaagagattaaaaaaaaaaagctcaaactaacattttccaacctttcactaagagcaagggctaaaaccacatgttttgaaggtcttgcactgtgttattattagaagtcacaattctattgatactgatgagtcattcgtatcggcggaaaccaagaacttccatcaa

SEQ ID NO: 146958 - DNA, 601 bp, Human
acggccaggcacggtggctcatgcctgtaatcccagcactttgggaggctgaggtgggcggatcacctgagatcaggagtttcagaccagcctggccaacatagggaaaccccgtctctactaaaaatacaaaaattagctgggcacggcagcacatgcctgtaatcgcagccactcaagaggctgaggcaggagagtcgcttgaacccaggaggtggaggttgcagtgagccgagatcatgccactgcactccagcctgggcgacagagcgagactccgtctcaaaaaaaaaaaaaaaaagtctacactactttatcattttataaagccctctgtcatacattatctcatctagatgacatacgtacagcaaacattaagccataaagtagtttcttggtcctatataccaaaagaacacagacctggtaacacacgcttaaatcaaataactcacagccttaaagaacatctattcatgagacgttttctccatttttactatacagtaaagcatattttatctcttattttaagtcatttaagaactttttattttggaattttatgactagccctttaaatattagttttgctagg

SEQ ID NO: 146959 - DNA, 601 bp, Human
cgtttctccgtgctccaaggacagtaatatgcagagattaaacagacagataggggaatacagactgaataaacgaaaacctttccaagtctgattttatgacaatattctgaaaagggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacycagaaagtccacacacaacaaaaacaaaacaaaacaaaaaaaggaacacaaagtaattgaaaagacttttcatacctaaaaagggaatttttaatcacaaccttagtcataaacctcaacaggcaagtcagaagcagtgaaagataaaagtgccaacaagaaaatccggttgaagtgccactcgggttcatgcagtgggttacagggcgcacaagacaagctggcggaagtgggtgctgtacctttatcacagccgcccccacctgaccacctgtagcagcctcagaggaagcagacaac

SEQ ID NO: 146960 - DNA, 601 bp, Human
tttcctctgggtgcccctaagtgggtaatgtctcagaaccccagcttctttctctgaaaaagttattatcttatttataaggtttcctcaaagactgaataagaacatgtaaagctcctatcatataatcaggcgtaaacattagttcccttccagtgggactataaacctccaagggtagctcacgtttctccgtgctccaaggacagtaatatgcagagattaaacagacagataggggaatacagactgaataaacgaaaacctttccaagtctgattttatgacaatattctgaaawgggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacccagaaagtccacacacaacaaaaacaaaacaaaacaaaaaaaggaacacaaagtaattgaaaagacttttcatacctaaaaagggaatttttaatcacaaccttagtcataaacc

SEQ ID NO: 146961 - DNA, 601 bp, Human
aggccctgggtttttctctctccctcagaaatcgtctgttcccagcacatcaattctctccttgcagatagccccccaatcatccccattccctcccttgaactcctctcctttattctcaactctccagtgagccatttttcctgcatatggtatctctactgcatatgctcttcaaaagccttcatttcttgctgcaacactactgctgtggaaaaatgagcttgtctattgacctcattgatttctgcaatagcagaattatcctcccagccaaccaagctccaaatcttagattcayttttgctcattccctcttcttcaattccagtcattcatcaaggcctcttgatttgttacatctcacctctatcttttgctacccacttacactgaccagatcctgcttagctgagaaaaactccctcttctcttctttcctaatgtttcctcttgtaaaattggccagcgtgctgctgccattttgatctttctatcactacccctgccattttcatcttcctctcgctatccccagcaatttgagaatcctcatcacccctctaacaagcaacctgcattgcccagtagagagaaaaca

SEQ ID NO: 146962 - DNA, 601 bp, Human
agaaaaaatgctcaacatctctattagggaaatgcaaattaaaagtgcacgagataccatcttactcctgtaagaacggacataactgaaaaacaaaaaataatagatgctggcgtggatctggtaaaaagggaacactttcacactgctggtgggaatgtaagctagctgtgtaaacttatgaaacaaagaccaagctgaggtccttgcctcacctgctgtgcttcaagggctcatcagcttggtcccaaatgatgtcttcagtaggtggcgaaatgttaaaactgggagctatgtgaaygaacgcgctgaaagacaaaacacgttagatcagttaggtcactataacaaaacgtagtatcatgcaaccaagtgctgttaaccaacttccttctctgcttgacattgaactacctgcaaatttagtgcttagaaaaggtccagggacttgcccatgaggaagaactcagcaataccacagactttaatgcaactggatttcacctcctcatgtcaccaagacttactgtgcagggtacaaatggccttcttccgtgtcaaatcttatgtccccctttcactcttgttctccttgacttct

SEQ ID NO: 146963 - DNA, 601 bp, Human
ttacatactcctaagtcttctgagttttctaaaagttgatacaccaagttacagttacccagaaaaactggtgggaagaataaagaaccaaaaaacatacttacagtccaaaagtaaaaaatatcatttgtacatacaaatttcttctccccttcctaaattttttaaactaatgctatagtgaggtgcatttccaaatctggcagcttaaataaaatcaactgtaactagcattgtggtgaatgaaatgctttacaactcacagctgtgacactgaaataaggaaatcctggattcccaycaaggggtaaccagcatcaaaagacagggcacattttgatgttttgagaatttctgagaagtcagagaaaatttaggttattttcatatcggttggactttccataataaaagagccctaaaacaaatagcagccccaagtgtggcagtgctatattgtttggattccttataacaatcagtgtgttcataagatgcttagaaatacacagaataagctgatggccccggtgagtgggacacacgctgggcagctgtgtgaacttttaaaattttaatttaatttttattttatttcaat

SEQ ID NO: 146964 - DNA, 601 bp, Human
attagattctattgagaatacatgctaatatattcaaactcttatgaaaaaagatactaaatagatcagaagaaagctttctggtaataagaacagattactaaccattctaggtaaataattaagttcattcttgtcaggaaaaatgaactctagtttctattttcaagtgaagactaagagacctggagaataaatgaaaccccatacaactccaaaaccagctacccagagttcagccagacactttaacttttgctgaacaaaattaacttcattttcatttttttctcccctctcrtccttctgaatgaagatgctaatagcaacagaaaacagtaacagagacaagtggcagggttaggtggggctaaggtctgactactccgtgcagattctatttaataaagtttcacctaccaatattctatgctgggggtgaggggtgggaagggaagggagagagcttacatactcctaagtcttctgagttttctaaaagttgatacaccaagttacagttacccagaaaaactggtgggaagaataaagaaccaaaaaacatacttacagtccaaaagtaaaaaatatcatttgtaca

SEQ ID NO: 146965 - DNA, 601 bp, Human
tcaattttttaaaagtacacatggcaacgcatagtctttgagcaatcttgaataacgatatacactatgccaagctataaagatgccccaccctgtgccctttttacattacacacaaatagggacggatttcctgtaagctgatcttgaagaaaaaaaacatgttagacaaagaaaatcagaactaagacatctcccccccaccaaaaaaccctcaacactgtatctttgttcttttcccatgtcctctaccctactaaaacgaacaaataatataaaccccaaccactgagtgtaccayagacagaaaacttggtacacaaaagacctaataaaataaaatctgtcaagttttgttgcccccaaattgaatagaaagatccagcaggcccttaaacatatgaaaagaagcacactcttgctggcaatcaggggaactcaaattaaaacagctagtgatcactttacaccgcagagagagaacacttaaaaagactcctaacacctggcaggggtgaggcaaacaggtactctcatattttgcaggtgtgactctacagcaatgcaacttttttggagtatcatctgacatcatgcatga

SEQ ID NO: 146966 - DNA, 601 bp, Human
ctgagagatacataactggactaaggctgcagagatgggaaatgagcctatactgtcatatgcccaggtactatgtgggcacaattcctcctgatcaccacattctacaagctccaacccagatgctaaaggtagaggcaacaaccatggaggaatagccatgaatgttccttgcggccactgcacccatggaggctagagcagacctagtgccctgagggtgggatgtaaattcctttttaaatccagagggtgtgatatggagggtctatctctggtttaacgaagatactgaagccartgaaaacagatcccaaatctggccccacgactgacccagcctcctaaagagcctgtagatgaccaactacagagagaggaaggctctagaagacagaagatgctccctgggaggttcttttcagctgtctttcttcttccctcatgcctctctatgacttaacttggcatctaggtgcacatgggcaattgttcacagcagccaaaaggtggaaacaaccctaatatcaactggtaaatggataaacaaattattgtatattgtagcatacaataaaattttatccagccacaataagga

SEQ ID NO: 146967 - DNA, 601 bp, Human
tgcatctcacccctgatcagtgggaagccagttatcacattgaagacactaggtaagcacaagagtttactgaaaatggaccttttcatgaaaaatcatgggtcaaacatctctatgacatacactgctgttaaaggaaacacatagtttctcattcttgacatgatgatgcctgatgtgcttagttagacagacagcttaatatggttcccctcccaaagcttagtgaaaatagcttttttaaaaaatttgaaaaataaatccccaaacataattcttctggcaaaatattaaatcctamcgaagaaggaggctttcagggaaacagtccaaataaaccttttaatttgtttaatgttctataagctattggtatcaagaaaatgtatatctttgttttaaaatagacaaattagtgatgcatctacatgccatccacttaactttgttcctgctgttcagcctttataagagtagcattttttcttgcgctgactcctgaagcctaaatctgcaaaagtctgtgatgacatcaagcttaacattttgccaagcctgtaaaattatttctcaaaatagtgtgctaacacatcagctttta

SEQ ID NO: 146968 - DNA, 601 bp, Human
agtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgataacagccatcctaacagttgtgaggaggtaaatcacagtggttttgatttgcatttccctgatatgatgttgtrtaccctttcatatgcctgtggccatctttgtgtcttctttagaaaaatgtctactcaggccttttgcccattttataaatcaggtaattcgtttgttctttgctattgagttgtatgagttcctgataaattttggctactaactccttaccaaatacatgatttacaatatatctgatgtacattggaatattgggatatactgattggaattttttcccaatctgtaggctgctacttcactttgttgattgtttcctttactgtacagaaactttctagtttggtgtagtcccattt

SEQ ID NO: 146969 - DNA, 601 bp, Human
atgctaatttctaggcctactccataaaaaccttccatgtgtaacctgccatgtttttccccctctcttgatgtgatgcaaacaagcacagtaactctgggagtcacatggtgaagatggagaaactacaagatggaaggaatctgaattcctgaaggatttccaggaggaaaatgtcacctaccattcatcaacacccatttaagacctcatgtgaataaggaagaaacttgtgttagaacagtgaaatgttgagaagttatcttgtatttttttattttgaaaaataatttttattacrtatatttatggtatacaacgtgatgttataggcttaatatagatagtaaaaaggttactgtagtgaagcaaattaacatatccatcatctcagttaccctatttttgtttttatgttaagagcagctaaaatctcacttagcatgaatcccatacctatagtcttcatactgcacattagatctctatacttgttcatactactttgtatcctctgacctacatctctccatttcctgcccacaacccatatccctggtaaccactgttgtattctctctgcatatttgaaatttttttg

SEQ ID NO: 146970 - DNA, 601 bp, Human
aaagttgacctaccaaagccagaactgctaaataattacaaaacagttgttttagaaatcacttcaccctccgaaaggagtcaactttccatgtatacttaaaatcactcataaaaatggatttaccatttaagaaataattttcaaacacacatgtagtttgtcaaatgaagcctcactgttcattcattcattcattcattcattcgacagatattgattgagccctgttatgggccagatgctgattgtggcacttgtgatacagcagtgaacagaagagtctaaactccctgccccratggtgcttgcattcctgtgttacgtccacacagctgtgtaactgactctgaagaaaaatgagcttttaaaacataataaacatttcagttttgccagatgaaaaattctaaagatttgttacactacaatgtaaatatagctaatattactgagttatatactcaaaaatggttaagagaataaatgtgttcatttaaccaaaaatttttttaaatgaaaaaaataagcataacaaacatttactgagtacttaccatgttaggcagagcatcatctcatttaatcacaacaaccttag

SEQ ID NO: 146971 - DNA, 601 bp, Human
taataagggctgggaaagaaaggagaaagcaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccgrggaggaggctggattcttagtgcaacaggaagccatggcagggcagatgaagaataaatgaactggctgcttcactactaccctgtcccaagggcccagaccatgaaacggtcttttatttggtttcaaatccaaataaaaacctatgtaggtatagaatcaaaagaaggagttaaaaatttgggaaggttttatacattttcctgttaacagaaaatttaaatataaaaatattttattatctcagagaggcaacagagatttatgctctttgattcagagataaactttgtcttgtag

SEQ ID NO: 146972 - DNA, 601 bp, Human
accaattaactaatctgctgtcgttttttcagtacttaacactcctgacagaattgcacattcttagaattggatatttatatttttcatttaataaaaaatatttttaaattattattcaataactcttccttgagtgtgtcctgcttgctaggaagtggatattacatacagcagacaaaatagccgtgatccctaatgggctcatagactaatgggagagaaaactattaaagaaacaaatgtatggccaaatatgaaattaaaattctaataagggctgggaaagaaaggagaaagsaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccggggaggaggctggattcttagtgcaacagg

SEQ ID NO: 146973 - DNA, 601 bp, Human
tggctttcttagagtgaaccttagctttaccctcctagggaccaaattcctatctcttgcattacaaacatctgcaggccacaagacagcaaccaaaggttaatactgcctccagccaaacattattaagaagctaaatctgctaacttccattaaatataatactaaatataatattatttccaaagccaacagatattacttttgaaccctatcacttgtcaatatgaggctagaaattaagagttgactaaaagtatagaaaaaattagccaggcgtggtggcgtgcgcctgtagtcyccagctacttgggaggctgaggcaggagaatcgcttgaacttgggaggcagaggttgcagtgagccgagatcgccccactgcactccagcctgggtgacagagcgagactccaactcaaaaaaaaaaaaaaaagagttgactaaaattatagttatatggtttccagataatatataataatatatatgtataataataatgtgataatgtatcacttaatagattgaaaatgatgagatgatacttctcaatggcagacactagcctgtagggtggtggtattcaccacagctaaaatc

SEQ ID NO: 146974 - DNA, 601 bp, Human
atgaatttaaaaactcttcctctaccttgccattgtttcctactgggaaaaagctaaagtgagggtggtgaaggcataaaacaggctgggacacaagacagggatctaaggaaaccagcttggtcttgcttgagagaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttyttgggggagtgagttgtgatactgccttgtgtggagctcatctagtgtctcctttcatttatatttcataacctccctgctgtgagcccaagaacctgaagagcacacctcacttcctattttgaaaattaagaaaaagtatacattttaacacagagtcaaaattgcaaagttaaacgaccactaactcaaatactgattttaaggcaggagcagcagcaggttagctgctgcactgaattttactgactgaaagccactagggtgtttgccaatcaatgctaaaatgatacttgaatt

SEQ ID NO: 146975 - DNA, 601 bp, Human
tggagttgtggcttttgataaaatattaaatttcttagagtatttgcatatacagatagcgcaactgctgatgtgcaattgaattatatgctgtaaaaaatatttacactacttctacttttagattactaatatctacaaagaaaaaaactcactcctaataagaatgaatttaaaaactcttcctctaccttgccattgtttcctactgggaaaaagctaaagtgagggtggtgaaggcataaaacaggctgggacacaagacagggatctaaggaaaccagcttggtcttgcttgagrgaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttcttgggggagtgagttgtgatactgccttgtgtggagctcatctagtgtctcctttcatttatatttcataacctccctgctgtgagcccaagaacctgaagagcacacctcacttcctattttgaaaattaaga

SEQ ID NO: 146976 - DNA, 601 bp, Human
agagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagccttggagataaaaagaattctagtgaaacctaggcattattattttccaaacaggaggaaatgtactgatcttcagactttcaatagacatgatatatttggtctgagagagagagacagagagagagagagasagagagagagagaagcccaaccgttatctaaaccttttaaggacacaattatacaagagtgccttgcaaggttttcaactctttataactggaagagaggaaaacacttattactgaaatccagataatcaaaacactttgttttaatcagcagtttctacccttttcacattctatatcaattcacaaggagtgaccttcatcttaggtataatggggtcaaaacctacctctgcaggtgtttctcccttacctgccttaatctgtggcccaggttaagcacacctgcaggcaggctca

SEQ ID NO: 146977 - DNA, 601 bp, Human
ttatctatcaaggacaggaaatcctgtctttcagttgctaagtctcagactattccatctgagtatttttgctgacaaatgtgaccttgtctaggttctgcgggaatttaaaaattccctcaatgtcatttctacttgaccttagcaacatgaccaaactgcaaattcaaatgccattgagtaaaggtacaacattcacatcctgttaccaaagcgttctccaactccaatccagtgaccctgggccagagcctaatccaaaagattacaaagcaactttctgatgagttgtcatggcaayccctagatgttagatatttcatgtcatccctgggctgcaaattctcatttttagtctactcatatcctactatttcatgtataacaaccaaccaaaatgcaatttgaaatgtcagctgccaaacataataagagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagcctt

SEQ ID NO: 146978 - DNA, 601 bp, Human
tgttattgaatttctcttctcttactacaattaacatcttgcactctcaaaaagtatgcattgactaggatttgccatgcatagtatgtgagattgctgctccaaaggctcacataaatccaagacaggccatcaaggaatgtgcgtgaactgcaagaataaaagtttgaatctatctgaagatgaaatgaagtttgaataaggccttcatccatttgatttgccattaagaaacttttcttagcctaatggaatatccctacttctgtcaatgagatttcagtttgtgaataacattttmaaagtgcagcatcttctgtctacaaaaagacattctatgaactcttaatacacataaagtgtttgcaactaccaggagtctgctccacgcattctcccgtctgcatgatccctcgggcggtataccacccacactcagaccccgggcagccagatcagcaaatgtgcacaagcctgcactcctgtcaaacaatggggtctttcaggccttacaatcttgtgaagaaacaggctaaaacgtcatgggaaaaattaggaaatatcagaggaaaacagctcacaaaatgaggggtggaaccac

SEQ ID NO: 146979 - DNA, 601 bp, Human
tcatattctgggagtggggctttaaaacacatacacacacacacacacacacacacacacgctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctrcaaaacttatgcttatttacatctgcactttttaatagtacacagcaatgaaatggaacctactatcagaatttatagaattttttcacaatgtttccaaagtatttaccccagagtttctccgctacaggatttaaggtcctttataactctatacatttttaaatgtatgaaggaagatgtatttgatatatagaaattaggtcacttttcttcctgtccccctaagaataaggtctgcattagcagcccattttaccgaattaggaaattaaagttaattctttcccacacactgaa

SEQ ID NO: 146980 - DNA, 601 bp, Human
gaattctctgccattcatcacgtacaaagaaaactttacctgacatggcagcggcagagccattaagaatgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacaygctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctgcaaaacttatgcttatttacatctgcactttttaatagtacacagcaatgaaatggaac

SEQ ID NO: 146981 - DNA, 601 bp, Human
gctgtcaacagtgtggtctttgtttggtgggtgttgctctaaaaatttttttaaagtttcccaacaccttcttcttttaaacagaggcaagctgctggaggcgccgtcctcgcctggcccgccccactctgtaaactagacattaccttatacacaaatgactctaggcattcctcagtctagctgcctcactgcaaaattcctatgctcctcagcagcagggcagcgcacattcccctggcttcccctctttcctcttcccccaccctcctctttttcttttctttctttttttttttttaatttccactgcctcactgtgtttttgtgtaaatgatctcacatgactcaacaaatccatctgcctgaagcaggccaagtctggagccctcccaggagggaggagaagaattgctttgtggaaaggacctggagctctgccctttctctggctcgaattacccgcctgtcaggcctgacggatttggctaaaaataaaaggaaacgggccgtgaaaagcagatgaatgggctcagcagttccttagataacacaggcctgctgttgcccaaagctccccaaacagaaacttcaaatgcag

SEQ ID NO: 146982 - DNA, 601 bp, Human
aaggaaaaaaagaatttcatgaatgagcgggagacaattttttaatggaatgttttaaaggcttgtggtataaacagtaaacaaaattgattcactaacattaatactgtttgccatgatgtgagagttggtctttttttttaatgccccagaagctaaaggaaaataaatactgtggtagggaaaaataataccttacttggcattttgaagtcattgctcaatccttcttgagcaagaaaaccatagtaatgactttgttttacctaccgcaattatggtacacctcgcagcaatcctycacaatattttcctccctctgttcaagtcctgctaaataatctctggaaaccattaactaagagtacggttccaattttcctgttctccctcctctgctgcctcagtgtcatgttggcgtcaggacaaagcaaacttgtatgacatcacagagcaaactcattttctgtaaaccagccccttggtagtttaccgctactggaacccaacgctgtcaacagtgtggtctttgtttggtgggtgttgctctaaaaatttttttaaagtttcccaacaccttcttcttttaaacagaggcaag

SEQ ID NO: 146983 - DNA, 601 bp, Human
cttgcctgcaccttcaaaaactttacttaacttggaattccaacttaaaacattatttcatatcctttaattcaatcttagaagtaactgagcagccagctcatgacgtaaagcgtgagcttctaaaccagagtaagaaatgtggagcagaagttctgaaccagagtggttttgtctcccaggggacatctggcaatgctgtagacatttttggttgtcatgacccgggggagggtgctactggcatctagtgggtgagaccaatgatgctactgaagatcctaccacgtacaggacacamcccataataaagtattactggtccaaaatgtcaatagtgctgagattgggaaatcctgacggggagggaacattcaaggatatgggtagacttaaaatcatgccaactcataatcacattataataatgtggcaccatgcaacttggggtccccaaaatgtaaacaattaacaaccataaaaatttaccagttctctccttgagcgaagtaaaagctgtaacttacacagagtaagaccatcagagttgcctggaagaagtggaacagcttcagtgttggactatgttatcatcaatatc

SEQ ID NO: 146984 - DNA, 601 bp, Human
ccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattraaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgccccaagagaccagacgtttgccattctgctttgctcccctgtgcg

SEQ ID NO: 146985 - DNA, 601 bp, Human
acgcccagcagcttaggcagagggctggggcatgagggcctatgccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgcc

SEQ ID NO: 146986 - DNA, 601 bp, Human
cccccttctatgatgtccattctagaagccttcagtaatatatgtcaaagctgggtagctcaggcactcctgtgggagatagataggccaacaagagcaagcaggtcactcttcgcagtgttaaaggtctcactagcttttagacataacgtaccatgaggccagtctgtgggatggactcttgttcctacccttcccaccaccacgcccagcagcttaggcagagggctggggcatgagggcctatgccaggcccaagagcttttggagaaggagtaagtgaagtaatacaaggtgaacmggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcata

SEQ ID NO: 146987 - DNA, 601 bp, Human
aataaatttcttagttttaaagtagaactttatacatgctgtttccttttcaatgtatgtatccatccatgtaaaaactacagcctagcacttaactggaaagcttgcccaaatgcctagcagagatgcctcatgtcacaattcaatttctatgtacacattggtatcaacacaggaaatgtgggcacaagaagataataacagacaaggattcttgaacatcatttccctgaggaaccccacccagctccaatcatgccacaatccccgtactctcagaacttggataaatagcttgcamtaaactgattacggatcccttcctgcccccgccccaactgttcttatgtcattttcatgtatgttgttttacaaccgaaacaggctaaaaaccctttgagggaaacatcagacacacagaacgttttaaaataaatattacgatagttttttctttgctgtcactcacagggcctaggatgatacagactcttaagtgtggggtcttaaaaacaatgttaataattgttgcagctgcctttggagttcttttaaaaaggaaaacctcttaatgccagggttgtaaatcttttaaaaaata

SEQ ID NO: 146988 - DNA, 601 bp, Human
tttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttacaggtggaactgagaggagagcaaaatattgtaaggttcctgatactcaatttgtgtgttatttttttaagttgcatctaggarggatttatatatctgcaccttcccataatacatggaatcggaggtttaactggaactgcagtgcttttaaaaatgaaaaatatactatttttaattataatatattaagactatagaaaatgttcaacaggaaaagaaaaaggtacttataaccccacaagcccaccataaccatctttagttcttagtaatcagcctttgtctacactggagaataacatgtctgctaactaagtccaggacatggagaattccaaagctgtattccccatattaacatctttcactgctaagaaaatg

SEQ ID NO: 146989 - DNA, 601 bp, Human
agtgtaccataagggaattcaggaggtcagtcttccatgggccaaatgaactaaacagtccaattccccccaaacagtccaattccccccaccatgttttcattcatgctatttattctttacatggcgttttttgattcatatgaattacattttagagtaaaagggtcattgtacagtttcagggttcttctttgtcttttttgtttttgtttttgtttttttggcatagagtctcattctgttgcccaggtttgagtgcagtggcatgaccacggctcactgcagcctcaaccttctsggctacagtgatcctcccacctcagcctcccaagcagctggggctacaggcgtgcaccactatgtccagctaatttttgtattttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttac

SEQ ID NO: 146990 - DNA, 601 bp, Human
acccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcatggaaagacatatgtactccagaaaatcatggtaccgtaaaggaaatacaagtgctgattcctcaaagtacctcttaccttgttcatgctgcagggatgggagcaagggatcagacatgtcacagtgcgaggaagytcttgaagattctcctcattcctggagccctcactttctgaagcagacagctgcactgtgaatataaacaaagaagaaatccatcagctggtgcccaggaaggcatagagcactgccatgtccagtggcacttgctgtcatgatggcaatgatccaagtctgcactgtccaacatggtagccactagtcagatgtggctattattgagcacttgaaaagcagctagtgcaaacgggggctgccaggactcaacagctagaactttcacagatttcctagaaaggcagtgtaccataaggg

SEQ ID NO: 146991 - DNA, 601 bp, Human
catctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacagatggggaaaytggggaaccaagaagtcaggccacttgtctagggtcactgacactagcatcccaaaaaagtgatatttagtcccaggaaatctagccccagagtctcaatattccaatattcatgccaaggcagttacactaaaacccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcat

SEQ ID NO: 146992 - DNA, 601 bp, Human
tgtcaaggctgagaatccctgctccagccataccaaactctttgctgttctctgagcacaccaggctttctcatatgcttttgtgcctaaacacattcctttacctggaatgccttgccccaccttccctgtccaggaaattaccatttcccatctaggatcctactcaaatgtcacctcctctacactgtctttcccagattccccagagttggatgttcctttttctgtgcctccaaagcttctggtacacaccttgctagaacatactcactatgttgacccaagatagtctgcacaygctaaaggcatctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacaga

SEQ ID NO: 146993 - DNA, 601 bp, Human
gggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaacatgygagctatccaaagtcccaaagtacacccctttctggtgtttcctcagaccctggcacagataggagttcaagaatgtgaggaatgaaggccctacctgatggacagcaactcatgaggtatcagggtagtcctgttaaattagtgcggccaactgctaatccttttgtggcacgggatttgggggattctgtgttttctagagggatggtctctaatggattcaaaagagagctgtcaatgtctaactgcaatcagcatcgccctggcacttcaaaggaataacaaggaccctagaacgc

SEQ ID NO: 146994 - DNA, 601 bp, Human
acatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcrtgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaac

SEQ ID NO: 146995 - DNA, 601 bp, Human
aaaagttaaattttggccaggtgaggtggttcacacctgtaatcccagcattttgggaggttgagatgggaggattgcttgagtccaggggttccagaccagcctgggtaacatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtac

SEQ ID NO: 146996 - DNA, 601 bp, Human
ttggctatggcttttaagtgacacactgaaatcctttctctatagcatgataatgcagcagtaacacagataaaccagaaatgttggtttttcttactggcaaatatactatatgtaatatatatttacacatattagcaagaaaataaccaagaaagtagtagaaatacttttgacagaatttaaaagttaaattttggccaggtgaggtggttcacacctgtaatcccagcattttgggaggttgagatgggaggattgcttgagtccaggggttccagaccagcctgggtaacatggygaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgaggg

SEQ ID NO: 146997 - DNA, 601 bp, Human
aatgaaagaaaaactccaaatgaaggtagaaactaaatttcagttttactttttagttgactgtagagatactgatctgcgtgtaaacgtgaaactgcctcagacctgggacagtaggatgtggtgctgaatactggaaaatattcagagaaaaaaaaattctgctgggcagatcattaagcaaaacagtggcatccacccactaaaagagacaaggggcactactctacttcatttggatgctttggcatttgtccaaagcaataaaaatcagatccagcttgatctgaacataacaagkaagaaacagttctcaagaagatcctttttcatgatgggggaagagagagggtcattttgtataataatggaaaaatcaattatttttcaatcagatggagtgtcctcataaatttaaagcacagaacagcatgtgacatgccttcataaaaaacaatgaccatgagggagaagagtaaaggatcataatcccaaagttgctactaagaaggaaagatctttcaagagaagaacaacacttttcttgctagtgtgttttctgtgaatgtacacagtggtcagtatgcactgaacgtacacc

SEQ ID NO: 146998 - DNA, 601 bp, Human
atggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccrtgtgtccagagaataaagccatgttgaaatgcccccatgattccttgactggtctttcagctgcctgccactcatccaccgactctcctccgacctcagttagaacccgacagatggtcagtagctgcagccatatttcaaagaagttatcatgattcacagctaggcctctcagacttgaaattatattacagtcatgtcaaaacagatcctttcttctctggggcctatagggtcttaacacaaagtccagcttttctattccgaagacttaatttacctcctacctcttcagactct

SEQ ID NO: 146999 - DNA, 601 bp, Human
aaagatcacagattgtttaaaaggcatatctaaacatctaagagacagtctttgtttaaattgaactaggatttcctggagagtagtaaaatgttgtttcagtatagtgaatgtgcaagttaacacttcaagagtgggcttccggccgggcgcggtggctcacgcctgtaatcccagcactttgggaggccgaggcgggtggatcatgaggtcaggagatcgagaccatcctggctaacaaggtgaaaccccgtatctactaaaaatacaaaaaattagccgggcgcggtggcgggcgccygtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagagtgggcttcctttggcttcaaactaaacagctggacaggggatgctacttaattctttttcttccctaccagaaggaggaggtgctcaagtatttttctttattctttcatctgtttatctgctgagcaatagggatcttgct

SEQ ID NO: 147000 - DNA, 601 bp, Human
ttttccccctttaaaatcatagtgtattaataggctacttttaaaaaatttttttgcagcatatacactcatagaagagaccgatcctctaccatatttaaagtagaaagtaaaacagtactgtaattttctctgttttagcccatttccatgttatataatgaatgtaattccaaggatgagcttacagtttgatttccatattaattcaattactggactcgccactgactcagacctggaattaatataaaatacagggagacacacacaaaaaatgttccacttaagaaaccaaaasagccctaagtcaaaccactcttacaacactagagtaatatccaatgaagcggcttccatttacagtgttttccagaccccacaaagttcttttcagagttcttatattccctaaaatataaccaaggttactgtaacttttgaagtcactctcaagatgtacctatcaataaacagtagctttttgtttttttagtacggtggctgtaagaagttacaaatgactgtcagtgtggtttcaggtggtattcttattagaaatttaaaacacggtgttatcaaatttggcctaagtctgttc

SEQ ID NO: 147001 - DNA, 601 bp, Human
aaaggtgccttagtctaccaaggaactaaattcagtgtggtctgaaaggaaacaataaacaacatttaaccatgagaggtagcaaaggacgtcttttctcagtgtctatgttagacaggtgaggaatgttgccaatttattttttgtccatataacctctatagctatttcttctcttgtctgtcgttctgaaattataaagggttcttatgagttgtttatgtgaaaccaagtaccctgacccacaggcaaggtattcctggaactgctgaaatagcaagccagataatgatatcatttwaaaaagtgccaggcaagaaagctctgattaactactgaaacatgctcagtggagatatttgtagctagaataaacgccattttaacatctcctctttatctagggtcctccttcctcatgctattattgtgaatatttcctcttcagattcctgcatacaaggaagactgatgaaagagagtaaaaatcacttttggagaaaaaaaggtaagagctggcagaggtaaaagaaagattctgaacctcatcaacagttgttgcaatctcactcacctctctggctaaccttcctccctccac

SEQ ID NO: 147002 - DNA, 601 bp, Human
catagcttagcacctgcttataagtgagaacatggtatttagctttcaattcctgaattactgcacttagaataatggcctccagttccatccaagttgctgcaaagacattatttcattctttttcatggctgagtagtattccatactgtgtgaatggaatgtgtggtgtggaatacacaccagtccaatggaatggaatgcattctatttacacaccatggaatactactcagccataaaacagaatgaaatggaattatgtgtattacacacacacacacacacacacacacacacattcctcacatgttttatccactcatcatctgatgggcacttaggttgaacccgtatctttgcaattgtgaattgtgctgcaataaacatacacctgcaggtgtcctttttatatagtgacttcttctttgggtagatacccagtagtgggattgctgggttgaatagtagatctacttttagttctttgagaaatctccatattgttttccacagagggtgtaccaatttacattcccaccagtagtgtgtaagtgttcccttttcactatatgtacatcaatatctattgtttttttac

SEQ ID NO: 147003 - DNA, 601 bp, Human
caagagtttttctttatagccttacaattttaatacttttgtatagcacttcccaggcataagcaacacttccactgcatcttactctactttcataacaacccctgtaggcagtaagaattatattctgaatcttggagagtgtgctacttgcccagggtggttggccaaagtgggactgttcctattttggtttaagaatgcaagtttttgggttacaaattcagtcctttttctacatggcatggccaaaaataacattctcaaagatgggttacttagctgccccactctcatggtwtacttcaggggagcattgtacaaaaatgggtgattgtctagttttcattgccaatatgctgggaaataaagaaaataatgagagaacaccaaagtttctactaccaaacaagtaggcatttcaggtggtctttacttagggccttgcatttcttaggctaagttgtgttatattgagctgaggtggaggactatgaaaaagaaaggcagcagatttcacagggaccattcaaagccctgcaggaacaacaacaacaaaaatgctatgaaacaacacggagtaactcttgcataaaaatgg

SEQ ID NO: 147004 - DNA, 601 bp, Human
taaaggtagttttaattcttccatgcagttttcaaagttgcttgcaatatagtctcaattttactttctagtcttattcacatctactatctaacacttatcaattactacggccacttcattacttcaaatgtcctgagaagcagacactaacatgggattcgatgtgctagagatttcttggggtagggtgcaggaggaggcaagaaaagccttcagatcgagatgcaggtctggcccctgggaaggagaggaggaaggaaggaggataggctgtgaagtgtcttggagtgcagcatarttccgagaagggtttagccatgtcaatggggagtgcttgagcccaagcttctcagtggaggaccccttgtgttgctggaatgggcatgccttacttagcacccccaccatgcatggtcaatggctgggagtagcccttgggaagcatagccttggtgccaaaacagtggtgggttcagaggggcagcagttgggatgtcagtcagtcagtcagtcagcggtgttgcctaaagcaagagagctgagcggtgcattttcatggccaccacagtcactgtataattcaccattaaactgggac

SEQ ID NO: 147005 - DNA, 601 bp, Human
gaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcattagaaatgcatttttgcccaaacacttcaaacacatgacttcgcttttaatccattttaatttagaaatatttctgtaatacagtatagaaatattttgatgatgtacatcagtgccctgtttgtastatcaacctaggcatgaagagtgatgaaggctgacattttacaagaggatggatgagaagagtccttcctggtcggatggggttagtgaggcaggagtagcctggagcacctggtagagctggaatcatgggatgtatagttcaggtggtcaggggcctatgggcaagtttcactgggatggtaataattatgcagcagaaacaggcagtgcatagaataatctgaatggtgaccatctccagaatggcagcctccagagtgaggcttttcacagtgcccagtcttcttgaccaaaagtc

SEQ ID NO: 147006 - DNA, 601 bp, Human
tggcacatatacaccatggaatactatgcagccataaaaaatgatgagttcatgtcctttgtggggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtggggatgggggaagggtgaagggatagcattaggagatatacctaatgctaaatgacgagttaatgggtgcagcacaccaayatggcacatgtatacatatgtaacaaacctgcacgttgcgcacatgtaccctaaaacttaaagtataataacaaaaaatctataaagggttctggatatcaaatagttttagaaccactgtcccagactactggagccctaaaaacttcattaagtggtttcctacttctctgtcacatatttctttttcttctaaaaaaacggggtacatgtgcagaatgtgcaggtttgttacacaggtgtacacgtgccatggcggtttgctgcacctactgacatgtcctctaagttccctcccct

SEQ ID NO: 147007 - DNA, 601 bp, Human
aaaagaaaagataaaactgcaaaatgggagtgccacaaatttctgctcctcctactccagccaacttaacttgacagggaggaggcagcctctgtttccttcctccctttaaaggggggatggcaagctgttgacaactcctactgtacaaaagagttgttcacactgcaaaagtgtttactgctcacaagtgacgctcaaaattaattcacagcagcaacaccagcagaaagctttgacagactgtcttatgtgttgacacagttatacgttgttgcataaaaaaaagtaacacacttaycctcttttccagcccatacacactgaagttgctccaaagagagactgtgaaatgcgtctgagattgtaaatgccaccctccaggtaaggatttcccgctccgctccggggttgatggctgcaggcatgagaagacgtggaccccctttttgaggtgaagcaaggctgcgagcctctcccccggcctctgttacaactggccttgctggtggtttttccttcaaaggcatttccctctagggcaagcctcaggcaccagggtgggaagtggggtagagctgtttattataccgccttggca

SEQ ID NO: 147008 - DNA, 601 bp, Human
aggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgttttttctgatttttaaaattttctaacttttcttaacggttattatttgcttatttaaataaaaactattttaataaaaagatatatatctaaatttcagctatcttggagcaaaaagcctttgcattttattaattaattaattwatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacccagctaattttttgtatttttagtagagatggggtttcaccatgttggtcaggctggtctcgaactcctgacctcaggtaattcgcccacctcggcctcccaaagtgctgggattacatgtgtgagccaccgtgcccggccacctt

SEQ ID NO: 147009 - DNA, 601 bp, Human
gaaaatggaaatcatgcaataatgtgcatgaaagattacatgaagttccaatcagcagacccaaactcgaagaaaaggcctcgagcccacatcaaaagattggcaaataactgttcatttgcaactttaggttaaatacatgatttaggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgytttttctgatttttaaaattttctaacttttcttaacggttattatttgcttatttaaataaaaactattttaataaaaagatatatatctaaatttcagctatcttggagcaaaaagcctttgcattttattaattaattaattaatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacc

SEQ ID NO: 147010 - DNA, 601 bp, Human
aaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaagattggcaaataactgttca

SEQ ID NO: 147011 - DNA, 601 bp, Human
gaaccgttcaaatcatctgaaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccatraaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaag

SEQ ID NO: 147012 - DNA, 601 bp, Human
gtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctggggacatcaatgaacaagacagacatatcacatatcacatatcacaaagcttattcattaaggcctcaccagcaccctaaaaatggggagaggaccgtagagttgagaagaagtttaaatcaaacatcayaggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctactttattaaaataaaccattaggaaaatcaaataagtacaaggttatcagagcaaagcttgcctagttcacaaacatcttcatggatatgtttaatggcccttcagaggaagccaaatatttgcataaccataa

SEQ ID NO: 147013 - DNA, 601 bp, Human
aaaaaaatctgctgactgggacatttctagataattttgaagctcaaaaacgccaaatctatcaaaatcagagagttgctcttggtttgtgttgtcacaatctgtgacgagacaatgggtcttgctcaggtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctgkggacatcaatgaacaagacagacatatcacatatcacatatcacaaagcttattcattaaggcctcaccagcaccctaaaaatggggagaggaccgtagagttgagaagaagtttaaatcaaacatcataggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctacttta

SEQ ID NO: 147014 - DNA, 601 bp, Human
taagctctgccattcactacctatatctagaaaatgttcctgacctcctttaaacccaataccataaaatggagataatagtacttaccaagtaagatttttatgatgattaaaggagacaatacatataaagtaaaatttgagcccagtctcaactatctatcaaatgttcagaatattttacctaaattaaatatatgttatcatccaccttcctttgcacaaacatgtgacatgatatcatataaaatgaagactttatttatatgcaagtctttaggtggcacttgcaagcttccaygtgcctatgacatttgggaacttctatctgcatgttgtaggaactgttcatatttatacctctcatgcccatgtggctacattttaaaatgattcagtcatgattcttccagggtctcctgtgggcccagctctgtctttacctaattatgttagtttcaatcgacaactataatacgaagacttaatgaggaacacaaatgagagtaattcacatataccaaaaatcaacttaaacacacactaatataatgttgagaaatgcattatttaaaataccctgtacattatagagaaatgc

SEQ ID NO: 147015 - DNA, 601 bp, Human
taaagcaaagccgtctcctatggacatccttcaggaatgtcatactaaccaagaaatctgaaggggaaccatctattattcatactaagggaacagggacaatggcttcacacagctgacttctctttgctactgactagctttttctgctctgtggataatacaaacaggatgaaaggatcttgatactccacaagtaaatatcctttttaagcagatggcttgcaagttaggaaaaaaagttgctctccagtgattaaaacagctctctggaagcccactttattgcatctaagtacaytgctagtctcactgggagagtttattcctttcaaagatccagcctctcagctggtaagagttttgataaataattttgttctatctatatgtacctcttgttaatacaggcatatcaatgatcagtactcatgagctagaattgacttgttcatgttcatattgtctcagtaattcaagagacatgcatttgatgaatgaaaatgccttagtcatggaaagaccaagatgcgctcttaagaaaagttgaccatattaagccaacagggtcattgtaagtatctgatgtcaaagtggaata

SEQ ID NO: 147016 - DNA, 601 bp, Human
ctaaacaaaaagaacaaagcctgaggaatcacgttacctgacttcaaactacaatataaggctatagtgaccaaaacagcatggtactggtacaaaaacaaacacataaaccaatggaacagaatagagagctcagaaataaggccacacatctatgaccatctgatctttgacaaagctgacaaaaacaagcaacgggaaaaagactctattcaataaatggtgctgggataactggctagctatatgcagaagattgaagctggaccccttttttacaccacgtacaaaaatcaattcragatggattaaacacttaaatgtaaaactccaaactataaaaaccctggaagacaacctgggcaataccatcctggacataggaacgggcaaagatttcatgaaaaagacaccaagagcaattgcaacaaaagcaaatattgacaaattggatctaattaaacttaagagcttctgcacagcaaaataaattatcaatagagtaaacagataacttacagaatggaagacaatatttgcaaactacccatccaaccaaggtctaatatccagtatctgtaaggaacttaaacaaatttac

SEQ ID NO: 147017 - DNA, 601 bp, Human
aaatgttcaattcaacaagaacatcctaatatcctaaatataaatgcactcaacacaggagcactcagatttataaagcaagttcttagagacctacaaagagatacagattcccacacaatagttgtgggagacttcaacactccactgacagtattagacagatcattgaggtgaaaaattaacaaagatattcaggacctaaacttagcactggaccaaacagatctgataaacctttacaaacatctccaccccgaaacaacagaatatacattcttctcatctccacaaggcacawactctaaaatagaccacataattggacataaaacaatcctcaacaaatgttaaataaccacatactctcagaccacagcacaataaaaatagaagtcaacacaatgaaaactgctcaaaaccatacaatcacatggaaatgaaacaacatgttcctgaatgacttttgggtaaataatgaaatgaaggcagaaatcaagaagtttattgaaaataatgagaacaaagatataccagaatctctgggacacagctaaggcagtgttaagagggaaattcatagcactaaatgttcacatca

SEQ ID NO: 147018 - DNA, 601 bp, Human
aaggctcctcccccaggttttagcaggtagggttctcctcatttaggtctcatctcctgtgttaggcattactcaacctgcccatacacatcttcctatacactgccctcctctggattacatagctccatttattaccctgattgctctcatcgttctctgaaatgatattgttcactaatttgacagctggtttgttgtctgtatttctaaaacagaaagtgagtttccacaagggtaggaatcttgaatcttgtgctatgccatatccttaccatctaagacaatacttggaacacakcaggtgattaattagtatttgctgaatggatgcttctgtgagtgacaatgggtggtaggataccatgcaggaaagctctctgcatactgcaaaatatacacatgtaaggtaagggaaatgatgtgttacaacttgtaattctccgtcactagtacatactttgccatgtcaaatttaagtcatagataacattatcaggctattagtgttaccttcttgactatttttctgcagatcaaacaagataagagtccaagatctctttgtctctccccaaactggtctccctgttgttaatcc

SEQ ID NO: 147019 - DNA, 601 bp, Human
caacatcatgaaaccccgtctctactaaaaatacaaaaattagctgggtgtggtggcgtgcgcctgtagtcccagctacttgggggactgaggcaggagaattgcttgaatccaggaagcggaggttgcagtgagctgagatcgtgccactacattccagcctggagacagagcaagactctgtctcaaaaaaaaacaaaaaaacaaaacaaaacaaaaaaaacaccccatgttatagccaacaatacatttgccaatatatctatcaaatgtgatctcaaataaagcacaattttattastgaagagtacatagaactatctttcaccttcttagtcctacaatgcagaccatgatttcattaatgctttgggcagctacatcacatctctggctaggattgagcttacagaaatgaaacccccaaggagtcttcacatattgctattgtgttttatttcccacattctctatttgtgatttttttttttttttttttagtgggggtgtgggatacaactgcaggtcttggcacttattcctattactaaatgtcaactcacttgggtctcgtcccttgttttcttcttctttcttctgt

SEQ ID NO: 147020 - DNA, 601 bp, Human
tagtcaccaaaatctgctttaaaagactgaatttttagaccttaaattttaaaatttggggttctaagcttcaaagtaattatttaagacttatcccacattacaactacagattgcaccaacagttttcttagagttagtgagcctcttgcatcaactttgtttcctgttctctccaaagctcctttctaaagcaactgagcttcagaagagggaagaaggaaacagggcagaggggtttgctgacctcagtctgcattcaatacatttttctttttctctttgagacaaggactgctargaaagggccttttcatattttaaagctgaagtttcaaaaaagctagaacaattcaaagatatttattccataaaattatcctcaggtaccaaaagtagctctggaaaagtggccacctctttttatttggccttcatagctcattattttaatcaagtagatggttaatgaaaagcaaacttacactttccatgaagtaaataaagtaatgtgctgaataatgacatttcagttgataatagactgcatatataatggtggtcccatagattctaacatcatatttttactgtacctttt

SEQ ID NO: 147021 - DNA, 601 bp, Human
acttcaaaacttagttctaaaaatacaaattgcatttagataccattatcttctttttaaaaaggtcaaatctcaaacgttcagctggttccaggctatataaaaatattactgaaaatctgatgacagctttggtaacaaacatcttgagagtggccctgaaatccttatttatattcagaaacactaagtggagtagtcgcacgccattttatggctgaaggggttcaaaaggaaagaggtcaattgatgttaattgttaattttttggaaattcagagatgaagttttttttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaagaaccaaagctagaaaattcacttatttgacattcaaggtg

SEQ ID NO: 147022 - DNA, 601 bp, Human
ttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccaggaaactayaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaatattatca

SEQ ID NO: 147023 - DNA, 601 bp, Human
gcataatcttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccargaaactacaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaa

SEQ ID NO: 147024 - DNA, 601 bp, Human
gtattttataactttaacaactggtatagccaagtaagtatataccagctgtcagtcttgctaacagttttactgttgtttgtctatcagtctcaaagagacggccaccactgagggccaaccaccttgcttggctaagttcctacagcatggggggagatgtgtaagagggctctttttggtattatgagtgcacatcagggtcacatgggaatttgactttaaaaagacactaacttaggcctctactaatgctattctactaacactgtttaacacaactttctgtaatgatggaaayattcaatatctctgctgtccaatatggcagccacatgaggatactgagcacttgaaaagtacctagtgagagtgaggaactgaatttttaactttagtcaatttaaatcaactgaaatttaaatagccacatattgttagtggttagctgattggacagtgcagccctaggtggcttcacatattagttttcttggacctatttcagactccagaagcccacaggacaatacccaatatagtccttcaataggtattcactgcccttctcctaggtgctgggccatgtttaggtgtctca

SEQ ID NO: 147025 - DNA, 601 bp, Human
gcataaagatattaatcgccatttcatagtttggaaaagaacacaagaagatgtaacaaaaaaagtactaagttagaagatctgagttttatttctaaattggctacgaactagctgcctgactctctgggacttgatttcttcagtaaaacaagggggttggatgaaatgactgtaaggtcttttggaagccaatggatctgtgatgtaggacgtggccatggtagtgatgggagtgccttaggaagtaatccctcctggaggccaaggaaccatgaggccaaaggtagcatccatcaayctgaggcctgcagtgctggcgcagagtccttgagcagcccccaactcccagagatgagacagacattaactaactcattttgctggactgaggggaggttggtggaatcctaaaggaatggccagggtgtcttgggcattggaaagaaataccgaagaaacttaggacagcaggtctttattaactggtacaggtattttataactttaacaactggtatagccaagtaagtatataccagctgtcagtcttgctaacagttttactgttgtttgtctatcagtctcaaagagacggcca

SEQ ID NO: 147026 - DNA, 601 bp, Human
aaaccctttgaaagtcctatattgacacggggaaggctatagctctttgagcacaatagagaagtgtgaggtaagagtgttatataacacaaaacaggttatacatggagaaagacatgaagacacagataaaatacacacttgaaaaaagaaacatacaaacacattcttcccaaatgtggctacgaattaggaatgctaaagcaggtcttacagccccaggttcttttagatttatagctttttctaataatctctctttctctttcccctttatgtatatttaaccttacaggataaytggtatagagaatgccacaattttcatatgctaataaaagcaaactgaagtgacgtttgtttgttatattaaatgaaataacctcactctttcacttatgtataaactcaaatttctgcacccactaatactataagatggttatggtttgaggagtggggggtgcaaaaaatttcaatcctattttgggagtgatttaaattgatctttcccaacaatcttatctaaaaataaggattgtttctatcaaaatgatcaaaagaccaaagagaagtggaccatttccttcactgtggcttt

SEQ ID NO: 147027 - DNA, 601 bp, Human
ccaatttatattttttttcagcagcatgaatgcctggttaattatgaaccttatcacagacagagaaaaatacacttgctcctcacgcaacttaacaaaattctaatcaatgatgaccaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatrgaaaagcatgtgagagaattcagaaataattcccataatatcgtgagaagaaaaaccactgattatttgtgggttgataattcatcttctagagtagtgaggccttgtattttccttccttctggggttttcctatttcttggacattttgctcttcctcaggatggcatcaaaaagcagaaaaagatgcaaagacaaaatcaaatcagaatagctaataataatggctaacccttatgcatgattacagtgtgtccactccaatgccaggtccttgtatgtattatctcatttaacgcc

SEQ ID NO: 147028 - DNA, 601 bp, Human
tccctcatttttggagttgcagattgtttttttctttgttattgtaaataacactttaggggatatttctgaatatcagattgtcttgaatttctgaacattttcttacgcaggttcccagaaaaggaattattgcatgaaagggcataaactttgagagtcttgattttctagaaagattgcaccaatttatattttttttcagcagcatgaatgcctggttaattatgaaccttatcacagacagagaaaaatacacttgctcctcacgcaacttaacaaaattctaatcaatgatgaycaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatggaaaagcatgtgagagaattcagaaataattcccataatatcgtgagaagaaaaaccactgattatttgtgggttgataattcatcttctagagtagtgaggccttgtattttcct

SEQ ID NO: 147029 - DNA, 601 bp, Human
ggttcctgcctccatgtccacctccgctgattaagacctttcagaagccacagtgaggcacacagctctgggactctctctgtgctctgtgcatggactggtttacaaacacccatctggaggaactggagcagccccactgctggagcatgggtggctcacgctttccttcgccccagtgaagcaggtcttctagatgtgtaaatggcattttagtagagaccacagttgtttaaggcaaattcccttgatggcttctgacaactgtgtctttactctgataggaaactcattcctgggrctgaagtatataccattcagtggatcccttacctttgttggcttctaaaggctgcccaaagggtaacaggaatgagggaggtgtgagagacataatgatctgttcttcctgcaccctcacaaactgcagcatccctatcaagcactagctagtgattctgcacagcactcttaggaggaaagctttaaaaaattatgtaaaatatatacaacataaaatttaccattttacccattttaagtgtgcatttcggtggcattaaatacattcacattgttgtgcaactgtcatcatcattca

SEQ ID NO: 147030 - DNA, 601 bp, Human
tttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcastttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgacttacgggtacaataatac

SEQ ID NO: 147031 - DNA, 601 bp, Human
tccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtagrataatttaggatagcagtttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgact

SEQ ID NO: 147032 - DNA, 601 bp, Human
tggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcrtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagtttgtgaactttttgaaaccatggatccttatagatgactcttcaggaattctaacccctggtcagccctaggggtagagggtaaaggtagtgaagacgacctgaataaagtatggctactgg

SEQ ID NO: 147033 - DNA, 601 bp, Human
aggagatcccactagggtctgtctttgttggtcttctctactttatgtcattttgtctcggtgactgctggtttgatgctcttctctgtggaaaatgtgtcagtgtgtctatctaaaaattctggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagt

SEQ ID NO: 147034 - DNA, 601 bp, Human
ggtgtgtgggagggaaggggagggggtggggaagtatgaaggttagctaattcagggttctggctagttgggttccaggtagcaaaaccgtcagtaaacacaaattcaatgtctggaaccaggcacatctgattcctgcgaatgatgagacaaggacacaaggagatcccactagggtctgtctttgttggtcttctctactttatgtcattttgtctcggtgactgctggtttgatgctcttctctgtggaaaatgtgtcagtgtgtctatctaaaaattctggtctatgaactcatggsgggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaa

SEQ ID NO: 147035 - DNA, 601 bp, Human
gcacacactcttacaagatctagctaatgggacatccttggaaaaacatgctgcaatgccctgggttaaatctgggctcacagagaggcatcatttcactagtgacaggtgcatccaaaaaagagcacacaaaccatttcttaaaaatcaacagattggaaactattagaataaattgataaacaatttgtactacaactgatgtcactgggcaggcagctttataataaaacatagattatttggagactcacgactcagagaattatcttttgaaatttttgatttatatattaatgtwtacaaccatgctggtaacatcactcctctctgtaccattagcagagaatgaaaattaattttgatgatctcttgagcagaacataatctgaatctgaaatggaatattacaaataatcatatcataggttctttttattttttaaaaagaaacagaattggcttcaaaagtatgccgttggttcccaatgactataggagctaaatacataggttcataaaatgatttcatatattagttttaaaaccagtaatatcacaacttttagagtgcttaacataaacagaacattcaacattt

SEQ ID NO: 147036 - DNA, 601 bp, Human
ctgccctcttgactcatccattttacaaagctcatcagactgaaaggctcagaacacttgcagacattctcattctttggaaatgccacaaccactcagtcagtggaatgggacagcaccatcaatgggattgcgaaggcacaaatttccctgtgaatgctggcgccgcctctctttggtgtttcttctagccacaaacggacacgttatcacttactgtggttgcattcgactcagcagccagatgcaggggagtttttacttggttaactgtccctccaacatctgtgtctacagaagrtactacagggcaggcgtgtgctcatccttgtcccttctccctcctccaaccaaacacacaaaaagttttccaatctctagggcaacaccattaagatatcctttccttgctgtgctatgagtttacaagaaataactttctaacaataagccaagaagatggatgttgtaaaactgcatttcaaataaggcaattcctttttaaaaaagattcaagggtttcacgcttctttcttccttccatcaacacaatttgtttatgtatgagttggatctttcttccttcggaagagaaaagtgc

SEQ ID NO: 147037 - DNA, 601 bp, Human
tttctgtggggaattacaccaccatggaagctattgctcctgaagttttgcccatttccacctgaaatatttttttagccttacttgattacaacattagcactctctttcataacgtacaccagcaggtactacaattaacatgcacagatgttagaactgaacatccatgtttaaataaaaaacagggagaaggtaaaaattactgaatatgctcaacacagcactaatcttaaaaggaaagagaggcttacattgtgctaacttaacagcaaaataaaaaaaacaacaatcccccagwtggcattagtaacctaagaagaagcaaaccactctataaatgcctgtattcttctgaaacactgaaccagaggctgatcttttgtccatttaattccaaaatttgtactccaagaatagaggagaactcccaaatgctctcaaattctccaacacattttatgatgcaactgcacaaatgacgataacaccaacatcattttgtggagtgctggctttgtgctttatgtacgtcatctcactgaatccccacaaccaccctctcattcaggcaggcagtactacttctgttcccattttc

SEQ ID NO: 147038 - DNA, 601 bp, Human
ataagtcacaagttgtatctgggacagggatggtaggacagactaagaaaaggaaaatttgaagaggattgaaaaacaacccagcaaaatacaacaattaagaaaactaagccaccactgttttatatctgtcctgtattttaattccttagcttataggtttaattcatcacttcttgtcaggtctcaggtgaggcaaagttaagatacagtcataacttctctttaactttgataaatgaagaaacagcattctaggaaagtcctggaggaggttaaagggagactgatttgaagtctyagcatctaatcctgaaggctaacaaaaaagttatgtccacaattatgactttgtactgtgaaatacacaatacactttataatgcaaaactttggtgggtggaaaaggactctagaaggacaggtatacattgtattaaacagaaaataacttgcaaagcataaaaaataaaaataaaagcaacagcaattgttttctacctgtcagcatctggtcaatctgtcagattgttcagtaaccagaattataacagatgcaatattttctgtggggaattacaccaccatggaagctattgct

SEQ ID NO: 147039 - DNA, 601 bp, Human
tgacagtatcatttatactccaccgtgtcgtggcctgacactgatccatccgccttcatccctcattcagaggagagcatgcaatttcaccttcctccgtgcccttctctggtgtgcacgtacacattcactccactcagccctaattacaaacctgggttaaaatactctcattagatttatatttcacactccaaatgtcaatcttgttgaaaattcccgttttccggaggattcatccattagcaataaactttaaagcattctgtgactgagtgcattaaaccagcaatgcggacaygcacttaaaatacatcattagagaaaatctccattgcaaatactttacactattcaaccaaaggaataatgagccccgcctggccagtaccctcaaactgcacatgaaggataagttaaaactggcagttttgcaggaaggagcacacagtgtatccacaggatgcatttcagaatctgtcattccttatgaaagcgtgggagggaatcacagccagagtctaatttatcaccttctctcacctattatttttacagaaacttcggtctatggcaaagggcaagagggacggcgaagata

SEQ ID NO: 147040 - DNA, 601 bp, Human
atatggcacaaaaacattttacatgatgccttttacacttagatattattttagaatcataaactaaaagcgtttttaaggtggaggtacccggcataaaatagatgtatcttctttttaaccaaggcttctcctgtccacactcaaacctggctttccaagtgtgttggctttactattttatgattggatgaataaaataagactgttaactatggctacaaaataaattacgataccctgaccccaacagagtattattttggaaagaaaaaaagtcaaatccaagatattattatcrtaactgcaatctacttgtgaccctgtttcagaaaacctgccatttggaagccttatggagacatttttcagaatcttatgtattctctctgttaactgatcagagatacttctcaggtttctttcaccaaggacaaaatatgacatatacttaagaaaggatggatattgtttcaggatctctatccattcaggagaagacacttgctttttagttaaaaaatgactgtgactaattccagagcacctggtattggctttttcaagaatgagcatttgaagtcaaactggaaaatggtga

SEQ ID NO: 147041 - DNA, 601 bp, Human
tcacaagaggtcttattgtttaaattcttatagccttatgtcatatgtgaacaaatgactttattgttcatttgaacatgtctttataggatctctggtggtagagctagtgttgttgtttgcatttttcccctcaacaagccagaacaaaagtctcttttactgaagcgctgggaactcagggacgatggcagtgtggcagcagttgtcagttggaaacaccataatgataatgtaagtgaagtgctcacattaaggggttgacttctgacaagtcaaggtctacagaaaagtttccgcyacagcagacattatggtaatgcaaaaacagaagtacttaatagaataattaagaatcatccagtacactattactgcagtagggctcaattcctttcgagatatgctttccttggaagagactccattcagaatattaggggaaaaatatcagtagcctttggggagaacataatcagatgggaggtggaagcgatggcgggatcattaatgggagattcagtaggactcaaagctcaagttcattatattccttagaactaagaatagcttctgaatgagtactcacaattctccacag

SEQ ID NO: 147042 - DNA, 601 bp, Human
gagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatctgttgcatggagttgaaagttcttcaacttgtttactgyattaagtgagcatcaaatagccaaagcactggcaatgttactataataagtagttttggaggttgtgcctctacttgagtgaactgtttgattaggttagaaaagcaaatggtaccctaagtatcaaaaggcagccaaaggtcactcagggccacaggctggaccacagtgctccagggtctttgccccattatgagctgatctgtttttcccttcaatgcctccagccagcagtgttgaaatgagatattttaggatttccaaactatttctaaggctgttagtcacaaactcttatca

SEQ ID NO: 147043 - DNA, 601 bp, Human
cttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttatatgtattatatacctgcaataaagtgagctggaaaaaacaaaatgttaytaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatct

SEQ ID NO: 147044 - DNA, 601 bp, Human
aaaagattttacaaagatgagctggtgtgagagaacatggcagtacagccttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttayatgtattatatacctgcaataaagtgagctggaaaaaacaaaatgttattaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgt

SEQ ID NO: 147045 - DNA, 601 bp, Human
cctgtgaatgacactctcctaactttagcaacgtcataaagacaatcagttgctgtgtgtctggcaagttaatgactacaagcccaagggatgcaagaatgggaaaatgttaacgtagaaaaaaagactttaagcaaattcagaggaaaatggaaaaggactcaccactccctccccaaaatgctacacataacatcttgttttgaacaaggaagttatggagaatattattctaaactttgtattcattagaacaatcctttacagaatgcagacaagaaggcgattagggaaattagtrggagataaagaagaaaagagttttaggaaaagatggaagcagaggaggaaggaagaagaaaaagcagagaagaagactccatgctaaggtgacagggaagcaggagaggaatgtgagcatgaggtcaggtctgggggcaggtaaaagagaaccttcggagaacttgactggcagaggtgggtgagaaaggacactcctctcctgtcttcctcagctccagagggtggaatgaggctgacaacacgatcattgtggcagttactctgctgggggcttttatatataacattttatttaatc

SEQ ID NO: 147046 - DNA, 601 bp, Human
cagaggacgagctggccacattgggaaacagtgaaggtcgggaaggagagggtggaggtgaagttcactatgaaatgagaacatagactgactggttgactcattggttcattcagttaagctgccattgagctttgtttgttatgtgctcaacacttctaaatggtggtaatcggctgtgcacaagacatggttgcttctccccaggccagggagtgtcaccaaacacacacgttctttctaaaagactatgcatgcagtgtggtcacagtgtatttatcattgtagctagtccccagartataccacaggacttgacatatactagatgctcaatgtttattaaactcattcattcactcaacaaatatttattaagcacccattccatgttgggcatagttctaggcaatggggatatatcagtgaatataacaaatatttctgaggttccttgagatctctgtgcattcagtttacacccaaagcataaacaaaatcactgcacttattctaattatgttgtagaattgaagtcagcatttctttgtattttttcctccagagttaaaagatacttattgtgaaagtatcaaacatc

SEQ ID NO: 147047 - DNA, 601 bp, Human
gcctacttttatgtctatgtaccccagcagactgggagcctcctgagggaaggtcttattttctattttctaggttcccagagtccagtgcagtgcttggttcacagccaggctcagtatgtacttactgaagaaaccaataagtccacaggtggagaggagaaagagcatctatgtggaaaaaccaaacctcatgatcaaagaacactgcacaggaattcacgtggtgcattcaagagaggtgaccagtggctcagggagaagaatgagattggggtaagtagaagctatagctggccaygtgactctgggtcatggggtgggggtgatgaggcaaaatgaaggacactgactttcagggatttgaagctatatgttactggaatatgtgacctagctgacatttatgaagataagtttggtggcagacggtagggtggattccaggcaaggagaatagttaggacaatttactaatccaggaacgagggagcaactagcctgggagatggtgggaatatcaaggtgtcagctcctgataaacaccaaatagagctgatcatgtgcttcagcataaactacaaaagaaaagagagacatc

SEQ ID NO: 147048 - DNA, 601 bp, Human
cccacaggtgattttaggaaggcagctttgttttaaccataagattaatgccataagctttggctcttttacttatatttgtttcactctgaacaagcattggagcccttttgaacttcaattttttcctctgtaaaatgggaatactactacccaccctacctctttcatatggctgttgtgagattctaatgcctggcatatttaggtgttttataaatgtctaattggataccgatagatatctgaactggatttaatattctgtatgtcacagattccagtctgtacattttttcayctaatgatatttcagaaataaggatatatcttatagttggtggcttatattttaattaactctttctttcttggtggtacataatatatttaaaccaatggcctcttagaaatatggcaaatgaaagagttgggaaatggcaaaagtgctatgcaaatatcagttatttattcataaaacgaaattttaccaaaagtctcccttatgcaaggcattcagaagaaaatgaaaatgaataagattgggtccttaatctccagaagagtgcaatgcacgaagtggatgactcaggataactca

SEQ ID NO: 147049 - DNA, 601 bp, Human
ttcttggggtaaacatgacaaaacaatacagctggaaaaaacaaattgaaaggccaaatgatgtgcatataattttgggtaggtagtgctataaaaagaaagaaaaaggtgcacactgataataagacttagaggtgacttacaggttttgatacccacaggtgattttaggaaggcagctttgttttaaccataagattaatgccataagctttggctcttttacttatatttgtttcactctgaacaagcattggagcccttttgaacttcaattttttcctctgtaaaatgggaataytactacccaccctacctctttcatatggctgttgtgagattctaatgcctggcatatttaggtgttttataaatgtctaattggataccgatagatatctgaactggatttaatattctgtatgtcacagattccagtctgtacattttttcatctaatgatatttcagaaataaggatatatcttatagttggtggcttatattttaattaactctttctttcttggtggtacataatatatttaaaccaatggcctcttagaaatatggcaaatgaaagagttgggaaatggcaaaag

SEQ ID NO: 147050 - DNA, 601 bp, Human
aaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttcccttctctccaactgttttttttttttccctaaagtgtagtgaccagcaattgacaaactactcaaacaaagtctgaataatcctgagagcagtgtgggtatttcaacacgtctcctttagacagatgaaaggctgacctggctctgccaagacttgaacacattccagttcctgctgatctgagaagtctcttccacttgcgtttttcttcttttacctggcaatttgaataaaatgaaaatacaaccagatgtatagggaaaagagtttttagtgtacctattctttaaaatcagcttgagctttatgtaaaagtcaaaatgtgc

SEQ ID NO: 147051 - DNA, 601 bp, Human
tctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcstatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttc

SEQ ID NO: 147052 - DNA, 601 bp, Human
tcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcgtatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatca

SEQ ID NO: 147053 - DNA, 601 bp, Human
attgagaagctgaggaagatgcggcaacaaggtggtcattggtagctttgatctgaacagttctggtgaagcagtggtgtcagagactttaatggagtgtgtcaaggataacaggagatgagtctagataatacctatagacaagaagttcgaagtgttttgtgtgaaagggagcagtaaagtggagtagaagctaaaggagaatgtgacacaagaagttttttcctggggcagtattaaagattttatatgccaatgggaaagatttagtacaaagggagaaactgatcatgcaggaaaraaagggaatattttcagggaaaatactcttcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtga

SEQ ID NO: 147054 - DNA, 601 bp, Human
ttactgaaggttttctttagctctttttcagaagtgcctggtgattgtgagagaccattgttgttcaccattcaccatttttgtagtctatatttaagttaatttttctttatataaggtagtctagtttcttcttatctgatacttcaaacatctaaagcccttggtggggaaggagtaattaatatattaacgctagttttgctgattttcactcacggtggtttgtttccttgtttgataatcttttttgaaagctcaagatcccaatctgtgaaaaaaaactagaagcctaaattayatttgctttatctggaatttagtggtactaccaacctgggctattttatctcccttctagaatcccaggcttaaactgggagttgcagtacggtccccatttgcacccccacatgaccgtcacacacaaacacaagggatggccaattctgccttttctggcttgtttactgttgacatatatgcacttagctacttgtattttttttcttagatattttcattacttcctaggagttctaaaatgcaacagagatatcctttggagtacaaagtctgttatactggcagaagaagaggt

SEQ ID NO: 147055 - DNA, 601 bp, Human
tgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattatatcccgcacgtggctcagagggtcctacgcccayggagtctcactcaccgctagcacagcagtctgagatcaaactgcaaggcggcagcgaggctgggggaggggcgcccaccactgccaagttagttgtttgattaggtaaacaaagcggcagggaagctcgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcacacagcttgagat

SEQ ID NO: 147056 - DNA, 601 bp, Human
ttttctctcagaactttgaaaatatttcatcatctcctggatttagtcattgctgttgagaagtctgctgtcagtctaagtattgttcctctgtggatgtggtctgttttccctatggctccttttaagagagctgtcttcagtgattcacagttttactacggtataaaaagttgtgaaggcctttttatttgtctgtttagatacactgcttcctatatctctggatcagtatttctcattgaaaaattctggaatgccggtggggaggagccaagatggccgaataggaacagctccrgtctacagctcccagcgtgagcgatgcagaagatgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattat

SEQ ID NO: 147057 - DNA, 601 bp, Human
gttgggattacaggtgcaggccagcatgcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttwaaaaatcttaatgtttactctattttttagccagaaagtttaggcaatttacatatattgtgattgctgatatatctgcatttgtttttataatattattttctatttgtcctactttcctatgctttatgtattttttctttcttttttgatttttaaaaatcaggcttagaagttatatactagttcttttcttttagcagttacccttgaaatccaaagttagtagtttaaccccttcagaacaacaaaaggaacttataatgcaaactctgattatctccttcctcatatataggg

SEQ ID NO: 147058 - DNA, 601 bp, Human
ttctctatagttttattagtttttgttttacatgttttgatgcaatatagaaatgttatacctttccagtgaattaaaaccttatcaataggtagtgctctctctatcctgatttttttttgccttaaagtcttttatctatctatctatctatttatttttgagacagggtctttctctgttacccaggctggagttcagtggcatgatcttggctcactgcaacctccgtctcctgggttcaagcgattctcatgcctcagcctcccgagcagttgggattacaggtgcaggccagcaygcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttaaaaaatcttaatgtttactctatttt

SEQ ID NO: 147059 - DNA, 601 bp, Human
ggctggcaaacacaatcctagacaattgattctcaaaggtctcaaatcatctggtgtctaaagggctaatctaggggctcccctgaaagtctcttggtaaatctctccttaaagatttcaaataaaacctgaagcaaacagagcacctgtctagatgataagaggcctgattcatattccattctattgctgacttgtgacacctagaaattcagtcgtagcttttctgtggcatattctatgaagtgagggtataataaccgagattagtttcaggtctaggtctttctattttttttttatttatatatttagagacaggttctcactctgttgcacagactggtgtgcagtggtgtgatcatagctcactgcagccttgaattcctgggctcaaggaatcctcttgcctcagccacctgagttgctagaactacaggtgtgcataaccatgtgcagctaatttttgtgtttttcgtagagacagggtctcactatattgcccaggctggtcttgaactcctggcctcaagcaatcctcctgccttggtatcccttgggcctaagccttcatgctgccatggcatgtcatcagacatgg

SEQ ID NO: 147060 - DNA, 601 bp, Human
aggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactmctgtcacccaggctggagtgcaatggcatgatcttggctcactgcaacctctgcctccgggttcaagcgattctcctgcctcagcctcctgagtagctgggattacaggcatctgccattacgcaggctaatttttgtatttttaggggtttcaccatgttggccaggctggtctcgaactcctgacttcaggtgatctgcccgccttggcctcccaaagtgctgggattacaggcgtgagccactgtgcctgtcctgcccatgttatttctacaaacctttatcctcttggtgctttca

SEQ ID NO: 147061 - DNA, 601 bp, Human
aattatctaagggaaggcacagagggagaatcagttaatatttgtggatccctaactgcattctcccttgtaagcctggtactaggtatacaaagatgaatatggtacacctcctccccaaaagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagaygcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactactgtcacccaggctggagtgcaatggcatgatcttggctcactgcaacctctgcctccgggttcaagcg

SEQ ID NO: 147062 - DNA, 601 bp, Human
atctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagttaatatttgtggatccctaactgcattctcccttgtaagcctggtactaggtatacaaagatgaatatggtacacctcctccccaraagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagc

SEQ ID NO: 147063 - DNA, 601 bp, Human
aaagttggcacatttttaaaggtgccagcttccatggacttttaaaatttccattcattcccatagtcttacaggcttctctcccctaaaaaccatgaggactctgttcatatctgctcccctgctccactatgatcaaagatattcctctgtatctctgtgtaatactcaaaacaggaaataaagaccccaaaatgaagcctcagtatctcatgtcttccccagtgtcccatccacgtctgaaagagtgaaagctctgttttagaatgactgctggctgccaatgagagctctggatacsttgacatggatgaacgaaaacacactcaaaaaagagcaaaattgtgtggaaacttggaaacatggaaagattcagtcatttaagcatctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagt

SEQ ID NO: 147064 - DNA, 601 bp, Human
gagataaatttgggagccattagtatgcagatggtatttaaaagccacaagactggatgagatcaccagggagtaagcttatgtgggctgaatgaatgaataagcaagtttatgctcaggaaggaaactgttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccrcatgactctgtggagcagtttccactgcttggcttgtgtgcaaggtgtgtcagcctacttcaggcgtcttggtaactaagcacttttctgggtgagcatcttatcacagcatgttgtgcaggctggaacccatgagagtgagtccttcaggaaagaaacgacatcaacagatgtacacaacacgtttcaaattaataaaggtggggggaagatcacaaatacaacatctgtaacactgtacgtgcaacttgtcatctctattgaagaaacaggcaggtaagcttccacaactaagataaa

SEQ ID NO: 147065 - DNA, 601 bp, Human
gcttaagtgaccagatgaatgggggtgtcatttattgaaagaggaaaccccagaggaggatcaggtatgggggatgagggcagaacaagtgttggttttggatatgacaactttgaggagttgattagacagccctgtggaggtaagcaactgaacacagcctgattctagagagataaatttgggagccattagtatgcagatggtatttaaaagccacaagactggatgagatcaccagggagtaagcttatgtgggctgaatgaatgaataagcaagtttatgctcaggaaggaaacygttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccacatgactctgtggagcagtttccactgcttggcttgtgtgcaaggtgtgtcagcctacttcaggcgtcttggtaactaagcacttttctgggtgagcatcttatcacagcatgttgtgcaggctggaa

SEQ ID NO: 147066 - DNA, 601 bp, Human
attctttttatttttatttttttgagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtattttttttttttggtagagacagggtttggccatgttgcccaggctggtattgactgaactcctgggctcatccactcacctcggcctcccaaagtgctggaattacaggcacgaccacygtgcccagccaagaataatccttttgctgccattcatggtgtattgaccaggtgcaccaggcacagtgtgggctactgtgagaataaacatgaaggggtctctgtctttccatcagtaaggaaaccacacatgagcacataaaaacacatactcacatatacaatatcacagaaacataaggacaagtcatacaaaccataaagagatacaaactttcacataaaataatttcccttcttctgctcaaaacatacatacctataatctttaataggcattcatttaatttatactgacct

SEQ ID NO: 147067 - DNA, 601 bp, Human
aattgtcccagcaccatttattgaacatccttttttatcacactgatttgagatgcttccttaatgtaaactaaaatttcaaatgtatttgagattatttctggactctataaggtgccactgacttgcccattaatgccaattcaaatatatgagtacgtttgtagtatattttaatatctaaagagcaattttctctctttttattcttggctatttttgattttttttttttacatgaacttcagcatcagcttgtttggttacaaaatattctgttggtatttttactgcattcacrttaaatttgtgatgttgaggttttctgtccaaggacatggattgtctttccatttattcacatctttgttttttctcttcatctcaggaggattttaaaacagtttcatttatttacaagaataaagatttacatcttaaggagttcttgagttcaattcctatatttatacacattacatatatatatatacacatgtgtatatattttatttgaacttttcttttttgctattgtaaataggatattaacttccattatatcttctaatcagctgttgatcacatatatgaagaatgt

SEQ ID NO: 147068 - DNA, 601 bp, Human
agcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtactttgaattttttctaaca

SEQ ID NO: 147069 - DNA, 601 bp, Human
cagaagaaaaactcaagcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctyatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtacttt

SEQ ID NO: 147070 - DNA, 601 bp, Human
gggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatattttattaaagaaaatacccaaggagaaggrgcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataa

SEQ ID NO: 147071 - DNA, 601 bp, Human
catgggaaaaaacctagctagaaatttatggcctcttcccataaccagtatttaaatgagaattttcacctggggatgagcccaagtgaactaaacatacagttccacagatataaaaatcactttctcctctgctctttcttctcgctatttttagagaggagatttgtaagacatcttggctttactctcttgaatgccttaagtatctgactaacttcatgttcaactaatatggagaaacagatggaaaattcaccgggactaaaatcttaggcattatttaaatgagttccttgcrgagtcttttgtgtgtcttgttgggaccgggggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatat

SEQ ID NO: 147072 - DNA, 601 bp, Human
cctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattaccccttagataattaaacaccaagtcaagggacacacataatgtaaatctctgtctytggcaacacagttgagtaaatagcacatgaaaaaatacaaagtttatctaactaccctctctgggttgttaacatattatgacacaccaaactactcttgcctttaagttctattacatcctgagaatgaaaatacactcagctgctagaaatactcactctgctctgcttgcattccatgggaaaaaacctagctagaaatttatggcctcttcccataaccagtatttaaatgagaattttcacctggggatgagcccaagtgaactaaacatacagttccacagatataaaaatcac

SEQ ID NO: 147073 - DNA, 601 bp, Human
tggccaattaattatcaattacaacatcataaaacattagcacaaaaataggaataatgaaatttaattatacattattcttctgagttgctgaaaataatatacaagactgattctgattaataattcattcagcaataaagtatcaggaaagataattatgcagtgccacaattctcacactgatttctataattacagattacaacagtgttagcaatttaaaaggttagagagctgtggtaatttgctatgtcatcctcagctatattaatgtctctctttgagcaccaaagataaytgaaaatataataatggaccaaatcagatggcttgcccatgctctcctcacctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattacccctt

SEQ ID NO: 147074 - DNA, 601 bp, Human
ttcataatcctttcagattttaaatcctgtgtgtctgtgaggaggataaccatttagtattttagacaactggaaaagaagattagaccacactgtgtctataaagttgtgctacaccctgggttaccctcatcaaaggctgaaggaaatggctgttattctctttttgaaactgtagttatatggtgactgctggttatttagttagaatggaaaactgatacacagagaagcataccaaccgtatctaatgtattagcctgatattaacaactagcatctgattacttacaattgaccrtatttgaaatctattaaaatctcttaattattcttatatgcccatagtcactgctttctcttaaggcaacatgaaatgcttaatgattaatataacaatttcaaaagctttattgtacagactggactagactctgtagtcttcacagagtgatcattacttaatgaactcagcacactgtacattttccagccacctgaaactcccaagtattgtgtgagtttttggccaattaattatcaattacaacatcataaaacattagcacaaaaataggaataatgaaatttaattatacat

SEQ ID NO: 147075 - DNA, 601 bp, Human
tgtaccctgaaacttaaataaaaaaaaaaaaaaaaaaagaaaatcagaccagcaggaaggccacagagcaacttttcctcacgcacaggaatgtgctttagttctactcacagtggtctgatgacaaagtcctctttaataacttataatttggaattgtaagacattggacccaacacaaccaatgtaaaaacaaaccactcatgatcttcctgggaaaatggaggtgcatttatataggaacagtcttctgtggatggttttctgagcagcttagcaaagaattgattaaataacagcmtatgcgttgttaaattccctattacaatgctttcaaaattctttgaaagaaaaagatgctcacctgttaaaaaaaaacgtaagtttctaaaggagacacttgaaaaccagaaaggagcatcaccttcttaaaaaaaaatcaaaatggcacagcagaagttcacataaaatgcccgacaatgtttcttttcaatagaactcaagctgactaaaagacatgcttggattcagagcttttactggttacctaggttgcaaatgataccaaaagagacactaggaattcttagttagaatgcca

SEQ ID NO: 147076 - DNA, 601 bp, Human
ccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcaaatactcacaaatccagaaacacattgcccattggctctatacaatgtggatccttgcagagtagaattaggctgttytctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgggagtagacgtggctctggaaggcctgggtttgagagaagatggtaggaggaaggtttctgattttcgaatgaaaatca

SEQ ID NO: 147077 - DNA, 601 bp, Human
ggtctccttccagcctgtttcttcacacatatccctacgctctccagagctgcttgtcttttctgggcctcaaggtcgccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcmaatactcacaaatccagaaacacattgcccattggctctatacaatgtggatccttgcagagtagaattaggctgttctctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgg

SEQ ID NO: 147078 - DNA, 601 bp, Human
cccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtacgttttcagtaataatctacaaaaatgggccaaatacagggatgaggccttttgggagatggtaagaaatctgagcccaggcctttgctttgcartaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagactttttaaggaagctagagatgctcaaaagaacacaactggctggaagggaaaaatgccatcacataacttttgagagagatgaagaagaggggaaga

SEQ ID NO: 147079 - DNA, 601 bp, Human
tatttcttgacatgagtgacaggtaaacatattcccactttaagttatacatttgttttatgcacttttctacatctactatatatatatatatcccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtamgttttcagtaataatctacaaaaatgggccaaatacagggatgaggccttttgggagatggtaagaaatctgagcccaggcctttgctttgcagtaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagacttt

SEQ ID NO: 147080 - DNA, 601 bp, Human
ctacaccaagatagaagcttgtgttgaaagaaacaaagccataaattctttaatgaaacatgaaatgaaagaaaataaaaagagaaatgaaagtgaagtgcagtggaaacaggagtggaccaggcatgtttggggcttttggtttagctccagcattgaccaactttgtggatctggacaaactgcctaactgtttaggggcctgcttccatgtttgtaaaatgaaaagcatgaactagaagaccaatagtgttcttccagatctacaattctatgagtctataaaagaaatatacctgaytgatcacaaagagcgggatactgtcttttttaactgagagaagctagttttctttgaccttctaaagaccattttgtgccgttatattgttgttgatgttgcatggcttaacaaaactgcccctgcagagctggttacagggaatggggtggacaacaaatatacaaggaaaccacagccttctgggagagtagaaactaggacccaaacccctgctctttctgggctctaagatggttgaagttctcaagagtagactccatattctgctaacagggcaggtttagaaaaacaaagata

SEQ ID NO: 147081 - DNA, 601 bp, Human
tacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctrgtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctacttaagatgttcaatctttcttctaactttttgaacacttggaatatagt

SEQ ID NO: 147082 - DNA, 601 bp, Human
ttgttaaaacccctgtactatattgtcattacttttgtttagtcaattaccttttaaaaagatataaataatgaggtaacattacttgcagtgcaggtatactagtgataaattatttcaacttttctctgtaaaagcctgctgccttcatttttgaaagttatctttgaagggtatagattccaggttgacaggtgttttttttttttcttttcagtactttgaaaattgtcattccactgtcttttcacctgcattgtttccagtgaaaaatctgtcatcctcatctttgttcctctgyatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaa

SEQ ID NO: 147083 - DNA, 601 bp, Human
acaaatgatttacacacgtgttttttggcttccaaatatttgggggagtttttagttatctttttgttaatcctctctgatttaattccattgtggtcacagaacaaacttcatatgactttaatccttttaaatttatggagacttgttttgggtcccagaatgtgacccaccttggtaaatactacataagcacttgaaatgtatattctgttgttggctggaatgtcctgtaaatatcaattaggttaagttgtatgatgagtgttgttcaagtcttctaatatcttttctgatcttytgtctataggttccgtcatgtattgagaaggagtactaaaactttccggctacaattgtaggcttgtctgtcagttattgtaattctattagtttctgcctcatgcagtttgaaatcctattagatgcatatatatttagggtttttattttttcttgtagtatttattcctttatcactatgaagtcaccttttaattcctggaaatattctttgctctgaaatctactttgtctcatattaacatggtcactccatcttttgtttggtgttagcacagtatatctttttctactctta

SEQ ID NO: 147084 - DNA, 601 bp, Human
tggcgtgatcatagctaactgcaacctcaaactcctggggctcatgtgaccttcctgtctcaggctcctgagtaactaggactataggccgtgccaccatgttcagctattttttttttttttttgtaagagatggagtcttactatgatacccaggctggtcttcaactcttggtgtcaagtgattctcctgctttggcccccacaaagcactgggattacaggcgtgagccaccacacccagcccatatatagtttttaaaaatattccttctaatatgggttgaatctgtactgatgycacctctcatattactgatactgaaaatttgtgtcttctctttctgatcagtctggctagaggcttaaccattttactgacattctcaaataactagtttttggttagtttttttaaattattctattttctagtttgctgatctctattctcattgttatatcctttattttgcttactttgggtttaattgggtctttttttcttttccagtttcctaaggtggtagttgagcccactaatctgagatcttttttgtcttttctaacacaggctttaatgctataaatttcactctgt

SEQ ID NO: 147085 - DNA, 601 bp, Human
gctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattctcctgcctcagcctccggagtagctggaattaaagaggcatgygccaccgtgcttggtcaatttttgtatttttagtagagacgggttttgccaggttggccagactggtctcgaactcttggtctctcctcggcctcccaaagtgctgggattacaggtgtgaaccaccacactgggccctcagcaacgttttatggtagtatataggtcttttatacctcttttgtcagatttatacctaagtatgaatatttttgatgccattgtaaatggcagtcttttaatttcaatttctaatttttcactgctagtatatacatacaaataatttttgtattttga

SEQ ID NO: 147086 - DNA, 601 bp, Human
catatacattttataatcagcttgccaatttctacaaaatagtctgctggaattttcactgagattgtactgaatctactgatgaatttaggaagaactgccatcttaacaataatgaatcttctgacccatgaacacagtctctttatttagatcatcttgaatttttctcagcagccgggcatggtggcttacgcctgtaatcacaagactttgggaggctgaggcaggtggataacttgaggtaaggagtgtgagaccagcctggccaacatgctgaaaccccatctctactaaaaaygcaaaaattagccaggcatggtagcgtgtgcctgtaatcccagctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattc

SEQ ID NO: 147087 - DNA, 601 bp, Human
attgaggcccaggaggatgttggtgcagtggactgtggactcatacacatacatgggggagtcaggcttctcatccacagacatgccgttcacaccctgaaagaaagaaagaaacaaagaaagaaagaaagaaaggctgagtcaccacagctgtaggatcagagagaggaggtgagaaagaacatcatggttcctgtgtcccactgccatgagcatggcaggaaggaggggaattaccaatcagcatatttgtgcttactctgtacaatgagctcaggaaacatatctgtaaagtcaagtyccacagctgacttttatgcttcctacttaccgcattcttttaccccatggtaacaaagccagatcttttaatagaacatttaaaacatattggtattttaaaacttggtggttctgattttgttagtaggctgaaaaagaaatttcacatgtaaatagcctctatgcaaggactaacttagatttgtgtgaagaggaaatgaatcattttgaagtatttgtaatgttgtcttgatgaagtatatgtaagttcctaaggtgaaatttggctgagatgccaagtagagtaaacatcaaatca

SEQ ID NO: 147088 - DNA, 601 bp, Human
gcacaccgcgctggtggtacacagggaatgattctgcccgaacacaaagtattatccttagtcccataggaatgacggaagtcaggatgatgaaccaagaggtagtgtatatatggttcaaaggatgaccatttaatggtttgccattgtgaagcccatcttttggggtcctacaacttaaaccatccaattaaatgtcatctctggacagaccaggtccagctactagtgttcccaaagtgccaaaataaccgtattcactgatgtgattaagaaacctgagtgggctgttttcaacaayggtgagaaaagcaagtttacacttcttagaatcttactgaattaatggtgaaaattactagttgcttttatttttcccccaagcaaagaaggtgctgtgaatgctttcgatcttttactctcaagggaaatctagtgatccttacaccatctgaaagacagaaatcatagcaatgattcagatcccacatctaggactgtgccaaacttaggctgaaccactcaaaacctgaagggtaagtgaactagaaactacaagtgactgagccacaggtgaggttcagttcccttcaagaaagat

SEQ ID NO: 147089 - DNA, 601 bp, Human
ggcctccatgactatagctaaggaggtgtcatactaatgagcagtggaagaacggccctgcaatgcttagcacatcaactactttctcttcatctcttagcaaaacatatacttactcattataaaattgaatgatctgctttattatgtaatgaaagtactaagtacagtggcttatctcctactatttgctgacacaattacctgggtgtgtttttcagtggggaacaaacactcaagtcctagaaatcctagggattgccatttgtttttttttaaaaacgcaagataattcaattaytccttgatttctagaaggaggcctccctctatttttgtctgtctttcagtttagagactatgctgggctctgtgagtggctctaatgtgctggtaatggcgtggctcatcaggaattgggatttgggggtggaattgcacaactggacagtcgctggacggcagatctgggtttggcctaaggtggatggggagttggggggaggagtggcagtttgtgttcggaagtttcaggctcctaggaggaactctcaggcctggctgtgctggcccccttgaggagcacagcggttggctgcca

SEQ ID NO: 147090 - DNA, 601 bp, Human
catgactgtcttattgcttccttaagactgaacctaaaccatcccagagacattaacagctttcatatcctctaaaaacttccagacaagaagattccataatttccttgttggcatctgtgcttggcagtactgctgcaggaatgttctttattgcagcctgtggttaagacttaacaacaaatgccttttctttagaatccttctgggtcagctttctttcctgtatagcactgaaaagtgagatttgccccaaaatgttgagtgagagagagaaagcaaaagatagtgagcacaagcragcacaaacctgaaatctatttataccgaggaaaacataaggtctacctgcaggggccatactcacccccagcctgtagctgttccctgcatgaacccgtccccttctctagagggtacaaggacacaggaagcaagccagagaaaggtggtgagaccttggcagtaaccttttaacagccacttttcccctagcattctgtcaaggagccaggcagccacgtaagaatagtgttgatgtgcaaacccactgtgggctgagcatcttctaaggaagcacatcccctccctgtcctctgaa

SEQ ID NO: 147091 - DNA, 601 bp, Human
aatggcatctaacaaagtatatttaacactgattaatttcctctttttcctcctcctccccactggaatgtgagctaggttcgcctagcacctagaatgatgtctcctggttacatagcagggtcttgacaaatatttgttgaatgaataaataaatgagtgaggaaacagaagcccagagaggaagactagtttgctgaagacctcacatgcagtgataccaaggtgcagagtgtggttttcccagcccctcaaggctgatgatcctagtttaaaaaaatctgcccattactctttttcwggtaaagagtggtggtgtcttcttcagagttttgtttaggtgaatggggtgaggccaaagggcaggctctgtgctctgggctaagtgagtgttttgcccttctcatcctggtcatgccacttcccaaagacttcacccctgtttcccaccaaaactccaccttcccttgtcctcaccctcaggctcagaatgctgttgtcaccctgtgctgtggcgttaactactttctgtactattacatactgaaagggttgcccaaagataatcatgactgtcttattgcttccttaagactgaacc

SEQ ID NO: 147092 - DNA, 601 bp, Human
acacacacacacacacacacatgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtaaattgaatgcatttaactcatccaaaaraatctccagttacgaaaactgtgcttcaattatcttcccttagtaacttcagttatcttccctgatttcccaaactatgaagttcttaccctgaatctgggtgttccacatttttaatctttccaccttcctatttgtagggtacaattcaattcctgtgctactacagatccacttggcagatataagaaacacaaagaatactcccacatagactaaggcattcagtgggaaacaaacagtgcacacatcagaacgcctctcatggtagtagagtgttcatctttatagagcaagacg

SEQ ID NO: 147093 - DNA, 601 bp, Human
ccctccacctgaacctctgcagcacaaacaactgccagtaccctgccatctacaatgaatactcttgaatcactcacctttgatttctatgtttttcttttgattcttcaactgtattgtgggttctttgaaggaggtaatcttgctttacatttctaagttaatcccccaaagaaatgacctctggggtcttgtggtccattcctctgcttctatgaagtgttgtacttaaggattttgtcttattaagcatctggtttaagcacatgcacacgggcacacacacacacacacacacacctgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtaaattgaatgcatttaactcatccaaaagaatctccagttacgaaaact

SEQ ID NO: 147094 - DNA, 601 bp, Human
gtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggctgtgtctcctgactgtgctctctgtctgtggtgggttgttgttgccatcyaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttgccacaccagtgtcctctcctgaagggtctctccccacttgctccctagtg

SEQ ID NO: 147095 - DNA, 601 bp, Human
tggagctcaatctcagcccctgccccttttttttcctgtttctcaaaggggtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggstgtgtctcctgactgtgctctctgtctgtggtgggttgttgttgccatccaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttg

SEQ ID NO: 147096 - DNA, 601 bp, Human
tcccctgaggtcaggagtttgagaccagcctgaccagcatggaaaaaccccatctctattaaaagtacaaaattagctgggcgtggtggcacatgcctgtaatcccagctacttgggaggctgaggcagaagaatatcacctgaacccgggaggtggaggttgtggtgagctgagatcgtgccactgcactccagcctgggcaacaagagcaaaactctgtcacacaaaaagaaaaacaatcaaacaaacaaacaaaaaaaaacaaagaaattactccacatcggttcacagagaactttyttctttcttatggctacacagtacatgattgattgtgtggctgtatgtggataactttgtgcacatgttgttttgtatctgcacgaatctactattttttcataggttgctatagagttttttagtaggttgttataaagtttactctttaacacatattgaagccctaatccccagtatgattctatttggaggcagggcctttacaaaggtaattaaggttaaatgaggtcacaagggtggggccctaattggatagaagtgatgtccttataagaaggagagacaccagagcactgt

SEQ ID NO: 147097 - DNA, 601 bp, Human
ttttctttatttcacatcccatttctaatcagtttgcaagaaaaactaaaattgtgaaggcaacccatctaccttggctggtctctctcctcccaatacccacccccaccgacccctccaacctctggtccatgttcgtatgtcaccttctcactgagccctgtcctaactactgtattcaaaattccaactcctgtcctccctaactactcccctcctcctagatttattttctcttaagttgctgatcactaacttaggtattcctgcttactgtctgtcatccctaattgggatatargctctgtgaaagctcagagttttgcctgttttgtatccctagtacccgcaacagtgcacacagtagatgctcaatgcaaatctgttaaatgaatgaacagcttcttctggtcattcaggtctcaacacaaagttcttctccttagggaagccttccttggccatcccatctaacgttgcacttccctaaattactgtctatcacatcactctgctttactttgcttctaggacttacaataatttaaactgtcttgttttcttatttgccctccacaatacttgtaggcccataagaact

SEQ ID NO: 147098 - DNA, 601 bp, Human
aaaagaagttcatgcaatgatgggactgcctaactcctggaggtcccctgtctagagctcctgtttagccatctgttttctgtgacaatggttagcacctgactctgggttaaaattttttgggtagttccctcaggtctgcaaccttgatttaattaccaaatctaggtcgaactctagacacaaatttgaggtgaacaatcgaaccaaggtgtcatgctgtgcattgagcagtggaaggaccttctcttgacctctcatggcccctgatcacagatggctgtgctggcacagagcatgyccctccagttctccaagatggagcaagaaagaaggccctgtatgctaagacaatcatactcttttcacaaatatttcatgtgacctagaaatgtacacagtttggtagtgttaaatatattcacactattgtaaaacaaatctccagaaccttttcatcttggaaatctgaaaatctatacccattaaacaacaactctccttttccacctcctcacacccccggtaaccaccacttgactttctgtttctatgaatttgagtactttaggtatgtcacataaatggaatcatttagtaa

SEQ ID NO: 147099 - DNA, 601 bp, Human
tgagtggcaactggtgagctactccaggagatagaatcaggatcccaaatgatgacccaggctgatattatgtgttaaatgcagaaagatttaacaaaaatagatgtcaaatcctgtatcaggattaaaaaaatcaactttgtaagaagaggatgggagagtcctggcttaaggagttgggtcagtatggtgacacaggtgacaggaaacttaccctgatgatcctgaactacactgaaagatgtgtgatgcagaaagcgagtcacgcctctgctctgctctttaccactcaaatcagatkgaggctgtcgaacttagtcctggctgtgtgtgagggatcacactgatcactgagtccatgccccaggtggcatgtggaatggcagaagtacattaaacactgagaaaggcagactcatgggcaccctataagagttgccttcagagagctaacaggctaccatgtaaagatgagattagatttgttctctttcatgccagagggtgtaaacgggatcatgagtgaaattttaaggaagatagatttctgccacaaataaggaagaacttgctagtagtcacggttgtataaaatggagga

SEQ ID NO: 147100 - DNA, 601 bp, Human
agtgggggcgggacactaagattctcacattaacaatgcacagacatccgtccatccggcactcctgggtcatgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtrttaaagcagttcagtgagaagcaaggcaactgaaagccccttccaacagctgccaatggttgtggacgagcaggcagacaccagggctaggaggaagggagccaacaatcactccacagtggcatttttcaggactcagtcatttctgatgctggaaagaagcttgagaaaccaaagtacagctgtgggaagacagtgtggggctggagggatgcgggtgtgggctgctgcccacgtgctccctggccctgttatagccggacttgtaaggctttcttaagccttgcatctgagaaaggc

SEQ ID NO: 147101 - DNA, 601 bp, Human
gagcacagaagtttccaagcatctactgtggttctcaatcctttgcagggaagtaaacaactgaggtggccacctgggattctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcrtgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtgttaaagcagttcagtgagaagcaaggcaactgaaagccccttccaacagctgccaatggttgtggacgagc

SEQ ID NO: 147102 - DNA, 601 bp, Human
tgagtcctcgggcaggagacatttggccgtgcctttcctattttccagggataggactgtgagttacttccgtgtggtgggcggtgggtgcttgcaggggtgaagtactaacaggtagcaaagtgttggagacacgaagcattaatcatcagtcaacaacagcagtggcagcactgctatctttcctggggctagtgagaattaacggattaatgtttaggagagcacagaagtttccaagcatctactgtggttctcaatcctttgcagggaagtaaacaactgaggtggccacctgggwttctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcatgtccctgagagtgacacagggctgcccctggggcagacacatgagatcatctgaactggttagctccagagggcctc

SEQ ID NO: 147103 - DNA, 601 bp, Human
gcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttawgcatattaaaactgagaaaaaaataaaaagatcagaaaagaggtcaaagttaagaaagtcttggagaaatggaattattagcgagaaaataattctagtggtaacattattttcaagtggattctctttaaaaatcctgggtctggggaacagcatgagaagttgacacacaggcaaagctttgagcctttcttgtaaggagttacctagaggaagcgtgtgatttgatacacctaaatcaatgcaatatattatttgacagagttatacggagctcctgataaccaactctgtgctata

SEQ ID NO: 147104 - DNA, 601 bp, Human
attctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtagccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttaagcatattaaaactgagaaa

SEQ ID NO: 147105 - DNA, 601 bp, Human
cacaaagagacgtttgaattaaagtttaaagatgacaaatggtctaaattctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtrgccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatt

SEQ ID NO: 147106 - DNA, 601 bp, Human
aaacttttgaaatgtaatttatccaaactgtttaatcttccttccttagacactgggctaccgaaaatgtaacctgcatttgcatgaaccaaatgcatgagataatggaaatgtttcaagtagtgcaaatatgaactgaagattcttcttacagtcatataacttgtgtattaaaaatatctgttttagaggccaggcgtggtggctcacacctttaatcccagcactttgggaggctgaggtaggcggatcacctgagaggtcaggagttcaagaccagcctggccaacatggtgaaacsccatctctacaaaaatacaaaaattagctgggcgtggtggtgtgcgcctgtaatcccagctactccggaggctgaagcaagagaattgcttgaacccaggaggcagaggttgcagtgagccgagatcgtgccactgcactccagcctgggtgacagagcaagactctgtctcaaaaaaaaaaaaaaatctgttttaggggacgatcctcatttcacatcatccttggtaaaatgaaaactgaaaagcacacctggacacacacatgagcatggggctctgtttggccatgtgctgctctg

SEQ ID NO: 147107 - DNA, 601 bp, Human
tgccttgtgatctctgcctttccctaaggaaagtgtatgtttccttgatactggaagcagatgggttccttagctggaacaccaaagagattttcccataaaaaataactgtatggacagaagtgtggatgaaaaaaacgcatcagaatttctttctccaatgataccatgtttgctggcattcaaggcttcagggcttagtgatctggtttcaatccttcctctcattctcacctaatacaaaccacatacttgcctgcctctagaactttgctaaatgatctctttcatttatttgacraacattcaccaaatggctattgtgttggcctggatatatagggtagatttgtacaccgaaaacactcccctccaattcttgcacaaagaactaactgtccaaatgagaagacagataagcaataactcaatgacaatacagtgtaacagctgctatgacaaatatggagaaggtactacagacatacagcagagggacactaaaccccaaatggccatttcccatctactgaaattctacccacatctccctctccacgatgtagtccctcatcttctcattagaattacgtgttcctgc

SEQ ID NO: 147108 - DNA, 601 bp, Human
tgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcaatscatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagcaaag

SEQ ID NO: 147109 - DNA, 601 bp, Human
atttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcratgcatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagca

SEQ ID NO: 147110 - DNA, 601 bp, Human
atttttgcaatttggcaaattttatcatgcagtgagaaattattatctagatgctatctgctaggatatacaatgaactttctccttatcctactgaaagtacacctctcaaaaagaatacaaaataagagcccttcttggatttatttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagaraagtctgagctattggatttgccagcttggattaataactacccatttcaaatcattaatgatgctggttccagttcagtgattgaactgggtaaaaaaacatttcatcttattctttccttatgaaagagctgctggctttgcaatgcatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctg

SEQ ID NO: 147111 - DNA, 601 bp, Human
acacgtaaagtgcacagggcagtgcctggcataccctggatgctcagtaaaggttatttaaaaaaatcatcatcatcatcactgtgttagacacaagggatatgcaaaagataaaacagagtccttttcttagtgctgggtcagataattttttaagactaaggttttacgattccccatatatcacgggagaaaaaacgccctgatgtcctcacacgttccatgcatcatgctgtgttagcaagatcttttaacatttctccttgctgccaattaaagggcaccaagtcaaagttgataygtaaaaattactgtcccattagcaccttctggcctcgctaataaatcctaacttaattaggcatatgtatctttttcgtgggacaagggatagccaaaactagaggtatatgggctccagcttgtttacaaccgtcccttaaaagagctcaatgcataattgcatacccataaatacaaatgctataattttcttggatcaaagatcattttcaaaaagtagacacgtatgtatcttcatggtagcttttaaagcaagttctacaaggtctaacaagtcagttttgagagcaggccttcc

SEQ ID NO: 147112 - DNA, 601 bp, Human
ctcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggtttcctagaggagtcttattctctcggtgtctcaaaatagaggagttccctggcaaaggtaggttcttatgtaagttaaagtgatgcaggcattaatgtcttcatgtgatcaactgacataaattgaggagagccattaatggayaaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttagtgagtcttactcttgtcattgaagca

SEQ ID NO: 147113 - DNA, 601 bp, Human
aaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggtttcctagaggagtcttattctctcggtgtctcaaaatagaggagttccctggcaaaggtaggttcttatgtaagttaaagtgatgcaggcattaatgtcttcatgtgatcaactgacrtaaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttag

SEQ ID NO: 147114 - DNA, 601 bp, Human
taccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggttkcctagaggagtcttattctctcggtgtctcaaaatagaggagttccctggcaaaggtaggttcttatgtaagttaaagtgatgcaggcattaatgtcttcatgtgatcaactgacataaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtaca

SEQ ID NO: 147115 - DNA, 601 bp, Human
gttgcagtgagctgagattgtgccactgcactccagcctgggcaacaagagcgaaattccatttcaaaacaacaacaacaacaaaaacaaagatggctgggcgtgttggcttgggcctgtaatcccaactactcagcaggctgagggaaggggatcgtttgagcccaagagttcaggaccagcctgggcaacactgagaccccatctctaaagaatgaaaataaaaaaataagaaaatataaaaaataaaggtgattggaaaaatagatgagctagtataatgtgagatgatgctgcatayagccatggtcagaaacggggaaaaggcaggggaaagttgactttcctcccaggacctgtttgttgatttccatgataattgtggagcaacctaccaaacctaccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtc

SEQ ID NO: 147116 - DNA, 601 bp, Human
tatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatataagatacaaatcaccttatccctttaacraatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttccacatggctggggaggcctcagtcatggt

SEQ ID NO: 147117 - DNA, 601 bp, Human
ttagtttgtcctgaatgatatcattactttatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatawaagatacaaatcaccttatccctttaacgaatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttc

SEQ ID NO: 147118 - DNA, 601 bp, Human
tgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacgttttcatgctagttggatgacagtatttaagaaaagttaaattgataaaacatcattagatcacagaaaggctaaagccataagtattttgtgtacakatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaattccagaccagcctgaccaacatggtgaaatcccatctctactagaaatacaaacattagctgggtgtggtggcgtatgcctgtagtcccagctacttg

SEQ ID NO: 147119 - DNA, 601 bp, Human
aaaggaggtggcaattaaactggaccctcccttctatgacctggacaatcagcacttgcttacagaccatcagtttgggcatttaatcacaggagggctgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacrttttcatgctagttggatgacagtatttaagaaaagttaaattgataaaacatcattagatcacagaaaggctaaagccataagtattttgtgtacagatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaat

SEQ ID NO: 147120 - DNA, 601 bp, Human
cttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaagcacctacagcatcccgggtgttccagtatttggatggaattttagtcacygaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggtagaggcaccattgtggtaaaaatacagagactcaaagcaaaagggaaaact

SEQ ID NO: 147121 - DNA, 601 bp, Human
ttttcacaccaacacaggggatggtaagaaaaggaagtaagtcacaggtgcttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaarcacctacagcatcccgggtgttccagtatttggatggaattttagtcaccgaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggta

SEQ ID NO: 147122 - DNA, 601 bp, Human
tttttgagatggagtctcactctgtcacccaggctgcaatgtagtggcacaatctcggctaactgcagcctccgcctccaggttcaagcgattctcgtgcctcaacctcccaagtagctgggattacaggcgtgtgccaccacacccggctaatttttttgtatttttagtagagaaggggtttcgccatgttggtcaggctagtctcgaactcctgacctcaagtaatccacccgcctgggccttctgaagtgctgggattacaggcataagccacagtgactggcctagatatactttyggctctgcttgtctttccagtggttacatttttattttgaatatggaattccttcccatagccatatttcactgtgatgtccttctgcttaccaggttacttgggttctctgagaaattctatttatcactgtggcaataatctccaagtccatttttacattactcctgcttcaaccatgaatagacattggagactgtaacttcttgatttatcccatgatttaccaaatattttactttcctaccaatatcaaacttgctgggttctgacctaattggtattatgagttaagcaaga

SEQ ID NO: 147123 - DNA, 601 bp, Human
acttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaagaaaagtagtcacattcatagaaacagaaagtggaatggcgtttatcaggggctagggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttctttaagatgatactgccgctttcttctaaagatcttctcatgtgtactcttattaatt

SEQ ID NO: 147124 - DNA, 601 bp, Human
gacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaagaaaagtagtcacattcatagaaacagaaagtggaatggcgtttatcaggggctagggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttcttt

SEQ ID NO: 147125 - DNA, 601 bp, Human
tacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgytgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaagaaaagtagtcacattcatagaaacagaaagtggaatggcgtttatcaggggctagggggaagaaaaagagggggagttgtttaatgagtacagagttttggattttccaagatgaaaaaactttggaga

SEQ ID NO: 147126 - DNA, 601 bp, Human
gcagggtcttaaagaggtgtttgtacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggkgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaagaaaagtagtcacattcatagaaacagaaagtggaatggcgtttatcaggggctagggggaagaaaaagagggggagttgtttaatgagtacagagttttggatttt

SEQ ID NO: 147127 - DNA, 601 bp, Human
tgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaagaggtgtttgtacactcatgttcacagcagcattattcacaatagccaagaagtgaaagcaacccaaatttccattmatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttag

SEQ ID NO: 147128 - DNA, 601 bp, Human
gtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcaacttcccaggctcaagtgctcctcccatctcagtttcccaagtagctgggacaggaggcacayaccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaa

SEQ ID NO: 147129 - DNA, 601 bp, Human
cttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcracttcccaggctcaagtgctcctcccatctcagtttcccaagtagctgggacaggaggcacataccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactac

SEQ ID NO: 147130 - DNA, 601 bp, Human
tttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatcatatacctagtaaagggttgatatataaagaacccctaygtaaagaactctcatttaaagaactcctacaactcccaacagcaaaatataaaataacccaactaaaagtaggcaaaggacttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttg

SEQ ID NO: 147131 - DNA, 601 bp, Human
ttttgccatcctcagtactacacagtcagccccaatgagcagctgttggttccctcatctttacgctccaaagagaaccacaaattcatttttgttttctgtggtcctcttcgaaaggtctccactcattttgggcttgagttttcttgaacgccttatttgtggttccatacatgttcccatagttgttcgtgtttttccagtgtttaaaataaaactctgaatgaaacacaactgctggcacaatttaccctcctttttcaagaaaagggtcctcatgtgaactttgttttggacactyctagccctcctgaatcatctttccccacagatgcataatttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatc

SEQ ID NO: 147132 - DNA, 601 bp, Human
agatggttatatttcctaggttagtgacaggcaaaagtcatatatgatacagatacaaggaactatattcatatttaccctaaaagcatacggtgaaaacagaaaatctcccttctgaaagattataaaatgaagttcacagaataatttttaaaaatccaatttcaatataagtgtaggtcttaaaatagatatgaaatagtagtaatgtttcacgtttttcagtgtaaaataaaagtgaaaagcatcccactcactggtaatgaagtagtaaaacctgcatcaaggtttatggtttcaytcgaaaaactgcctccaaaagaaaattatttttaaaaagaagatttagaaaaaattacctaatttccattttaaatgaccctcttcccattccagaaaccagtgattttcctaggcgagaatttcttgactcaaggtctggtttcaccctctcaacccctctagtcatttcaaaccaactatgaaccacttgatcttcaaccagaaaatacaaaacatttttgaaggcttccagtgatgagaagtttggcccctcattagcaccttctaatggttcttcatgttaagtttcaggaatgga

SEQ ID NO: 147133 - DNA, 601 bp, Human
tggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactcacatccacttttctcatatttc

SEQ ID NO: 147134 - DNA, 601 bp, Human
cctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttcmgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactca

SEQ ID NO: 147135 - DNA, 601 bp, Human
gcaattagttgcacaggttttatgctcatgaagctggccctgtcaataacacatgcatgcacaagtgcacacacacacacacacacacacacacacacacacacacagttacctattccctgcagttgaaatggactccctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactygaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaactta

SEQ ID NO: 147136 - DNA, 601 bp, Human
gtcttagtgaatatgtcttaaaacataaacggagtgtcttttctctcctgtgcaggtttgaacttggatctgcagccataatgtaaaaatccttcccctatttgtaagttttactcctgagactctatctgatcattcagtcacttataatttttttgtttactaattttattttattttttagagatgaggtctcactatgttgtccaggctggcctcgaactcctgggctcaagccattttcctgcctcagcctctcaaagtgctgggattacaggcatgagccactgtgtccatccawactcattttttcattctccaacgatgtgctaggcactcactgtgtactatgcaaggtctggggactccactttcttggattcaagtctcagctctgctgtctaccagctgtgtcacttgggctggttacttaacctttctgtgctttagtttctacaactgtaagacagggatactgacagtgcctgccttatagtaaaacctttggaacaggacctggcattaagtaacaaccagtattattgctgttgctacaaatatgaataaaacaccacctttttctccaaggagctaacaagtg

SEQ ID NO: 147137 - DNA, 601 bp, Human
aaataaggccagggtaccgtgtccgatggtgcaagtcaacatgctgacaatgtgttgaaatttgacccactgtaactatgacccttaatccttcattacattggattctaacatatcatctctctgctgaaaggaagatgggctgatgaaaactcaatttgtagagaaagtttgggcactgtttgcaaagctggggagctcagtgttttggggagctcagtgttttggggagctcagtgtttcatgagacatccattttgctgcaggacagagtttatgaggatacttacaacagttccayctctggactatgatagggatgaggcagtcagccttcaggcatttattgaaaatagggtttgaggatttttgagacttggaacatcattctctatataagctacatgactaaggtgtctccagttggttttggcagtatatacacatggctgtagcattgagcccatctgcagaaggctgatcagatgaatccggaggacaggtgactgctccctgggagagggctggcacgcttctcaaggtcccttaatcacaacttcacaaaaaagggaaacttacatcttcagcaacaccatgtaca

SEQ ID NO: 147138 - DNA, 601 bp, Human
ataaagttaaaatggaatgaagtggctataaatagaagaatagttccaactcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatragatgggatcacacattggggccagaatacagtgtgccatgtgggggcgagacctcggagaaggcagaaagttaaccctccaacctcccacagactgcttcctaggaggtgatgacctcagctagcagttggcacatagttggttcaaccctgaaagaaataaggccagggtaccgtgtccgatggtgcaagtcaacatgctgacaatgtgttgaaatttgacccactgtaactatgacccttaatccttcattacattggattctaacatatcatctctctgctgaaaggaagatgggc

SEQ ID NO: 147139 - DNA, 601 bp, Human
agaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaattacacgcaaaactaacaactcataaaatggtattttaaaaagtaatgatcataaagttaaaatggaatgaagtggctataaatagaagaatagttccaaytcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatgagatgggatcacacattggggccagaatacagtgtgccatgtgggggcg

SEQ ID NO: 147140 - DNA, 601 bp, Human
ctttgtagaagaggtacaaatgatgaaaagttaactaagtaacaatgtaagcaagtcaacaatggaaaagccattgcaagattatatgagtagttgtcaactgagaaatccagacaagttcaggataggagactactgaggctgaggggactagcaagggggccccttgaacacttttatcagcacgccttgagtgtctgctctaggtcaagggttgctttgatacgatggctactttcggaactgtcacaagggtccctcccaggaacccatctctggtctactttcggcagtggtaatygctccagatacacaaaacagaaagcaagtgcccatcacacctgccagcaagtgttacaacaggcagaggctttctaaatactggcttagcctccatcttgagaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaa

SEQ ID NO: 147141 - DNA, 601 bp, Human
atcttccactgtggcctcttgtaaagaaaatttctaaagaagccagggacatccatggggatctgtagatcaggaagcagtactgggagtcaccctctgccacatggctgcaaggagctggagaaagcatctccgctcagggacgagctgatgcttaaatgtatgaattggaccaaggaggtgaatgagcaaagtctccacatcacaaatcaatggcactccttagatcactgaggcttaggaaacttcctgagcttgaaatgatcgtcatatggtcatgaaagagtcatagataaaaaayctggtttgtaaactgtcacttaagcccaagggcagaggaaatggtgtcctcaccatgaaagttcaagagctcataactagctcttctcccattctggtttcagtcctgctttgtcatatttaagtctgcaagattttgctcagcttctgtgtgtgaggctttgtttggtgagccagaatgaccatttaccaagtatctcctagtgcccagcactgtgctcttgtaacaccctgcaaggcaggcatgactgcccttattctgtagataaggaaactatgaagcagggaggtgaaggagttt

SEQ ID NO: 147142 - DNA, 601 bp, Human
tccagggagttgtaaaaataggttttcctcacttacaatgttaaaagagacattaaaacaactcctgttttgctcatccatcacagtttctacttgagactttcggtcatcatgtctacctgatcttatgatgatgatgatctcattatctcaccagagatgacaacaatcaaaagtggtgtgctcaagatgaaatcaacccctggcccataatgaatgggggttgcagagttaaacaaaccggctctcatttaaatggttgaagctgctgagtggcacagggtatgggctattccttccytaattattagcagcagctttgccatgcagctgtctttttttcctggtaaatcttcaggggctaagcctactgtcatttgctgcttatctgttatattttacaaagattgaaagtgtgctatttatgcacagcttgcatatgcacacaaacacgtgtgtgcccacacgcatgcctgctcacacacaatgacttagacaattaagaatatgttgcctaaggccaattgttttttcagatggaaatggattaaacttgctggtgttcatcagggtaagcttccttaccctgcacataaaacca

SEQ ID NO: 147143 - DNA, 601 bp, Human
atttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggggacacaaaagaagatgtatctgaaactgacagttctttgaacatatgcaaatgtcataaaaacaccaccctcccttgagcttaatgrccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacgcctggctatttttttatatttttggtagagatggggtttcaccatgttgcccaggctggtcttgaaatcctgagctcaagtgatccacccacctcggcctcccaaaatgctaggattacaggcctgagccaccatgcccg

SEQ ID NO: 147144 - DNA, 601 bp, Human
ggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgcygtggccccaagactttaagctctcttttgggatattggcggcgagggtggggggacacaaaagaagatgtatctgaaactgacagttctttgaacatatgcaaatgtcataaaaacaccaccctcccttgagcttaatggccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacg

SEQ ID NO: 147145 - DNA, 601 bp, Human
ggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgccygcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggg

SEQ ID NO: 147146 - DNA, 601 bp, Human
tgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattytcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaa

SEQ ID NO: 147147 - DNA, 601 bp, Human
gttaacacttcacttttggtctaacgttttggctccctacggggtggaggaagacagattgggaaaacacacgcgaagtattacactggcgtctggcaaggggtggaaactcctgtcttgatttctgactctggtgtctccgtggggttcacttgaaagagaaggcacctggatcccatatgaaagcagggcagggcagaattagcccaatagatgctggcttcttctggatcagttcaggaaaacaagttttgacttgtggagaaggatctgccttgagcactattactggggataatayttcaaccagggtcaaagtaactccctaaagcaggttatcaactcctcgagcagcagtcatggcaagtccctgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctg

SEQ ID NO: 147148 - DNA, 601 bp, Human
gaaaatgttttagaattacatagtggtgatggttgtacaacattgtggatatatcaacaaccactgaattgttcatcttagtagggtggattttatgatatgggaattatgtcttaatttaaaaaataaacctgtgcaagatagacatacataaaattcaaacattacagacatacatagaaatgaaactttccctacactcctctccaacggtgctcccagttttttcttattctctatgctgattttatttatatggtgtgtatatttaggaaacaaactaggaccttgtgcatactgytttgtgattttcacttatgtgacttgttcatttttttttactggaagagaaaaattcccaacctgacttcttaaggaatatagcaaatccagaagtcataaagaaaaagacttataccttgactacataaaactaatatttttttatatgggaaaaggtacaataaataaagaagcagactaagggaatatctaagcaacatttatgagaaagggttaatattcctaatattagggattaagattcctacatgttgatttaaagttaaacaatacaaaagaaaaataggcaaagaggtaa

SEQ ID NO: 147149 - DNA, 601 bp, Human
tgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagacttyctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctcaaatggggctgagga

SEQ ID NO: 147150 - DNA, 601 bp, Human
acaacaaagccattctgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagactttctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctc

SEQ ID NO: 147151 - DNA, 601 bp, Human
tgctcttgggtgaagaaaccaacccctcgatagtgttcagatgctgcagggttaagtctgtgttcttcaagggagtgaggatgaagacatttgatcctgagcccaggtttctctttggttacatcatttgcaggcagacacgagtcccggctgccggcatgtgtggctagtcaattcccgtgcacaaaggcaaatgtacaaaatgatcatttgacttttctgtggttgggtgcaagctctttgtcaggttccatcacagctccgagcttgtgcagtgtggcatttactgaaggttcccagyaggtgatctgattcaacttctacctggtgagctctgtcccatgacacctgtaaaattttggtccaagaaagcaaaatcgcagtagggcccatgacaccactgtcggcttggccctgctccgactgctaaagacaggcagccaggacaaacagttccttgttatgggctcgggaaaggcctttgtgcacggggctgtgtttgcacagggcttctaatgatatgaaagaatgtttgatttccctcttatacccgttggataacaaacacactcagatcctgcacggtgtctccggaacacag

SEQ ID NO: 147152 - DNA, 601 bp, Human
aggctggtttcaaactcctgacctcaagtgatccacccgccttggcctttcaaagtgctaggattacaggcgtgagccaccacatctggccaacatcagttattttcacatgttggatggaaaataaaaaataactacctctatatgaataatgactgaaggatataaaatattgacacactattacacacctgcgcgcatgcatgcgcgtgcagacacacaaacacacacacacacacgcacagatgtaaagctattatttctgttgagaaacttcttaaaaaataaacccaaacttccscaaagggtgacccttctgtctacttttccaactttcattgctgttactttacattagtcctggtcacttcaggttgctgatcacaatggatgggtcaactcaccaatttgcggatttcacattctaaattctgaatacagtccagtttccttttgcggcagcgctgggccgcgatgcggttcttgctgcgccgtcggacatcatgaataaactctaactgttctgaggttagcttgtgcattttaatcatcatctggaaatcgttccttggaagatctgtgatttgatctacaggaaaag

SEQ ID NO: 147153 - DNA, 601 bp, Human
gacaaaacactctcaggcacagggatggcgatgacagccaccttgaggcagaactgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctragtcatagcgttcatgtgaggattaaatgggatcatccataaaaacagtttagaagaatacctggaccatagatgctcataatcaacatcagttatttattcatttttttttgagacagggtttcactctatcacccaggctggaatgcagtggcgtgatctccactcactgcaaccttcacttcccctgctcaagtgattatcctgcctcagcctcccgaatagctgggactacaggcacgtgctgccatgcccggctaattttttgtatctttagtagagacagggtttctccatgtt

SEQ ID NO: 147154 - DNA, 601 bp, Human
ccataccatgtggcctccctcttcttcagcctgacacagacatggcacctgagatgagtttctgttatttggtggcagaaaggtggagctgaaggaggttgagttggttgtcttcaaagctacagtcaggagccagaggtcacctggatttactttctgtagtttatggttgcttatcaaggagaaggggcgggggcacatagctctgagtatgggggagcctgggagacgggagtttgttttctgtgacaaaacactctcaggcacagggatggcgatgacagccaccttgaggcagaaytgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctgagtcatagcgttcatgtgaggattaaatgggatcatccataaaaacagtttag

SEQ ID NO: 147155 - DNA, 601 bp, Human
ataagcactaagccagaggtcagatcaggcttccacaggcaggtgcccagcctaactggggactcaggaaaggggcttcctagagaggtgatgcataacctgactcattcattcatttagagatggggtcttgctatattgcccaggctagtctcaaacttgtggcctcaagtgatcctcctgcctcagcctcccaaagtactgcgattacaggtgtgagccatggtgcccagccatgacctgactcttaaagaacaaaggagatagaaaaagtggaggaatgtccaaggcagagaggaartggcataggcacaagtgcagagtttgattttatcagggatcaagtcctaggaagggagtggatggtgacactggagaggtagctacagactggaacacaaatggcaggagatatcctactaagaagcttggactttctttgttggtgatgggagctgctaaacacagacattttccctggtggtgagtgtcaaagaaacccacaaaacaacaacaacaacaataacaaaaaaccctgacgtccagggctatcttgataacatataacatcctgtgcttttctaacatttcatccttgtgc

SEQ ID NO: 147156 - DNA, 601 bp, Human
ccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgtgtgggagacggcgtgggagtggggagtgagtgcagggcctgctggggaccgggcagggcagggagggacttggggagaggtggaagctgctccgcccaccagygccatccctgtcaggacatagcatcctcaccacagggtggcagataagaaacaaaacacatctgggatgtctccttagggaaaaaacttatatgggtggctgtgcaacctggagctctccccttttagtacagaaatctgcaatgtgaggggcaatactgcttgggcgctgggagaggaaccccaggatcattctgccacattaccccggccaaagcacggacccctccaggcctactcatctgttaaatgttccaggccactttctagggggaagaaaatgaggtgccgcgtgtgacag

SEQ ID NO: 147157 - DNA, 601 bp, Human
tactaaaaatacaaaaaattagctgggtgtgttggtgcgtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcrcaggcaggagaagaggacgggagagaaaatgaagaggagaaagggaggagcaggcatgcgacacgcacaaggaacaggtctccgacacgggagctgcatgtgccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgt

SEQ ID NO: 147158 - DNA, 601 bp, Human
tagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcrtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcgcaggcaggagaagaggacgggagagaaaatgaagagga

SEQ ID NO: 147159 - DNA, 601 bp, Human
gagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtacyagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcg

SEQ ID NO: 147160 - DNA, 601 bp, Human
agtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtgttactgaaattc

SEQ ID NO: 147161 - DNA, 601 bp, Human
cctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccrcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtg

SEQ ID NO: 147162 - DNA, 601 bp, Human
acttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacagga

SEQ ID NO: 147163 - DNA, 601 bp, Human
cccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcaytgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcct

SEQ ID NO: 147164 - DNA, 601 bp, Human
cacaccttccatctgatgccaacaccttccccaggacatctcttcatccctctccaaggcccgggcaaacaaccggcaaaatcgtcacgaatcagaaaacttcagagtccatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgytaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtg

SEQ ID NO: 147165 - DNA, 601 bp, Human
tctcacacacctggacagtagagaaaaaaagagaagggttgatcaagcctgaactggaggacagaaggcctcgtttcaggttttccagcctttgttttgcatcctccattataatgtaactcaagaatgactaggtcaggctctagaaacttaaagatacatattcagggggcccagacacaggcttctgccacaccttccatctgatgccaacaccttccccaggacatctcttcatccctctccaaggcccgggcaaacaaccggcaaaatcgtcacgaatcagaaaacttcagagtcmatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaa

SEQ ID NO: 147166 - DNA, 601 bp, Human
tcctagtaagtaagctaagtattgtgggtaaaaacacttatttacagctaataagatgatctcactgacatgtttttattgctaaagtcttttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctycttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatg

SEQ ID NO: 147167 - DNA, 601 bp, Human
tttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctaycagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacactt

SEQ ID NO: 147168 - DNA, 601 bp, Human
aatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgaytgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacacttactggtcaatgaatactaagttgaggatccagttagatagaagcgaaaaagttctgctagttg

SEQ ID NO: 147169 - DNA, 601 bp, Human
tgaatactaagttgaggatccagttagatagaagcgaaaaagttctgctagttggagtttaagttgatcttctggggtaagagatcttactcttctattagtaccagagagcaagcttaaacttcagttcatgtacagaaatgcaaagctactagaattggaaataggtttctgatggtctgtctggttttgctcgttatgggaaatcagtgtttctatagtgttagtaccctactctttaactgggaagtcctaacttatttattatatttttattttttagagacaaggtctcaaactyctgagctcaagtgatcctcctgcctcagcctccctagtagctgggattataggtgcaagccactgaccctggctcaagaaatcataacttctaaggtctttaaagctagttagtgaaaagtccagataggcttactaaattactatacagaaagctagcagatgctttgaggaaatccgtttcctagtccgattcatttaccagtctctatcctcctcctcaaattgccagtctgtcctcaaagtaaactgtttagctggcaaggacaagctagtgtcacatcttcctcttgtaaaatca

SEQ ID NO: 147170 - DNA, 601 bp, Human
aaggatgttttaggttgtctaaatgtcacactaaattattaaactggttagaatatacatgcacttaacccaaatatcttaagcttgaatgaattaggtccctgcacgttagctctatagaagatggttattctctttaaaggtacatctttaatagtgaaatcaatattgtatgtcctatagtaaggtcaattcagggaagacaggtctggaatactgatatattaaaaaacttggtagaggataaaatgttgatgtcaatccagatactctttggttgctttttttgagaaagggtctygctgtgtcattcaggctggagtgcagtggtgcaatcatggcttactgtagccttgaagtccttgctcaagcaatcctcccacctaagtcttctgagtagccaggactagaagcgcacaccaccatgcccagctaatttttaaatttttagtagagattttgcccaggctggtcttgaactcctgagctcaagtcatccgctgcctcagcttcccaaagtgctgagattgcaggcctgagctgtgtctggcccaaactcattgagttggtgatttctaaattttaggagtgatgtttcatt

SEQ ID NO: 147171 - DNA, 601 bp, Human
attgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcstttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaa

SEQ ID NO: 147172 - DNA, 601 bp, Human
ttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgccc

SEQ ID NO: 147173 - DNA, 601 bp, Human
tgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccrtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatcttgtgttctttcttcctttctttta

SEQ ID NO: 147174 - DNA, 601 bp, Human
ctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctcctyggcctcccaaagtgctgggattacaggcgtgagccactgcgcccggccaaatctgttaaattctgtttccatgtaacagaaatatataggattacacaactgcatcttgtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattaca

SEQ ID NO: 147175 - DNA, 601 bp, Human
cgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctkgtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgt

SEQ ID NO: 147176 - DNA, 601 bp, Human
tttccatgtaacagaaatatataggattacacaactgcatcttgtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctrttctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgc

SEQ ID NO: 147177 - DNA, 601 bp, Human
ttccatgtaacagaaatatataggattacacaactgcatcttgtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctaytctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgca

SEQ ID NO: 147178 - DNA, 601 bp, Human
agctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacaytcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcat

SEQ ID NO: 147179 - DNA, 601 bp, Human
tatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatayagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggg

SEQ ID NO: 147180 - DNA, 601 bp, Human
acaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcrtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcaca

SEQ ID NO: 147181 - DNA, 601 bp, Human
ttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttyttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgt

SEQ ID NO: 147182 - DNA, 601 bp, Human
aattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccattwacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattattt

SEQ ID NO: 147183 - DNA, 601 bp, Human
ttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaawgacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagc

SEQ ID NO: 147184 - DNA, 601 bp, Human
ataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttrtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagaga

SEQ ID NO: 147185 - DNA, 601 bp, Human
atcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccraagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatga

SEQ ID NO: 147186 - DNA, 601 bp, Human
ctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcatyggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaa

SEQ ID NO: 147187 - DNA, 601 bp, Human
ggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttcttttyttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctccc

SEQ ID NO: 147188 - DNA, 601 bp, Human
tagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttycccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccatttt

SEQ ID NO: 147189 - DNA, 601 bp, Human; identical to SEQ ID NO: 34539

SEQ ID NO: 147190 - DNA, 601 bp, Human; identical to SEQ ID NO: 34540

SEQ ID NO: 147191 - DNA, 601 bp, Human; identical to SEQ ID NO: 34541

SEQ ID NO: 147192 - DNA, 601 bp, Human; identical to SEQ ID NO: 34542

SEQ ID NO: 147193 - DNA, 601 bp, Human; identical to SEQ ID NO: 34543

SEQ ID NO: 147194 - DNA, 601 bp, Human; identical to SEQ ID NO: 34544

SEQ ID NO: 147195 - DNA, 601 bp, Human; identical to SEQ ID NO: 34545

SEQ ID NO: 147196 - DNA, 601 bp, Human; identical to SEQ ID NO: 34546

SEQ ID NO: 147197 - DNA, 601 bp, Human; identical to SEQ ID NO: 34547

SEQ ID NO: 147198 - DNA, 601 bp, Human; identical to SEQ ID NO: 34548

SEQ ID NO: 147199 - DNA, 601 bp, Human; identical to SEQ ID NO: 34549

SEQ ID NO: 147200 - DNA, 601 bp, Human; identical to SEQ ID NO: 34550

SEQ ID NO: 147201 - DNA, 601 bp, Human; identical to SEQ ID NO: 34551

SEQ ID NO: 147202 - DNA, 601 bp, Human; identical to SEQ ID NO: 34552

SEQ ID NO: 147203 - DNA, 601 bp, Human; identical to SEQ ID NO: 24080

SEQ ID NO: 147204 - DNA, 601 bp, Human; identical to SEQ ID NO: 24081

SEQ ID NO: 147205 - DNA, 601 bp, Human; identical to SEQ ID NO: 24082

SEQ ID NO: 147206 - DNA, 601 bp, Human; identical to SEQ ID NO: 24083

SEQ ID NO: 147207 - DNA, 601 bp, Human; identical to SEQ ID NO: 24084

SEQ ID NO: 147208 - DNA, 601 bp, Human; identical to SEQ ID NO: 24085

SEQ ID NO: 147209 - DNA, 601 bp, Human; identical to SEQ ID NO: 24086

SEQ ID NO: 147210 - DNA, 601 bp, Human; identical to SEQ ID NO: 24087

SEQ ID NO: 147211 - DNA, 601 bp, Human; identical to SEQ ID NO: 24088

SEQ ID NO: 147212 - DNA, 601 bp, Human; identical to SEQ ID NO: 24089

SEQ ID NO: 147213 - DNA, 601 bp, Human; identical to SEQ ID NO: 24090

SEQ ID NO: 147214 - DNA, 601 bp, Human; identical to SEQ ID NO: 24091

SEQ ID NO: 147215 - DNA, 601 bp, Human; identical to SEQ ID NO: 24092

SEQ ID NO: 147216 - DNA, 601 bp, Human; identical to SEQ ID NO: 24093

SEQ ID NO: 147217 - DNA, 601 bp, Human; identical to SEQ ID NO: 24094

SEQ ID NO: 147218 - DNA, 601 bp, Human; identical to SEQ ID NO: 24095

SEQ ID NO: 147219 - DNA, 601 bp, Human; identical to SEQ ID NO: 24096

SEQ ID NO: 147220 - DNA, 601 bp, Human; identical to SEQ ID NO: 24097

SEQ ID NO: 147221 - DNA, 601 bp, Human; identical to SEQ ID NO: 24098

SEQ ID NO: 147222 - DNA, 601 bp, Human; identical to SEQ ID NO: 24099

SEQ ID NO: 147223 - DNA, 601 bp, Human; identical to SEQ ID NO: 24100

SEQ ID NO: 147224 - DNA, 601 bp, Human; identical to SEQ ID NO: 24101

SEQ ID NO: 147225 - DNA, 601 bp, Human; identical to SEQ ID NO: 24102

SEQ ID NO: 147226 - DNA, 601 bp, Human; identical to SEQ ID NO: 24103

SEQ ID NO: 147227 - DNA, 601 bp, Human; identical to SEQ ID NO: 24104

SEQ ID NO: 147228 - DNA, 601 bp, Human; identical to SEQ ID NO: 24105

SEQ ID NO: 147229 - DNA, 601 bp, Human; identical to SEQ ID NO: 24106

SEQ ID NO: 147230 - DNA, 601 bp, Human; identical to SEQ ID NO: 24107

SEQ ID NO: 147231 - DNA, 601 bp, Human; identical to SEQ ID NO: 24108

SEQ ID NO: 147232 - DNA, 601 bp, Human; identical to SEQ ID NO: 24109

SEQ ID NO: 147233 - DNA, 601 bp, Human
ctttaagtaaaagtcaaatctaaatcaaaatatgtttgcttctgactcctaaaattttctctattatgaaaaactttatctataacttaagtttctttcactctggctcctcaatacattacacaatatatttcctcctagaactcatgtactttcaaacttcatgttcgttaagcaaatcagcaaactgtatatcactgtggttgtatatctagaaaaagcccaacctggtatggtaactcagaccaaatgattctgcagaggattgggaggccatatctacttgccatggccaattaargacaactgctttgggcatgaaggagtgacatcaagtgtcagagtattttctatccccaaaatcctgagccctacaaatcatactctttaattatctctcaactaatctcttgtcctagaatcttgaaccttcctatgccacaagactgtttcctaacaacataaacaaaattctacttgatggatctacccactaaatattctagttttcctccttccttccttaaactccaagggagtttttgactgctatgactactacttctacttcttcattaatcatcctccctttccccttctt

SEQ ID NO: 147234 - DNA, 601 bp, Human
acaagcatttgtcagagtcatatcataactgcaaagataaagattacattgtttaaaaatgcacgtgcttttgcagaaatgcagttttaaagctacagtacatacttaaatttcaaagtcccttttaaataaggaaaacaaactccaaagtgaggaaaataggaaatattttacctaacttacatactactggcatcatccaagaactcacaaacccaaatggataccacattaatgaaacacccatctatcttttagaaagaatgccaaagcacctcagcaaaagactgtcatgtgctcragtagtatatgctaaagtagttggaatcagttgagcatatttagtacatggcaggaacagttctaggcactcaagacaacaagatgaacaacatcaagtccttgctgtcatggattttacttggttgttccaaacatctaatcatctaacaaacctgcaagcacctgctacataattggcaccgttctagatgctagacccttgagagagcccgataccattgcctgatgatttcattcctttttagaagaaaatgaaattaacacatggtaattgttaagcaaattataccaatatttg

SEQ ID NO: 147235 - DNA, 601 bp, Human
tgtatttggatagaggtagagcatgcatgagtgagattatgggtataagtataaccaaacgcatcatacccataatttctccaacatgtttatagtattacccccaattaatgtgttctggatctagagtatgcatgagagccatgtgcctagatatgcaagagtaataggactgtgatcatgcctgtgactaatcaagagacaagtgatcaaaaattggtccaaaggcagtttattcagggaaattataaactactgttatgtgccatgtgacgtttcagacaatgacagacatcatatmcaacagtggtctcataagattataatggacctgaaaaactcctatagcctagtgatgccagtgatgccacacccgctgtaacatagtagcacaatgcatttccttttctatgtttagatacacttagatacacaaacaccattgtgttacaactacctacagtattcagtaccataatacactgtacaggtttgtagcctataagtaacaggttgtaccatgtaggctaggtgtgtagtaagctatactacctagttttgatatactctgatgtttgcacaatgatgaaatggcctaata

SEQ ID NO: 147236 - DNA, 601 bp, Human
atctattgtcatgatgaaacagttcttaatcttgattgcagtggttatacgaatcaacacaggtgaggacatgacacagaactatatttagactttattccagtatctatttcctgggttctatagttacataagatggaaccaatggtggggggattgggagaagggtacaagtatgggtcctttctatataatctttgtaacttcctttatatttgtaattactgaaaataattttttaagatatcatcttggttgctgtttgaaaaacaggcaatagggaatcaacagcaaaaggagragattactacagtaccctaagtaacaaatgttggtggcttagactagggtggctgtactgaagatggagggaagcaggcagatttaggacatattacaaaggcagaagcaacaggccagcagacacgactgctaaattagtttcacacacactcctaccacccagcttttagtcagcatttatagtaaaaacatctattcaaatattttttttttctttttttccaggcagggtcttgctctgttgcacaggctgaagtgcagtggtgcagtcacagctcactgcagcctcaaccacctg

SEQ ID NO: 147237 - DNA, 601 bp, Human
agtgcataaaacctaacagggaaaagacacacacacgaagtcaggtaatgacaggcgatatgcaaaagactaaaatagagggatgtggaaatgagtagctagttattttacactgtatattgaggaaagttctctctgctgagatatttttaacagaaatttaaatgcaagaaagagccagtcagggaagatggttaagttgtggataacaggatattccagatagagaaaaaagctaatgaaaagccgacatatggcagagttcgacttgttagaacagtggtcctcaaactttaacatscttcagaatcatcaaggatctgtaaaacatgagattgctcggtctcacccacagacttcctggttcagtaggtctggtgtggaatctaaaaatatgtgtttctaacaaattcccaggtcctgctgacattgctggtccagggatcacactttgagaaccactgtgttagaggactagaaagaaggcaagtgtagctatagtacctaaccgtgcgggcaacagtggtaccaggtgagaccacagaggtaaggagggaacaagtcattcaacactttatacttcaccataaaagtttgaatt

SEQ ID NO: 147238 - DNA, 601 bp, Human
tctacgaatactggttgcctaaaagggtataagaaggatggggcataagggcccaaaggctcacccaaggtccaagctatctaatctgggtcaaagacagactggaggtaggggcaaatgcctacctagtaatacagaacatgtgtctaaagtttcctgtgatctgtacattccctggcagtacctaactgataaagaatttggggatcttaagtgaagcaaaataatcaatgatttaataatgaatgaagaggggctatctgatataaatgcataaataattacaaacaatgtgggatawtacaggctacagcatacaataagatttttctcagccaagcatgatggcatgcacctgtagtcccagctactcaggaggctagagtgggaggatcacttgtgcccaggagtttgcggctgcagtgagctaagataatgccactgcattccagcctgggtggcaaagtaataccctgtctcaagaaagagaaaagaaaaatgaagatttttttctctttctaggttatttcacatgtgaaatatcacaacattcaaatattaaaaacaaattatgcaaatcttttgcctacagacaacattt

SEQ ID NO: 147239 - DNA, 601 bp, Human
catcagtccaagatccaggatcacatgagaaggattcagaaagcaaaacaaaaagttgtaacagagattagtacatttagcctcattgctttgcttaactatacacagtattaaaattaaaatagtttctctgaaaaaatacttaagaaaatacttgaatattttaagttggtctaataaccatctatttcttatataatcaaaagtggctaagaaccacaaaactactaatatacccaaccaaattttcatccatttgtttattttagtgtatctcaagattgtttccataccactcctycatttattgactacctgtgtgccttattttaagcatgcttggctgggtgcatggctcacacctgtaatcccagcactttgggaggccgaggcaggcggatcacctgaggtcaggagtttgagaccagtctgatcaatatggtgaaactccatctctactaaaaacacaaaaactagctgggcatggtggcatgcgcctgtagtcccagctactcaagaggctgagacaggagaactgcttgaacccgggttgcagaggttgcagtgagccaagatcacgccactgcactccatcctaagc

SEQ ID NO: 147240 - DNA, 601 bp, Human
gacaagtaatcaaattacctaatctgcttccatttctgggcattgccatgaaggagccaaggctccctccaataacactgtgtggtctccgcaatgggggcttcttgaaagatcctgtgtactggtggaggaaggaatgcatactgtgagacgttggaggcctgccattcttcacaataggctctgtggttcatagaattcgaaaatcattccatcatcagtccaagatccaggatcacatgagaaggattcagaaagcaaaacaaaaagttgtaacagagattagtacatttagcctcaytgctttgcttaactatacacagtattaaaattaaaatagtttctctgaaaaaatacttaagaaaatacttgaatattttaagttggtctaataaccatctatttcttatataatcaaaagtggctaagaaccacaaaactactaatatacccaaccaaattttcatccatttgtttattttagtgtatctcaagattgtttccataccactcctccatttattgactacctgtgtgccttattttaagcatgcttggctgggtgcatggctcacacctgtaatcccagcactttgggagg

SEQ ID NO: 147241 - DNA, 601 bp, Human
atgcacaggtagttccagctactcaggaggctgaggtgggaggatcatttgagcctgggaggtcagggctgcagtgagcttcaatagcaccactgcattcccctccagcctgggtgacagagtgagacactgtctcaaaaaaaataaaaataaaaataaaaacataaggcatcatcaaaaaaggccagaggaataaacagaaacttgcaattcttttttcttggatatttaaagacataatgacagaagaagaaacaattcaggtgataaccacatatactattcattacaataggctttatatggtgatgatctgaaaagttactgaggcattaccctaaaataaacaccatcccaaactgccattcatcttgaaatactgcatccatttattatgggtttcatttccctcctgatggacaggtttttcaaatattacttccctgtattgtcagcactactacctctctagaactttccatccttctgctattcctcttgatctcaacttgatttttatctgacagaagaaacgagataataaaagttgcttaattaaaacttaactatgtgcatgacgtataatcagaaaggtaaacac

SEQ ID NO: 147242 - DNA, 601 bp, Human
ggcgtagcggcatgcacaggtagttccagctactcaggaggctgaggtgggaggatcatttgagcctgggaggtcagggctgcagtgagcttcaatagcaccactgcattcccctccagcctgggtgacagagtgagacactgtctcaaaaaaaataaaaataaaaataaaaacataaggcatcatcaaaaaaggccagaggaataaacagaaacttgcaattcttttttcttggatatttaaagacataatgacagaagaagaaacaattcaggtgataaccacatatactattcattayaataggctttatatggtgatgatctgaaaagttactgaggcattaccctaaaataaacaccatcccaaactgccattcatcttgaaatactgcatccatttattatgggtttcatttccctcctgatggacaggtttttcaaatattacttccctgtattgtcagcactactacctctctagaactttccatccttctgctattcctcttgatctcaacttgatttttatctgacagaagaaacgagataataaaagttgcttaattaaaacttaactatgtgcatgacgtataatcaga

SEQ ID NO: 147243 - DNA, 601 bp, Human
gggggaagagggatatctctctgctgatcaggtaatgtaacagcggcagatacaacatacttttctcctccagcacaataccctttaaatttaatctgcgttactaacattttcaatacactgtcttagttctagaacaagggtctagaacaagtgtggcttctttttatatggcccatgagctaaaaatgttttttgtatttttaaaggattattaaacagagaagaatatgcaatggagactgtatgcccataaaacctaaaatatttattactaactgcccccttacaaaaaaaaaamaaacaaaccctggtctagacaaacaagaaaacaataagccagggcctgatctgtagtgttttctgacttctctctccatggacaacttcaggctaccaacatgacaacactgaacatatggttgggaagaaatgtgcagtagcataccattatatagtgtttttgactataactagaacagaaaaaaataacgccggtggcatagataatagttaaaagtggtaaaaaattaggaagcaatgacttttgcatattcattacctttgtttttaatttagtttacctatttgtaaacttata

SEQ ID NO: 147244 - DNA, 601 bp, Human
aaaaatctgtcctgttgcacaaggaattggacgacaaagaaagcttactaatctcagactatgaataaatacttgagtaccatctgacccaaacaagaaattactcacgtcattaacaaacaagtgtagttctgacatgactaccagtcggtattttcatttccatcaagacaaacgtgaaacaatgatggcttgtcagaactttactcatctgtcaaggggggaagagggatatctctctgctgatcaggtaatgtaacagcggcagatacaacatacttttctcctccagcacaatacyctttaaatttaatctgcgttactaacattttcaatacactgtcttagttctagaacaagggtctagaacaagtgtggcttctttttatatggcccatgagctaaaaatgttttttgtatttttaaaggattattaaacagagaagaatatgcaatggagactgtatgcccataaaacctaaaatatttattactaactgcccccttacaaaaaaaaaaaaaacaaaccctggtctagacaaacaagaaaacaataagccagggcctgatctgtagtgttttctgacttctctctccatgg

SEQ ID NO: 147245 - DNA, 601 bp, Human
accccatcgtctcagcccaaaatctccttaagctgataagcaacttcagcaaagtctcaggatacaaaatcaatgtacaaaaatcttatacattgtacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgrgtaggaagaatcaatatcgtgaaaatggccatactgcccaaggtaatttacagattcaatgccatccccatcaagctaccaatgactttcttcacagaattgggaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccttcagaa

SEQ ID NO: 147246 - DNA, 601 bp, Human
catatactgttttgtttttgagacaaggtcttgctctgttggccaagctggagtgcagtgacacaaccatggctcactgcagcctctacttcccaggctcaagcaatcctcctgcctcccaagtagctgggagtacaggcacccatcacatctggtgttttgttttgttttattttattttattttttttgtagagacaaggttttgccttgttgttcaggctcatcttgaacttgtagccatttatgcctagtgttccattattggaagctaagcatgtgggagctacttatatcctackgctcaaggtcatcaccaaggtctgattgcaaaaattcaaaaaactgcaacttcaggaatccacccaccttggcctctcaaagtgatgggattacaggcatgagccaccacatctggccaagttgtatactcatatacctgcatttgtcagtcattatctaataacccagcaagaagagtgtactaggaaacaaatgctggatctctagaactcctctcttgccactattactttctatacacgtattcattttccagaaagaagcatgttgtttcatgctgcagtgctttaacacacttt

SEQ ID NO: 147247 - DNA, 601 bp, Human
aacacctcttaaaagcttctaatgcagtttctcctccctgcacccccaatgttaaaaataaaacaataaaaaattattcactgaatatctattttgtaccagaactacaaaaacaagtttatgatcttcaaatactcaaaaatctgttcagagcaaaaacatactacaaaaaaggtgggttatggcatgcttaatagagataaaagttaaatggaagtagggggaggaagataaattccatttgaaaatattaaaaacagacatatactgttttgtttttgagacaaggtcttgctctgtyggccaagctggagtgcagtgacacaaccatggctcactgcagcctctacttcccaggctcaagcaatcctcctgcctcccaagtagctgggagtacaggcacccatcacatctggtgttttgttttgttttattttattttattttttttgtagagacaaggttttgccttgttgttcaggctcatcttgaacttgtagccatttatgcctagtgttccattattggaagctaagcatgtgggagctacttatatcctactgctcaaggtcatcaccaaggtctgattgcaaaaattcaa

SEQ ID NO: 147248 - DNA, 601 bp, Human
ccttaatcatcatctcaacagcaccaaaaaagcaacaatactttcatttcaaaacatgttcaatttttttttgcagaaacctattttagtttacagtacgtactgaaataacagtcacgatcaacttatgtcctcaaggttataccacaacacttacaaagaaaagaaaatgaattcttcatccttttacacggagaaataaatgtgcttcagagatcagtaggtacagtgaaccacaaaggaaaggacacccacttttataatataatgcaagaaaaaaaagctgtttatttatacctcytaaaatttgaaacagagaaaataaaatgctaattatccagatgaatctcaaaaatatcattaaaatcgtattttctaaaaagaagacattgctaatgtatcattctgtatttccagaatttttgaaaattcacttctccttaatggataacctaaaataacgtttcgcaaaaaattaaaataaaatgtttcacagaatgcgaacaactatattacatatctacattgggataaaaattaaaaaagaggaaatattcacagactgcaatttatgaatgcaaagaagtaactttcttacaag

SEQ ID NO: 147249 - DNA, 601 bp, Human
agtagacattatatgatcttgtatgcaacatggggaaagagaattgtatttattactgccatgttaatggcatttctactttatttaattatacaatgtgagctgggataaacttgaaaagaatcttgcctatatcattgtatcaagaaatttaagccctataaaaagaaattcctcccattcataacagcagccaaaccatgaaacggaatggagaggtataggaactgcataaatatttactgagaaatataagacttaagtataaaaacatacaatgccaccaaatggtaagaataartaaggagaagatactggtcctccctatattaattttataagttatataaccactaagaaatcacaataagcttattcttagaacaaaataaaatgcctaaaatgtatcaatagaataaacagaaaaaatccaaaaacattctaaaataagaaagagtatatgtgtatatgggggagggatacagaaaggagtctttccagatattaaaatatactacaggtcaggcgcagtggctcaagcctgtaatcctagcactttgggaagccaatatggtgaaaccctgtctctacaaaaaataca

SEQ ID NO: 147250 - DNA, 601 bp, Human
gaatggaaaataataaaaatcgagaaggcaatataataaaatttagctattctaaagtcaagtataaaaattaatttaaaatgtttacacccagaagcagcaaacaagcagatctgattgatggtggaggtataggagaccaaaaacttactaaggaagctctacgagaccttcgactcattggttggtcaaatggtggactgtttatctgcaacttttcaagatatccatcaggtattctgatgtctgcaggcagtgataaccgcttatttaaatccttaaaaaaaaaaaaaggtaatcmaaaatagtaaaggcaaggcatttggcttttgtattcacaggctctaacatattatttcttagtgataagtaattgtaaagttttattgcagttgcaaagttacctacattgattatatgtaatatactcatggcaaaaacatttactgtaagcaaaagtatacagcgaagtgttacagaaatgaaattttgcaacctcagtaatttttgagtcctttcactggtaaattcaacttgaaatttactttaaatttattataccatatagtaacattaggcaaacactaccacaaactctgtg

SEQ ID NO: 147251 - DNA, 601 bp, Human
attaacatttcaaaagttcgttgagctgtacaattatggtttgtgtacttctctgtatatctagtatatattaatacatgtttatttatccagcacatatctagtgtatctatatatctagtatgtatttatctacctagcatgtattaataacatttaccaaaaataaaatataccttaaatcctattccaatatgcatcctattgaatgcatcttaaggactccaataaacctttaagaatggaaaataataaaaatcgagaaggcaatataataaaatttagctattctaaagtcaartataaaaattaatttaaaatgtttacacccagaagcagcaaacaagcagatctgattgatggtggaggtataggagaccaaaaacttactaaggaagctctacgagaccttcgactcattggttggtcaaatggtggactgtttatctgcaacttttcaagatatccatcaggtattctgatgtctgcaggcagtgataaccgcttatttaaatccttaaaaaaaaaaaaaggtaatccaaaatagtaaaggcaaggcatttggcttttgtattcacaggctctaacatattatttctta

SEQ ID NO: 147252 - DNA, 601 bp, Human
gtgattttattttttagagtatgtcaccaaaatattttgtagactatctaactagaatatctaatctggcccacaggggccagatgctatgggcggctcacacctataatcctagcacttcgggaaaccaatgcagaaggaccgcttgagcccaggcatttgaaaccagcatgggcaacacagtgagatgccatctctaaaaaaaaaaaaaaaaaaaaaaagttttttaattagctgggtgtgatggtgtacacctgcagtcttagctactcaggagcctgacatgtgaggattgcttggrcccaggagttcaagattacagtgagctatgatcgtgctactgcattccagcctaggtgacagagtgagaccttgtctctaaagaaaatagttccattatataataatatgtaaaggctggatgcagtggctcacccctgtaatcccagcacgttgggaggccgaggcgggtggatcacctgaggtcaggcattcaagaccagcctggccaacatggtgaaatcacatctctactaaaaatacaaaaattagcaggacatggtggcgcatacctataatcccagctactcgggaggctgag

SEQ ID NO: 147253 - DNA, 601 bp, Human
catagatgacattttaagagtgagtatatattaatacataagaaacggggccgggcacggtggctcatgcctgtaatcccagcactttcggaggccgagaagggcggatcatgaggtcaggagatcaagaccatcctggccaacatagtgaaaccctgtctctactaaaaatacaaaaattagctgggtgtggtggtgcatacctataatcccagctactcgggaggctgaggcagaagaatcgcttgaacccaggaggcggagattgcagtgagccaagatcgtgccactgcactccagyctggcgacagagcaagactctgtctcaaaaaacaacaacaaaaaagaaacagcaggggaagagggaggctttttcaaacattcatttccctctctgtgggaattaccgagttactgttaacgaaagaaatgtgttttatcccttagacttggtgggcagggggaaagactgagaatctctattctactcagtcactttgtcttacaaaaattgctattatcatcaccacaataccaccttaatcctgtactcctgtacataatatgctaaaggtaaattctgtgggactttgaacctcac

SEQ ID NO: 147254 - DNA, 601 bp, Human
atgtaatataagagcccccttaatgctgctttccagacaaatgaagataattttttctgatatttcactgttccaagaaaatacttcactttttgacagccccaagcaaattcctattcagatggctcttagagtataaacacatgaaaattctaaatatatatataaattaaattataatttataatagtcttcctagaattcactgtaacttgtaagcaataccaagccttatgggaaactttttgtttactttggatctagcaacataattactctatcacaggctggagatgctgtkctagctgagcttcaaaacaaatgaagcaccagaggtcccccttatccacaggggatacttctaagaacaccagtggatgcctgaaacagcagacagcactgaaacctgtatgtactaggtttttccctatacatattaaatacactcctaagataaagtttaatttataaattttgcagagtaagagatcaactaataaaacaaataaccataataatacactgtaataaaagttacgtgaatgcagtctctatctcttgctctcaaaataatcatactggcattgtattcacctatcct

SEQ ID NO: 147255 - DNA, 601 bp, Human
ttgcttgcatttttatttgctgaacacaacaagattaacaatagatataatgactagcttgttgacgtgctctcctacagaaattattcagaggacagaggacaaagctcatttattcaacatttacccagcacaatgttaggtgctagagaagacagacatgattcccactttcatgagttcacaatctagcctgagttccatcctagattattttagaatattttaaaagtttcacagaaacagaaataatagctaaagaaatagcacaataagctttataatgtgtatgttgttgttycagtctctgcagaaactcaaaaattgccaatgccaactataatcacaagttgtcatggtgggggtatttgggaaaaattttcaattagcaataactgtgccttggataaacctcgggtatgatactatcactgctcaaagcttatattttcatgtaatataagagcccccttaatgctgctttccagacaaatgaagataattttttctgatatttcactgttccaagaaaatacttcactttttgacagccccaagcaaattcctattcagatggctcttagagtataaacacatgaaa

SEQ ID NO: 147256 - DNA, 601 bp, Human
tgtatcatattaaaagccatgtggaaaactgcacgtccaatagtacttaattcaattttagtaaactaattaaaactttggtcacaggtattattgaatgaatgaaaaattatttttgcattctatgacattttcctatgacgtttttcataaaacattaaattttaaaaatgaagttttacgaccatcatacactattcatccatgtattgtcttgaacatgactcagtattaagtccttcgctttctagtatcaataactatgcaaaataaagaagtaaaactacaatagataacattkttaaaatacaagtgaagtttttaaaatcagtatgaaaaacatggcaaatagcccactatctggtacatgacagtctgattacgaataatcttttaatttatatatgttttatatagcctatttatatatgatcttaaatactttactccataaaaaaggctacttgccaagatcacagaaactaataaaatatctttattctgatacttatctctggaatttaggtgcttaaattcatgaatatggaactaccgcatttttgccatgaattttaagttttgtgtcatcttttatggggga

SEQ ID NO: 147257 - DNA, 601 bp, Human
ataaacagggtacatgaaatatacctaaatatgtaatacaaacacaatatttaaaatgaaaaagaaaaaaccttaacacaaaatttaggaaaatttgtttttagatagattgaaaactagggactgagagagcagaaatattttaaaaagtaaaacagaatgggaaaagaattttcttaaagttgctttctagtacccctttatagataatggaaaaggtaatgataatctaaagaaagatccacttgcttagaatggtgctaatgcccttaaataaaaagccagttaaaggaaataatgytttttaatacataatctcagttctcaaaggtgtataaattatgccagatgattaaacgttgtgatttagtcaaactctagaggtctaaatacgcaattttccttggaactgtggaataaaattaaaataatccttggtaattagacttgcatcacttaccatttcagacaataggataaattatccaaagctgaatggccaaaagtagcagaggcccctcaaaataactgtttttatctttttgttacaatgatatgtatcatattaaaagccatgtggaaaactgcacgtccaatagta

SEQ ID NO: 147258 - DNA, 601 bp, Human
tactatttgtttcaggctttccaatcaaaatacaatgaaaaagacaactgaaaatcatgctcttctatggatcaggaagtggcaaacatagaagcagcaatgtaagtctaattctggctacaccccccctcaacactcggccaaaaaaaaaaaaaaaaaaaacaaacaaacccacaacaacaagagaaaatgctttaaaagtgagttcttaaaagccttgcttttaaaacttgagctcgcctgactattgtgtatggagatgataaacagggtacatgaaatatacctaaatatgtaatayaaacacaatatttaaaatgaaaaagaaaaaaccttaacacaaaatttaggaaaatttgtttttagatagattgaaaactagggactgagagagcagaaatattttaaaaagtaaaacagaatgggaaaagaattttcttaaagttgctttctagtacccctttatagataatggaaaaggtaatgataatctaaagaaagatccacttgcttagaatggtgctaatgcccttaaataaaaagccagttaaaggaaataatgttttttaatacataatctcagttctcaaaggtgtataaa

SEQ ID NO: 147259 - DNA, 601 bp, Human
gacctcaagtgatctgcctgccttggccttccaaagtgctgggattacaggcgtaagccaccgcgcccagccttgtatatattcttaaagtttcaattcatctcttcctcaacttctgaaactttcccactctaaagaatgactaagaatagaaaaatctgattataatcaaatggttgaatatctatcaagttttaaaataaacccaatgttggaacattcaaaggttcaaaaatatcaaagttcacaatcaaaattgtcaacccaacctttatatatacacagttaacattctgtcatgaaaaatatttggttttattctaagataccacaggcattttaagatactaaagaatcttatcaaggataactacttgggattttctttttaacaaaattgcaaaataaataattttcctatgtattttctccctcaccaatctgaattcccaaggaagtcctgcaaacaacaaaatactatttgtttcaggctttccaatcaaaatacaatgaaaaagacaactgaaaatcatgctcttctatggatcaggaagtggcaaacatagaagcagcaatgtaagtctaattctggctacacccc

SEQ ID NO: 147260 - DNA, 601 bp, Human
acaatgaaaaatttagtatttactttttttttttttttttgagacagcatcgtctcactctgttgcccaggctggagtgcagcggcacaatcttggcttactgcaacctccacctcgcgggttcaagtgattctcctgcctcagcctccggagcagctgggattacaggcacgcagcaccaagcccggcaaatttttgcatttttagcagagacagggtttcaacacattggccaggctgttctcgaactcctgacctcaagtgatctgcctgccttggccttccaaagtgctgggattayaggcgtaagccaccgcgcccagccttgtatatattcttaaagtttcaattcatctcttcctcaacttctgaaactttcccactctaaagaatgactaagaatagaaaaatctgattataatcaaatggttgaatatctatcaagttttaaaataaacccaatgttggaacattcaaaggttcaaaaatatcaaagttcacaatcaaaattgtcaacccaacctttatatatacacagttaacattctgtcatgaaaaatatttggttttattctaagataccacaggcattttaagatac

SEQ ID NO: 147261 - DNA, 601 bp, Human
tataaaaacctgaagtaagttgaacatacgaactgattaaaagattctcttaagtttaggtcttgggcggtggctcacccctataatcccagcacttttgagagaccgaggcaggcggatcacttgagcccaggagttcaagaccagcctgggcaacaatgctatttaaaaaaaaaaaaaaaagattctcttaagtttaaagcaataatttaccaaggggattggttgtaaaaatgttcatggaggctgggcacggtggctcatgcctgtaatcccagcactttggaaggccaaggcgggyggatcgtgaggtcaggagatcgcctggctaacatggtgaaaccccgtctctactaaaaaatacaaaaaaaagttagccgggcgtgatggcggacgcctgtagttccagctactcgggaggctaaggcaggagaatggcgtgaacccaggaggcggagcttgcagtgagccaagatctcgccactgcactccagcctgggcaacagagccagactccctctcaaaaaaaaaaaaaagttcatggaaatcaattttttcttttatactactgggtttgatattataatacttaaaattgtcc

SEQ ID NO: 147262 - DNA, 601 bp, Human
tgtgcatactcatgatgtttccacagtcatccatgtactgtttcaggtctttatcctggaaaaacacagcactctgctatgtgatacaccattttcagaatgttgtgactggttcacttaatagtgtttttcaaaattagttgtttttcaagaaaagatactggatgcaccatacacataatttaatgaaaaactgataactaaataataaagtctcttgggctgttaaaaagtccaatttagctaagcacagctgcagtttaaagaaaaataaaaaacaaactaaaagtccaatttactatgtttttctaaagtaaagttaaatactgaatttttatgagatgcttaccagatactcaaacaccaaagtcaaggatttatctgtgtgaacaatgtcatgtaaggttactatatttgcatgttttaaatcctttaatagtgaaactgcaaaacagaaaaagaaaattgtttagtctgtggcagtctttataaaaacctgaagtaagttgaacatacgaactgattaaaagattctcttaagtttaggtcttgggcggtggctcacccctataatcccagcacttttgagagaccgaggcag

SEQ ID NO: 147263 - DNA, 601 bp, Human
ttattattttgggaccatcattgcaaatattaacacagtgaaataggcaaataacagatggtacaattttggtaatatatttacatttagaggcctcctacaagggtctcaggagccctaggggtctttgtccacacccaagaacagcctgtgcattttagaatttgctgctaataaccaacataaatcaccaaccaaagttctgtcaaatatcttattctgtgggctaccgagaaaatttccaaacccacataaaagcaatggcacattatgacagtggttgatcttttaaccattacaytttagaacctggaagtactaataaatatctcatacattccataccaaaatctgctagctttaattctcctttctcattaatgaggaggttctgtggtttcaagtctcgatgcaatacctttcttctatggcaatatgccaaaccacgtagaatttggtacagaaacagctacagaaacaaataaataaaaattagtcttaaagatgagacatgctttagtataagcataaatgatggtaagcagaaaagcagctggcctagaacattgtaacaggaaaaagaaagtaattgcatccttaa

SEQ ID NO: 147264 - DNA, 601 bp, Human
ctgagccactgtgtctggcctaaagtctatttcaatagaagacaactggattccacatctgtttttgcattctgtgtgtcgtgatatgttgctttgatacatatcacaatatgtatcaaaatagatcaaatatacatatcacaacatacatatatgaaggaaatcaaatctcacacagatatgaggttgaaagaggaggggcattttaatagccttttctgataaatgtgaatagtcttatttgacactacatcagaactagaaagtaagtggtctcttaaaagctatgtgttaacaaaamctataacgatgaacttctcatgcttttgttgcactaaaattcattgaccttgtactttaaatgggtcttttatccatgcatgattctgtaatatcatgcattagccatttggaaaacagtggatccctgggttatacattccaaatgtttatacactttttcagcatattgaaaaatcgtgtttgttaacatcaacatcgatctcatcagaaaagtctctaagtattgaaaagccatcaaactcaaagcagatccaaatttccaaactctaatttttgcttgaaaacttgaattttatta

SEQ ID NO: 147265 - DNA, 601 bp, Human
ctgctctacaaagttccttcaatatgaaaaagtttactttctagaagcaaaaagagcatttaattttactttcaattcccttaaaaccagattagctaaaaaaaaaatagataaatagctacaattaaattactgagcatataataaatacagagtaatggtggcaggtatattaagggaacgcctttcagtagttgcttctaaactcattgttctcaagacccattttatactcttgaaaattatcaaagacctaaagagcttttatttttgtggatatatttactgatatttgccacaytagaaattaaaacttagcaaattttaaaatattattttctctttaaaaacaccaccctttatatgcagcatgtatgacatttttatgaaaaacattttttttataaaaacaaaacagtaagaagaatggccttctttcacatttttgtaaatctcttttaagtcttgtttttgtagagatggggtcttgctatgttgcccaggctggtcttaaactcccggcttcaagtgatcctctcacctcagcctcataagtgctgggattacacccctgagccactgtgtctggcctaaagtctat

SEQ ID NO: 147266 - DNA, 601 bp, Human
gaaatagagacagaattgaatatactatctcatggaataatcagaatttcttgttgccttgtgggtaaaatttgcctggcttgcattgtagaggttggaagcaaaatttaaagcactcagagtattccctgataaaagtagttgttgtttttttcttcctctttttgagacagggtcttgttctgtcaaccaggctagaatgaaatggcttgatcatgactcgctgaagcctcaacctcccgggcacaactgatcctaccatctcagcctcccaactggctgggactagaggtgcacaccrccacacctggctaattttgaaattttttatagaggcaggtttttgccatattgcccagactggtcttgaactcctgagctcaagcaatctgcctgctgggccttccaaagtgctgggattacaggtgtcagcaaccgcacccagccaaaggtaaattttttatagtccttgacattccttttgcttttttttttttttttttttgagatgaagtctcgctctgtcatgcagtggcatgatcttgggctcactgcaacctccgcctcccgggttcaagcaattctcctgcctaaacttccc

SEQ ID NO: 147267 - DNA, 601 bp, Human
tgaccctccttcacaagaagtcatatttactatgcaaccaaaaaaaaaaaaaaaaaggaagaaatagagacagaattgaatatactatctcatggaataatcagaatttcttgttgccttgtgggtaaaatttgcctggcttgcattgtagaggttggaagcaaaatttaaagcactcagagtattccctgataaaagtagttgttgtttttttcttcctctttttgagacagggtcttgttctgtcaaccaggctagaatgaaatggcttgatcatgactcgctgaagcctcaacctccmgggcacaactgatcctaccatctcagcctcccaactggctgggactagaggtgcacaccaccacacctggctaattttgaaattttttatagaggcaggtttttgccatattgcccagactggtcttgaactcctgagctcaagcaatctgcctgctgggccttccaaagtgctgggattacaggtgtcagcaaccgcacccagccaaaggtaaattttttatagtccttgacattccttttgcttttttttttttttttttttgagatgaagtctcgctctgtcatgcagtggcatgat

SEQ ID NO: 147268 - DNA, 601 bp, Human
ttatgatctgaagaagcaactttaaaaaatatctggaaaattacaaatttattttgccaaaacaaggaagaatttattttttaggctgagattgctgttatatataacttggtatatctgattaaaatattaaagaaaaatgtcacaaaagaaaaaatcaattttactgaataaggttacagaaacaatgtcagaaatttaattaggcaggactcatatactatttcagttcagtataatggtgaaaggttataactggaacaatgttgacattccttcatttaattacaagttttactcyagcatctcaacttggtgaagtaagtccaacaaattattttcataccaattttggtaattaattaacaagatggaggtagctttctgacctctcttcttgatattaaaagtgggttataggaaggcaaaggacagggttgcaaacgtgcttatcctgtaacataccatatcaaggcaaattaccagttatagtttcctcagtatcctactctcccactcctgagaggattccgaactatggtgtttgtgtacatggccttctagttcacaattagaatttcaatactggttggaatgaaat

SEQ ID NO: 147269 - DNA, 601 bp, Human
tagcttcttgaggcttcaccactattaactttatgaattcgttgagtgcatgtggccctaagtaagcaaatccttacatagttgaactaaacaagaattccacaaccagagactgtgcttacttttatgtttgaatacacctggtgaagtattctgggtgaatctaaacttaagatgttttccttctgtccatgaatcatgatgacaaaattatttctcagctgcaattaaattaatccataataggccaatgacattgagatacacaattttacttctaacggctatgagcttttgtcaycttttaacctgattccaactttcatttgctataccattttttatcaaaaactgtaaagttattggtccataatctcattgagatttactgacaaatcgacttagagacaatttccttggaataaaattacagtgctgttctgtactccctttttaggttgtaagttacatggatcattctggagtaagacagacttcattgtccttggatattattaattgctgtttacgtcaggggtgtccaatcttttagcttccctgggctacaatggaagaactgtcttaagccacacataaaata

SEQ ID NO: 147270 - DNA, 601 bp, Human
ggctagtccttcatagggaaaataaaacaaagggttaagaaaaagctttaatggatctctcagaccctattctcaccatgactccattcaaagggatgcctgaaatggttaattcgtagcttcttgaggcttcaccactattaactttatgaattcgttgagtgcatgtggccctaagtaagcaaatccttacatagttgaactaaacaagaattccacaaccagagactgtgcttacttttatgtttgaatacacctggtgaagtattctgggtgaatctaaacttaagatgttttcctwctgtccatgaatcatgatgacaaaattatttctcagctgcaattaaattaatccataataggccaatgacattgagatacacaattttacttctaacggctatgagcttttgtcaccttttaacctgattccaactttcatttgctataccattttttatcaaaaactgtaaagttattggtccataatctcattgagatttactgacaaatcgacttagagacaatttccttggaataaaattacagtgctgttctgtactccctttttaggttgtaagttacatggatcattctggag

SEQ ID NO: 147271 - DNA, 601 bp, Human
tgatcctggaaataaaggtcttccagaagccatttcaaagaaaatgcaaccaacacccctttaaaatagatcatgaaaataatttagcaattcatttacatattatgaagcacaagaatcttttccttaaggttgcctctctgcagaattttgcactagcctgtcggaaaacctcttgaagggatattttagatctaactaatttgttcgcatttaccctatttgtctcaatttctatattgctatatcccatttttcccacttaaaatgtccaactctcctttgcataatccttgaagartaacactaacaacagctaacagtgactgaagatttactatgtgttagaaatgttttttaagtgcaccaattatctcactgaatccttgtattagcaatagtgtagaccatggattgaacagcaaagacaggagtggggaaaaacaactgaagagatattatggtaatctaggagatgacagtgagtgaagctaggcaggagaaatggagagaaacaaatgattcaagacgttttgatgcaggaagcagaggtagaacatgttggtacaaggcggtgtgtgtaagtgaaggaaaagaaaag

SEQ ID NO: 147272 - DNA, 601 bp, Human
ttcaaagaaaagcttcaaccttctacactgaacattaccaaaaaataattaaaggacaaaaatagaatttatgctacttgggagagacatgcaaaaaaagcccagcaagtattattattcttcctaagaaaatctagttagaatggtattagttgctatagtaacaataagagtaccaactcacataaatactttaaaaatatttttggtgtcataactgttttgctcttccttccttagcttgaaaataaaaggaagcataacaagtgtgttatgttgtgagcaatgtgaatggctttgrgttaaaataaatgatgtccttatttggtatcttggtgactttcaaaatttgggggggttgggggcagggagatggaaaatgcagtcaaaggggttattctatgttatctcctgaaaatgtaatacattctacaagtaaaaatgttctgactcaaattttattgggagccttggattgatcttggggtaggtctaagaagaaacttaaatgaatggctgacatttagatgttacattttgctaaggaattggacagagtttatattcttcaaatatgaattacatcattaacactggtcaa

SEQ ID NO: 147273 - DNA, 601 bp, Human
taaaatcaatgttattcaggcatgggaaatctgctattacagtgactttgacaatatgctcactgctgtcatggggatagtaaagtcagtgtgaccacaataaaggaaaatcatctttgtatcttaagaaaaaatgtattttcacaagaaaacaatttatgtttcggttatgcttcattagtttttgtttgaaattcacttttaacaacgctaaatcgaagctagattgggcctagggacaatgcctgtcatcagatggcatgtttcaactaaagtccaataagattaatgatccttgcckaagtactattggtttcctacagaggagtgacaatgtgctcagtgttacaagaaataactgaatcatagggaaataagacacacacctcccttcaagaaattctaatctaactatagagaagactagaatcttaggcttaaaaatcaatagccatctccccaatcaccccagaccctaaccttggacaaataaaaataaagcagggaaaacactttaggatttctcttactttctggtaaagcatgtattcttggtcccagacttcgaaagtacacatgtttcatggcctcttcagctgaa

SEQ ID NO: 147274 - DNA, 601 bp, Human
tgtataaccataactgcctacctcaaagtaaaacttggtattaataatgaaacacaaatacctttttctttttgagacggagtctcactctctcacccaggctagagtgcagtggcatgatcttggctcactgcaacctccgcctcccaggttcaagcagttctcctgcctcagtctcctgagtagctgggattacaggtacgcgccaccacgcccagctaatttttgtatttttagtagagacggggtttccccatgttggtcagcctggtctcgaactcctgacctcgtgatccgcccrccttggcctcccaaagtgctgggattacaggcatgagccatcgcgcccagtgaaatacaaatatctttaaaagaaaacttgtaatttatctttttcatttccaatctctgtcagagaggtattctttcatttaaatatatccagtaaagttgaagtgaaaagtattaaggattttttattccaattagctttgtcactgactgctacacaagctttgatgaatcaatattgtctaataaatgagaataggaaattaatgaaagcttttggcagcttagttcccaaacattcttctaattc

SEQ ID NO: 147275 - DNA, 601 bp, Human
gttcattaagaaattatatagtataaacttaaagtgttcaagatggctcacttattttactattaagcaaagctaaatttacattccaggaaacactgcagtttaattttaaaaacaaaaaatgcagcagtaaaacaattcgtgaggagaaacagatgcattcacatataataaagccactgcaacttcttcaggcattcaattgttgtgttaaataaacagacagtagttatttagcagcaatgattccgcaataaataatgcactgtgtttctcagtcctgcacaaaaattgcagctayagttacatcaatagctgtaacctactggctctaatggcagagaagaccttaaaaccgactgtacaaaaaattgtcacactgtgacaacaaatataaaaacaatctgtaggtctgaaataaaaagactccactgtgaagaggacagtgtagacaaacggagattccaagtccaccaaaagaaataattgccttcagttctgagtccttgattggtaagaaaggctgggggctgggcttgaaaccatgttatcagacttaaaagagcatgctctgtcttctgttcttcccatgtcctaaaat

SEQ ID NO: 147276 - DNA, 601 bp, Human
acgtctgcaagggacgttgatcctcactctccaatgcgtgtcagtggcatatgggggctggggtgggggaggggcggtatcttagggcttggatataggaggaaaagaaacagaacttttcaaggactggatgtgcagggtggtgtcaggggttgccgagaagggccctactgttttagtgactcgtttcttttggttgttgccccttccttccaagttgctcttaataagttgagtccgaatcttcaggcaggagtaaagatgtaggaggaatgggattggttgttgaagtctttggaaycaggtagccatccaggtggaaggcattgcccctgaggcctgtcatccaaggcttgtcatcagttgctttgtgtaatagtcgcagcatggcaagtaggttaaaagtcgcctgcaggtaatgtgggtgaaactgaagtttcctaatacaggaccaggatattatagtgttagagttaggaggatacctcatgctcacctggttaaaccccaggtttcataggtgaaagcaacaggcctcaagggtgaagtcactcctgaaatggcccagataagtgaatagcagaggtgggattggagggtt

SEQ ID NO: 147277 - DNA, 601 bp, Human
ttactcaatccttgcatcaaccctatgataaggtactatgatgatcacctttttacctatatataaatgaatgcatagaaaggttaagttggtttctcaagattccagctaggatccaaacccagctgtctgcctccagtcctgtgtcttcaacatgctcctgcattgcctctccaaacagaaggcaaatgctgcctggtgggtacactgaactaatttggtctcaactcacatttccatcattctctcccattaccatagacctgacatcttctcctctagcgagcccagaccgctgtgscatcttccctgtatacagacaaggcagttgaggtccagggaaagtcagtggcatatacaaagcacacggctaagaagtggtgaataaaactgggatttagatccaagtccatctgcccatgaagcccctactctttccccaagccacacacactctttttctaataaagcttccagcatgtgggatggaccgtcttaggagggtgagtcctcattattggaagtacagtactgtgttggagaaaaaactcaaactgtttttttcattatctcaacatcaccaacaacacagaagcacaga

SEQ ID NO: 147278 - DNA, 601 bp, Human
cctatgataaggtactatgatgatcacctttttacctatatataaatgaatgcatagaaaggttaagttggtttctcaagattccagctaggatccaaacccagctgtctgcctccagtcctgtgtcttcaacatgctcctgcattgcctctccaaacagaaggcaaatgctgcctggtgggtacactgaactaatttggtctcaactcacatttccatcattctctcccattaccatagacctgacatcttctcctctagcgagcccagaccgctgtgccatcttccctgtatacagacraggcagttgaggtccagggaaagtcagtggcatatacaaagcacacggctaagaagtggtgaataaaactgggatttagatccaagtccatctgcccatgaagcccctactctttccccaagccacacacactctttttctaataaagcttccagcatgtgggatggaccgtcttaggagggtgagtcctcattattggaagtacagtactgtgttggagaaaaaactcaaactgtttttttcattatctcaacatcaccaacaacacagaagcacagaagactcctgtgaccaaatgtc

SEQ ID NO: 147279 - DNA, 601 bp, Human
gctgaggctactggtccgggaatcacactttgagaaccactggtggatggggagcatctagcatggtgctgaggcagttctgacattgagagctaaagtcagaggcaggagaataccctagagatgagatgcaatggaaattgaaagatgaaagtgagaccaaaaaatgtcttaagacaaaagcaacatccattttagggctccctctccctgatgtttaagttagtggtcacttgggagtaaatgtggtcccctgagcagtgctgagaagtttccctgagagaagggccatgggtcactkagaaaagctcttccagtgatctgcaagtcaggcccttgcaggaacttcaggcttcgttaccatgccattaaccactgcccatagagtgtggaaccagtgcgcagaggctcacagcttcaatttagagaaaataaatgttggactgaaaagctctggctgatggcttgacttattaagtttttaaatctaaatatctggcactgtgagaaggggcagcctaaattgtgtttttgtccttgaatagggcttctaatcaaagagtttggtgaggagcagacagtactttcccagggactgttc

SEQ ID NO: 147280 - DNA, 601 bp, Human
caaaatacatgacttttgttgtattgttaataaatcatcaagggaaacagaatccagtctgcagtcaagtagaagcctctgcttggtttcttcttgggatcaagatatagtgaataccagctggtattcactatatgtactatagcaggtatatataaaaatatatatacctactggcattatatatacacatatatatctgctggtattatatataaaatatataatatataaatatatgtaatatatattctatatataacattatatttatgtagaataatatttctatatatatttrtatatattttttctgagttagttattcaaaggagacagtactttttataacatggcatgtagggtcttgtacgcatttgtgcaaaactaaatgttgtatctcaatttaatatccattaaagtgtccattatctcttccttgacagtacattttagcaacatttatgtacttctgtactgttttaatgaatttatgtataattatatttcttgtaaatattcataagtcttaccagcactattctgtcagtctacttttttaccttgatgtcagatttttaaaaataaatctggacttggt

SEQ ID NO: 147281 - DNA, 601 bp, Human
ggttcaaataaaattcagcattgttgataaggaccactatgtcaattaggattgtttttagctacaagtaatagaaaattggacaatcaatgacaaacagaggcatgtttatctcacctaataaataggtcagagttctacctattggtagagtttgctgtcattgatttagcattcagtgatgccagcaaccctctgagtctttctactctgtttctcatgttgattgcctcttggtcataggatagttgcagcagttccaaccatcatgtccacatttaaaacagggataagtcacacrgctacctctccctgcagaggagaccagggaagttattggctgtttacattgccacggggttctcttaataaggagaaggagtgtttaccacatcaagtcttatgtttcttctggcagttgcattctgtacatgatactggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagc

SEQ ID NO: 147282 - DNA, 601 bp, Human
tttagctacaagtaatagaaaattggacaatcaatgacaaacagaggcatgtttatctcacctaataaataggtcagagttctacctattggtagagtttgctgtcattgatttagcattcagtgatgccagcaaccctctgagtctttctactctgtttctcatgttgattgcctcttggtcataggatagttgcagcagttccaaccatcatgtccacatttaaaacagggataagtcacacggctacctctccctgcagaggagaccagggaagttattggctgtttacattgccacggggttctcttaataaggagaaggagtgtttaccacatcaagtcttatgtttcttctggcagttgcattctgtacatgatactggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagccaagaatctcttgagtaagcttctttggagtcatttattcaaatgttagtaagctt

SEQ ID NO: 147283 - DNA, 601 bp, Human
ataaggaaattgagccactgttagaggtggttttctggaggagcttcaggaaaagccaagaatctcttgagtaagcttctttggagtcatttattcaaatgttagtaagcttggaaaaataaaaccgatattgcaaaagatttatatctctaattttaagagatcttacacatcagatcttattatagtagcaataaaagttttgccaaataagttttgctttttcatatcaaattgtttgtataaacaatggtgcccaacgctggtgagatgctcctttggaactggtgagaggaactgrtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaagtattctatacaaacataaatattctggaaattttttttcataaaaatatttggaaacaaatttttttggagaataattgagttaggtatggagtcttcataacctcagtataatatttagttaaaaataagaatacaaactatttataccatgtgattccc

SEQ ID NO: 147284 - DNA, 601 bp, Human
catcagatcttattatagtagcaataaaagttttgccaaataagttttgctttttcatatcaaattgtttgtataaacaatggtgcccaacgctggtgagatgctcctttggaactggtgagaggaactggtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaagtattctatacaaacataaatattctggaaattttttttcataaaaatatttggaaacaaatttttttggagaataattgagttaggtatggagtcttcataacctcagtataatatttagttaaaaataagaatacaaactatttataccatgtgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatga

SEQ ID NO: 147285 - DNA, 601 bp, Human
tgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatgagtgtggttgctgagatcctttttaaaaagaaataatgggtgagaaaatgctttgattcaagaatgtggaccaggctgttcagcgcttggacattgtattgatgaagtaggaaaggtgttgccrtgttatggagcatttggttcctctggagctctggcattgctcagttctgcctcgaagggaatgtttaaaggaagttgtcgcaatcgttcattcttctgtactcacgcaaattatggttgttctatttttctcttccttgagaacttcctgttctcattgtctgtgccatataacaggatggaagtcactatgggttgtaactacattcaggagaagaagagaaccagtgtaagggaacagtgtgttttaatttatgcagatatccaatgctaacttatttaaaggttggggaggtcatta

SEQ ID NO: 147286 - DNA, 601 bp, Human
ttcctgacatctctcatcagaccctgaggtctgcccttctactggggcatccatggcatggcacataaggggttcagatagactagtttgatatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatstttattccttgacttcccctcaggccatggcacagtgtttacagagagggcttcattcatgcatgattaaccagtaacacggccttagcgcatggatgcaagagttcatccaaaagtttatgttcgttcatttgtttctttgcctttgtgttgaaattaatctaatagccattgctttaattttaataatagagcctttaggcaaagctgagggtcaggaattgtaaattgtcaccgtacagagagtgaaatgtgtgatggggcaactctaggccaggaccctcatggacaagaatatgg

SEQ ID NO: 147287 - DNA, 601 bp, Human
atatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcrcatggatgcaagagttcatccaaaagtttatgttcgttcatttgtttctttgcctttgtgttgaaattaatctaatagccattgctttaattttaataatagagcctttaggcaaagctgagggtcaggaattgtaaattgtcaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcaga

SEQ ID NO: 147288 - DNA, 601 bp, Human
atccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcgcatggatgcaagagttcatccaaaagtttatgttcgttcatttgtttctttgcctttgtgttgaaattaatctaatagccattgctttaattttaataatagagcctttaggcaaagctgagggtcaggaattgtaaattgycaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcagatttcttttgtttttcattttcagtcttttatacagaatcaaaaagaagcagttgttgaaaaattctgtcttggaattgataaaacaatgtgttgggtttcactatgccacatggctatttaaaatataacctctctcgagaa

SEQ ID NO: 147289 - DNA, 601 bp, Human
gcaatgagaataaaatctttacctcttaccctggtttacaaagtccttggggtccagccctgacaaactctctaacctcagctcctgccactctctcttttgtccagagttctccagaccccaggttctttaaagatgccagcccaccaatctgaggaccttccttctaccaggaacgggcttttcctatcttcctatggctggcttcttccaacatttggaacaagatgctctgataaatgttaactctcatagaggcctttcctgatcacctgattacatagatgtcctccccatcccygcccttgcaaggcatcatttatcacacaactcttcttaccctatttaaattacctagatggcacttatagctatctctagcactgctgcctacctgaatttaagatctctgagagcagggcctgcacctgcttttttatcattgtgtcaccaagaccacagaggaggtcagtgtttggtgtggcatgaacgtcgtcatcagctgcttttctttttttttttttttattatactttaagttttagggtacatgtgcacaatgtgcaggttagttacatatgtatacatgtgccatgctggt

SEQ ID NO: 147290 - DNA, 601 bp, Human
cttcctatggctggcttcttccaacatttggaacaagatgctctgataaatgttaactctcatagaggcctttcctgatcacctgattacatagatgtcctccccatccctgcccttgcaaggcatcatttatcacacaactcttcttaccctatttaaattacctagatggcacttatagctatctctagcactgctgcctacctgaatttaagatctctgagagcagggcctgcacctgcttttttatcattgtgtcaccaagaccacagaggaggtcagtgtttggtgtggcatgaasgtcgtcatcagctgcttttctttttttttttttttattatactttaagttttagggtacatgtgcacaatgtgcaggttagttacatatgtatacatgtgccatgctggtgtgctgcacccattaactcgtcatttagcattagatatatctcctaatgctatctctcccccctccccccaccccacaacagtccccagagtgtaatgttccccttcctgtgtccatgtgttctcattgttcaattcccacctatgagtgagaatatgtggtgtttggttttttgttcttgtgatagttt

SEQ ID NO: 147291 - DNA, 601 bp, Human
ttacaatcccaccaacagtgtaaaagtgttcttatttctccacatcctctccagcacctgttttttcctgactttttaatgattgccattctaactggtgtgagatggtatctcattgtggttttgatttgcatttctctgatggccagtgatggtgagcattttttcatgtgttttttggctgcataaatgtcttcttttgagaagtatctgttcttgtccttcacccactttttgatggggttgtttgtttttttcttgtaaatttgttggagttcattgtagattctggatattagcyctttgtcagatgagtaggttgtgaaaattttctcccattttgtaggttgcctgttcactctgatggtagtttcttttgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgct

SEQ ID NO: 147292 - DNA, 601 bp, Human; identical to SEQ ID NO: 40290

SEQ ID NO: 147293 - DNA, 601 bp, Human; identical to SEQ ID NO: 40291

SEQ ID NO: 147294 - DNA, 601 bp, Human; identical to SEQ ID NO: 40292

SEQ ID NO: 147295 - DNA, 601 bp, Human; identical to SEQ ID NO: 40293

SEQ ID NO: 147296 - DNA, 601 bp, Human; identical to SEQ ID NO: 40294

SEQ ID NO: 147297 - DNA, 601 bp, Human; identical to SEQ ID NO: 40295

SEQ ID NO: 147298 - DNA, 601 bp, Human; identical to SEQ ID NO: 40296

SEQ ID NO: 147299 - DNA, 601 bp, Human; identical to SEQ ID NO: 40297

SEQ ID NO: 147300 - DNA, 601 bp, Human; identical to SEQ ID NO: 40298

SEQ ID NO: 147301 - DNA, 601 bp, Human; identical to SEQ ID NO: 40299

SEQ ID NO: 147302 - DNA, 601 bp, Human; identical to SEQ ID NO: 40300

SEQ ID NO: 147303 - DNA, 601 bp, Human; identical to SEQ ID NO: 40301

SEQ ID NO: 147304 - DNA, 601 bp, Human; identical to SEQ ID NO: 40302

SEQ ID NO: 147305 - DNA, 601 bp, Human; identical to SEQ ID NO: 40303

SEQ ID NO: 147306 - DNA, 601 bp, Human; identical to SEQ ID NO: 40304

SEQ ID NO: 147307 - DNA, 601 bp, Human; identical to SEQ ID NO: 40305

SEQ ID NO: 147308 - DNA, 601 bp, Human; identical to SEQ ID NO: 40306

SEQ ID NO: 147309 - DNA, 601 bp, Human; identical to SEQ ID NO: 20136

SEQ ID NO: 147310 - DNA, 601 bp, Human; identical to SEQ ID NO: 20137

SEQ ID NO: 147311 - DNA, 601 bp, Human; identical to SEQ ID NO: 20138

SEQ ID NO: 147312 - DNA, 601 bp, Human; identical to SEQ ID NO: 20139

SEQ ID NO: 147313 - DNA, 601 bp, Human; identical to SEQ ID NO: 20140

SEQ ID NO: 147314 - DNA, 601 bp, Human; identical to SEQ ID NO: 20141

SEQ ID NO: 147315 - DNA, 601 bp, Human; identical to SEQ ID NO: 20142

SEQ ID NO: 147316 - DNA, 601 bp, Human; identical to SEQ ID NO: 20143

SEQ ID NO: 147317 - DNA, 601 bp, Human; identical to SEQ ID NO: 20144

SEQ ID NO: 147318 - DNA, 601 bp, Human; identical to SEQ ID NO: 20145

SEQ ID NO: 147319 - DNA, 601 bp, Human; identical to SEQ ID NO: 20146

SEQ ID NO: 147320 - DNA, 601 bp, Human; identical to SEQ ID NO: 20147

SEQ ID NO: 147321 - DNA, 601 bp, Human; identical to SEQ ID NO: 20148

SEQ ID NO: 147322 - DNA, 601 bp, Human; identical to SEQ ID NO: 20149

SEQ ID NO: 147323 - DNA, 601 bp, Human; identical to SEQ ID NO: 20150

SEQ ID NO: 147324 - DNA, 601 bp, Human; identical to SEQ ID NO: 20151

SEQ ID NO: 147325 - DNA, 601 bp, Human; identical to SEQ ID NO: 34177

SEQ ID NO: 147326 - DNA, 601 bp, Human; identical to SEQ ID NO: 34178

SEQ ID NO: 147327 - DNA, 601 bp, Human; identical to SEQ ID NO: 34179

SEQ ID NO: 147328 - DNA, 601 bp, Human; identical to SEQ ID NO: 34180

SEQ ID NO: 147329 - DNA, 601 bp, Human; identical to SEQ ID NO: 34181

SEQ ID NO: 147330 - DNA, 601 bp, Human; identical to SEQ ID NO: 34182

SEQ ID NO: 147331 - DNA, 601 bp, Human; identical to SEQ ID NO: 34183

SEQ ID NO: 147332 - DNA, 601 bp, Human; identical to SEQ ID NO: 34184

SEQ ID NO: 147333 - DNA, 601 bp, Human
tctgtgtggaggcgcaggggatgagtgaggacttagttgagaagagacccagagggactggagagaaagctgagagcaggccagcccagcccacagcccccaggtctttgcttatggctggttccatcagtgtgtcacctcctccaggaaggcctccctggcttcctccccactgcctgtacaccaccagggacagagagctcatcagctcttcggggagagctctaactgagaccatctttttttttttttttttgagatggagtctcactctgtcactcaggctggagtgcaatggggmaatctcagctccactctgcctccagggttcaagtgattctgctgcctcagcctcccaagtagctgggattacaggcgtgcaccaccacacccagctaattttttctatttttagtagagacggggtttcaccatgttggccaggctgatctcaaactcctgacctcaggtgatcctcccacctcagcctcccaaagtgttgggatgacaggcatgagccactgtgcccagccttaactgagaccatcttaactggatctgagagggtcagctcagctcagccttctggtctcaggcccac

SEQ ID NO: 147334 - DNA, 601 bp, Human
caatcagggcattccgtttccttgactgcaatgattgattggttctggggtgggcacgggacccgaccccggccaataagaattgaacctgagacttttgctggagctctggagaaggagccactcttgtgcctcgggagtggctaaactggtgagatgttagcttggagctgctggtggccgtttcaccactgtgaagacagagaacttgcctgagaatgaagcctccacagaggaaagaagagccaggaaagggagataggtcatgggcagcttcttttgagaaccaagactggacccrcaggaattcctcatcccctctcccctctaaaccttactcctcctgtgtcttcatcctggaggatccagccgggcctgaaacccacactgatttttcagttacataaaccaccggatacccccacctttccttttatttatatattcatttatttgtttgtttttttatttttttttttgagacggagtctcaccctgttgcccaggctggagtgcagtggtgcgatctcggctcactgccatctccgccccccaagttcaatcgattctcctgcttcagcctcccgagtagctgggatta

SEQ ID NO: 147335 - DNA, 601 bp, Human
ctacaggcacgcgccaccacacctgggtaatttttttttttttttttagatacagggcctcactgtgttggccaggctggtcttggacccctgagctgaagtgatccgctcactttggcctcccaaagtgctgggtttacaggcgtgcaccatggcacccggtctgtttttctttctttctttctttctttttttttgaatacgtcaccaatctctaaaaaccaagcggtttctttcatgcataaatctcacttcccacttctcttgagacgtcggaagctctggctgtgccaggtgttaygtgctgcggcaacaatgggcagaagctgagcaggggccgccccaggcgtgaggcctgccggggtgacgacatctgtcacccgtgctcactgcctctgccttgggtcccgccccgtccccccttcccatccctgcggcctcttcacagctgtcctgcctccggtccccacgcccacccctgcctgctccaggccctcccctgctagacatcctgtcttggctcccttctgcctgcagaagaaatccgggcgcctcagcctggtgttcaaaggccttcgccatcgcccctgctctccctttc

SEQ ID NO: 147336 - DNA, 601 bp, Human
ttgttttgttcacttctgtatttttagtgtctagaatagtgcttggcacataataggaactcaacaaacactgtgtgttgaatgactaactgaatgtggaattgaatctcaggccaaccatttgtgtttttaattattttatttttattgttctttatttatttttgagacagggtgtcactctgtcctccaggctggagtgcactggtgcagtcgtggctcactgcagcctcaactttccaggctcaggtgatcctcccacctcagcctcctgagtagctgggactgactacaggcacgygccaccacacctgggtaatttttttttttttttttagatacagggcctcactgtgttggccaggctggtcttggacccctgagctgaagtgatccgctcactttggcctcccaaagtgctgggtttacaggcgtgcaccatggcacccggtctgtttttctttctttctttctttctttttttttgaatacgtcaccaatctctaaaaaccaagcggtttctttcatgcataaatctcacttcccacttctcttgagacgtcggaagctctggctgtgccaggtgttacgtgctgcggca

SEQ ID NO: 147337 - DNA, 601 bp, Human
caagcgattttcctgcctcagcctcctgaggagctgggattacaggcgcacaccaacacgcctggctaatttttgtatttttagtatagacggggcttcaccatgttggccaggctggtcttgaactcctgacctcaggtgatccacccacctctgcctcccaaagtgctgggattacaggcatgagccactgtgcccggcctacgaaatctatttcgtgccaagcactaaccactatacagacagaaattcaattggatcaacctgaactcttcatctccctttagaacttgttcccctrtgtcctcgtcatggagaatggtgctgtcctcaccctatcacccaggctcaacacccaggcagcatcctcacagccaccctccccatcatgcccccacattcattggatcccccagtccttctggtcctccctcggctttcatctaaggacccagaagggctggttttgggaaggctgagacactggaggagctgggacaggtgcgggggcagctctggcatgggttgggaggaccggccaggtggctggtgggacacagggtatggccatgggccacaggcaggagttgaccagatgggg

SEQ ID NO: 147338 - DNA, 601 bp, Human
acgctgtctctactaaaaaacaaaaacaaacacgtatttatccagcccctattcatgcgccaaacactgttgaacaaaacaaacacaaaagtgaacaaaacaaacaaaaatctcgcacccaagggtcttacacagatgctcctcaaatgacgatggggctataacctgataaacccatcctgagtcaaaaggctcttaatacccccaataaacccaccataaagtcaaaaaatcctaagtcaaaccacgctaagtccagatgctcctcaatttacaatgtggtgatgtcctgataaattcytttttttttttttttttttttgagacggagtctcgctctgtcccccagactggagtgcaatgaggcgatctaggctcactgcaacctctgcctcccggattcaagcgattttcctgcctcagcctcctgaggagctgggattacaggcgcacaccaacacgcctggctaatttttgtatttttagtatagacggggcttcaccatgttggccaggctggtcttgaactcctgacctcaggtgatccacccacctctgcctcccaaagtgctgggattacaggcatgagccactgtgcccg

SEQ ID NO: 147339 - DNA, 601 bp, Human
gaaagaggagctgggctggtcccacagggacgtgggacagagtcccacccaactctgagacaggccctgtgaggggaaggtgcaaacctgagccagctcacctgggctgggaagacgtagtcagccacatcccagacctgggggccgaggccagggagctgggtcacggccaggcccttgagtttcacagagacactgctgatgaggccgctcgaggtctggtagcccttctcatagagaaacacccacctgtgcgggtggggacagagggggagttgtggttgtggcaccagctggaccygtcacacgctttcccacgccctccccagatgtgcctctgagccaccatctgctcctaaagctcctgtcttgggctagaggcaggacagcctcccctgcctcccgctgctggcctgggcctgaagttccacggtgcttttcactatgaaaatgctaattcaggacgggcgtgccatcccagcattttgggaggccgaggcgggtggatcacctgaggtcaggaatttgagaccagcttggccaacatgatgaaatctgtctctactaaaaatacaaaaattagcttggcatggtggtgggt

SEQ ID NO: 147340 - DNA, 601 bp, Human; identical to SEQ ID NO: 25173

SEQ ID NO: 147341 - DNA, 601 bp, Human; identical to SEQ ID NO: 25174

SEQ ID NO: 147342 - DNA, 601 bp, Human; identical to SEQ ID NO: 25175

SEQ ID NO: 147343 - DNA, 601 bp, Human; identical to SEQ ID NO: 25176

SEQ ID NO: 147344 - DNA, 601 bp, Human; identical to SEQ ID NO: 25177

SEQ ID NO: 147345 - DNA, 601 bp, Human; identical to SEQ ID NO: 25178

SEQ ID NO: 147346 - DNA, 601 bp, Human; identical to SEQ ID NO: 25179

SEQ ID NO: 147347 - DNA, 601 bp, Human; identical to SEQ ID NO: 25180

SEQ ID NO: 147348 - DNA, 601 bp, Human; identical to SEQ ID NO: 25181

SEQ ID NO: 147349 - DNA, 601 bp, Human; identical to SEQ ID NO: 25182

SEQ ID NO: 147350 - DNA, 601 bp, Human; identical to SEQ ID NO: 31412

SEQ ID NO: 147351 - DNA, 601 bp, Human; identical to SEQ ID NO: 31413

SEQ ID NO: 147352 - DNA, 601 bp, Human; identical to SEQ ID NO: 31414

SEQ ID NO: 147353 - DNA, 601 bp, Human; identical to SEQ ID NO: 31415

SEQ ID NO: 147354 - DNA, 601 bp, Human; identical to SEQ ID NO: 31416

SEQ ID NO: 147355 - DNA, 601 bp, Human; identical to SEQ ID NO: 31417

SEQ ID NO: 147356 - DNA, 601 bp, Human; identical to SEQ ID NO: 31418

SEQ ID NO: 147357 - DNA, 601 bp, Human; identical to SEQ ID NO: 31419

SEQ ID NO: 147358 - DNA, 601 bp, Human; identical to SEQ ID NO: 31420

SEQ ID NO: 147359 - DNA, 601 bp, Human; identical to SEQ ID NO: 31421

SEQ ID NO: 147360 - DNA, 601 bp, Human; identical to SEQ ID NO: 31422

SEQ ID NO: 147361 - DNA, 601 bp, Human; identical to SEQ ID NO: 31423

SEQ ID NO: 147362 - DNA, 601 bp, Human; identical to SEQ ID NO: 31424

SEQ ID NO: 147363 - DNA, 601 bp, Human; identical to SEQ ID NO: 31425

SEQ ID NO: 147364 - DNA, 601 bp, Human; identical to SEQ ID NO: 31426

SEQ ID NO: 147365 - DNA, 601 bp, Human; identical to SEQ ID NO: 31427

SEQ ID NO: 147366 - DNA, 601 bp, Human; identical to SEQ ID NO: 31428

SEQ ID NO: 147367 - DNA, 601 bp, Human; identical to SEQ ID NO: 31429

SEQ ID NO: 147368 - DNA, 601 bp, Human; identical to SEQ ID NO: 31430

SEQ ID NO: 147369 - DNA, 601 bp, Human; identical to SEQ ID NO: 31431

SEQ ID NO: 147370 - DNA, 601 bp, Human; identical to SEQ ID NO: 31432

SEQ ID NO: 147371 - DNA, 601 bp, Human; identical to SEQ ID NO: 31433

SEQ ID NO: 147372 - DNA, 601 bp, Human; identical to SEQ ID NO: 31434

SEQ ID NO: 147373 - DNA, 601 bp, Human; identical to SEQ ID NO: 31435

SEQ ID NO: 147374 - DNA, 601 bp, Human; identical to SEQ ID NO: 31436

SEQ ID NO: 147375 - DNA, 601 bp, Human; identical to SEQ ID NO: 31437

SEQ ID NO: 147376 - DNA, 601 bp, Human; identical to SEQ ID NO: 31438

SEQ ID NO: 147377 - DNA, 601 bp, Human; identical to SEQ ID NO: 31439

SEQ ID NO: 147378 - DNA, 601 bp, Human; identical to SEQ ID NO: 31440

SEQ ID NO: 147379 - DNA, 601 bp, Human; identical to SEQ ID NO: 31441

SEQ ID NO: 147380 - DNA, 601 bp, Human; identical to SEQ ID NO: 31442

SEQ ID NO: 147381 - DNA, 601 bp, Human; identical to SEQ ID NO: 31443

SEQ ID NO: 147382 - DNA, 601 bp, Human; identical to SEQ ID NO: 31444

SEQ ID NO: 147383 - DNA, 601 bp, Human; identical to SEQ ID NO: 31445

SEQ ID NO: 147384 - DNA, 601 bp, Human; identical to SEQ ID NO: 31446

SEQ ID NO: 147385 - DNA, 601 bp, Human; identical to SEQ ID NO: 31447

SEQ ID NO: 147386 - DNA, 601 bp, Human; identical to SEQ ID NO: 31448

SEQ ID NO: 147387 - DNA, 601 bp, Human; identical to SEQ ID NO: 31449

SEQ ID NO: 147388 - DNA, 601 bp, Human; identical to SEQ ID NO: 31450

SEQ ID NO: 147389 - DNA, 601 bp, Human; identical to SEQ ID NO: 31451

SEQ ID NO: 147390 - DNA, 601 bp, Human; identical to SEQ ID NO: 31452

SEQ ID NO: 147391 - DNA, 601 bp, Human; identical to SEQ ID NO: 31453

SEQ ID NO: 147392 - DNA, 601 bp, Human; identical to SEQ ID NO: 31454

SEQ ID NO: 147393 - DNA, 601 bp, Human; identical to SEQ ID NO: 31455

SEQ ID NO: 147394 - DNA, 601 bp, Human; identical to SEQ ID NO: 25198

SEQ ID NO: 147395 - DNA, 601 bp, Human; identical to SEQ ID NO: 25199

SEQ ID NO: 147396 - DNA, 601 bp, Human; identical to SEQ ID NO: 25200

SEQ ID NO: 147397 - DNA, 601 bp, Human; identical to SEQ ID NO: 25201

SEQ ID NO: 147398 - DNA, 601 bp, Human; identical to SEQ ID NO: 25202

SEQ ID NO: 147399 - DNA, 601 bp, Human; identical to SEQ ID NO: 25203

SEQ ID NO: 147400 - DNA, 601 bp, Human; identical to SEQ ID NO: 25204

SEQ ID NO: 147401 - DNA, 601 bp, Human; identical to SEQ ID NO: 25205

SEQ ID NO: 147402 - DNA, 601 bp, Human; identical to SEQ ID NO: 25206

SEQ ID NO: 147403 - DNA, 601 bp, Human; identical to SEQ ID NO: 25207

SEQ ID NO: 147404 - DNA, 601 bp, Human; identical to SEQ ID NO: 25208

SEQ ID NO: 147405 - DNA, 601 bp, Human; identical to SEQ ID NO: 25209

SEQ ID NO: 147406 - DNA, 601 bp, Human; identical to SEQ ID NO: 25210

SEQ ID NO: 147407 - DNA, 601 bp, Human; identical to SEQ ID NO: 25211

SEQ ID NO: 147408 - DNA, 601 bp, Human; identical to SEQ ID NO: 25212

SEQ ID NO: 147409 - DNA, 601 bp, Human; identical to SEQ ID NO: 25213

SEQ ID NO: 147410 - DNA, 601 bp, Human; identical to SEQ ID NO: 25214

SEQ ID NO: 147411 - DNA, 601 bp, Human; identical to SEQ ID NO: 25215

SEQ ID NO: 147412 - DNA, 601 bp, Human; identical to SEQ ID NO: 25216

SEQ ID NO: 147413 - DNA, 601 bp, Human; identical to SEQ ID NO: 25217

SEQ ID NO: 147414 - DNA, 601 bp, Human; identical to SEQ ID NO: 25218

SEQ ID NO: 147415 - DNA, 601 bp, Human; identical to SEQ ID NO: 25219

SEQ ID NO: 147416 - DNA, 601 bp, Human; identical to SEQ ID NO: 25220

SEQ ID NO: 147417 - DNA, 601 bp, Human; identical to SEQ ID NO: 25221

SEQ ID NO: 147418 - DNA, 601 bp, Human; identical to SEQ ID NO: 25222

SEQ ID NO: 147419 - DNA, 601 bp, Human; identical to SEQ ID NO: 25223

SEQ ID NO: 147420 - DNA, 601 bp, Human; identical to SEQ ID NO: 25224

SEQ ID NO: 147421 - DNA, 601 bp, Human; identical to SEQ ID NO: 25225

SEQ ID NO: 147422 - DNA, 601 bp, Human; identical to SEQ ID NO: 25226

SEQ ID NO: 147423 - DNA, 601 bp, Human; identical to SEQ ID NO: 25227

SEQ ID NO: 147424 - DNA, 601 bp, Human; identical to SEQ ID NO: 25228

SEQ ID NO: 147425 - DNA, 601 bp, Human; identical to SEQ ID NO: 25229

SEQ ID NO: 147426 - DNA, 601 bp, Human; identical to SEQ ID NO: 25230

SEQ ID NO: 147427 - DNA, 601 bp, Human; identical to SEQ ID NO: 25231

SEQ ID NO: 147428 - DNA, 601 bp, Human
ggggcagcagaatcgcttgaacctgggaggcggaggttgcagtgaactgagattatgtcactgcgctccagtctgggtgaaaggtggtggtggctcacacttgtaattccagcactttgggaggccgaggtgggtggatcacctgaagtcaggagttcgagaccagcctggccaacatggtgaaaccctgtctctactaaaaatacaaaaattggccagacacagtggagggcttctgtaatcccagcaactctgaggccgaggcaggagaatcacttgaacccagaggcagaagttgtcrtcagccaagatctcgccactgcaccccagtttgggcaacaaagtaaaactctgtctcaaaaataaaataaaacaaggcttttatttcactgtgtgtagttatcgaatctttccaataaatttgatatgtttacatttcaattaaaattcatttgccttgccctactactttgtacattttgagcatgttaattaacatgcttcaaattttaaaaaaaaattaaaaacaatcccattgtttctgatcaagaaggcaggaaaacttaaatctgcagctaagtaactttacaatgaggcctga

SEQ ID NO: 147429 - DNA, 601 bp, Human
gtaattccagcactttcgtaagctgaggcgggtgaatcacctgagatcaggagttcaagaccagcctggccaacatggcaaaaaccctgtctctactaaaaatacaaaaaataagcctgggcatcgtggcacacacctgtaatcccagctacttgggaggctgaggcacaagaaacgcttgaacccgcgaggcggaggttgcacttagcggagatcgtgccactgcattccagcctgggccactgcaatccagcctgggcgacagagcaagactgtctcaaaaaaaaaaaaaaaaaaaaaagacatatttgtcaatgatgggttgcttccacaaaaagaacttatggccagggtgaaaagactatgtttttttgtactctttgcatttttaaccaatgcttataataccttttcaaaagataaaatgttttaaaagtatctcctgtgctgagggattttttagtgtttaacataaggcactgcaaaacttgaattgccaccgctcaatttgcaaaggagtaagtcatagtctaataatatccacagagaaatacacaacctatctgatttcatgaatctgttaggtgtctttatttgctta

SEQ ID NO: 147430 - DNA, 601 bp, Human
gaaaagacacatttgtcagccaggcatgatggctcatgcctgtaattccagcactttcgtaagctgaggcgggtgaatcacctgagatcaggagttcaagaccagcctggccaacatggcaaaaaccctgtctctactaaaaatacaaaaaataagcctgggcatcgtggcacacacctgtaatcccagctacttgggaggctgaggcacaagaaacgcttgaacccgcgaggcggaggttgcacttagcggagatcgtgccactgcattccagcctgggccactgcaatccagcctgggygacagagcaagactgtctcaaaaaaaaaaaaaaaaaaaaaagacatatttgtcaatgatgggttgcttccacaaaaagaacttatggccagggtgaaaagactatgtttttttgtactctttgcatttttaaccaatgcttataataccttttcaaaagataaaatgttttaaaagtatctcctgtgctgagggattttttagtgtttaacataaggcactgcaaaacttgaattgccaccgctcaatttgcaaaggagtaagtcatagtctaataatatccacagagaaatacacaacc

SEQ ID NO: 147431 - DNA, 601 bp, Human
ataaaaacttctgattagaccgggcgcgatggctcacgcctgtaatcccaacactttgggaggccaaggcaggccaaggagaccatcctggccaacatggtgaaactccatctctactaaaaatacaaaaatgatccaggggtggtggcgtgtgcctgtagtcccagctactcagaaggctgaggcaggagaatcacttgaacccgggaggcagaggctgcagtgagccaagatctcgccactatactccagcctgggcgacagaacaaggctccatctcaaaaaaaaaaaaaaaacaaamaaaaaaaaactgctgattaactcaaattagcccaatactatcttgcactagggggaaaaagtttagaatgttttattgtaacatttaaatatcttatttcctgaaactacattttattctttatcatttatctgtttataccaataattcatattcattaccaaaatttggaaaatgtttgctttttctgatttgtacttttctgtacctgaaatgctattaaccatataaaactacactatgtttaccttgccagatttgtttccataagcccacacttccttctctgaaaagttattt

SEQ ID NO: 147432 - DNA, 601 bp, Human
aatggaacagcactgataaaaacttctgattagaccgggcgcgatggctcacgcctgtaatcccaacactttgggaggccaaggcaggccaaggagaccatcctggccaacatggtgaaactccatctctactaaaaatacaaaaatgatccaggggtggtggcgtgtgcctgtagtcccagctactcagaaggctgaggcaggagaatcacttgaacccgggaggcagaggctgcagtgagccaagatctcgccactatactccagcctgggcgacagaacaaggctccatctcaaaaawaaaaaaaaaacaaaaaaaaaaaaactgctgattaactcaaattagcccaatactatcttgcactagggggaaaaagtttagaatgttttattgtaacatttaaatatcttatttcctgaaactacattttattctttatcatttatctgtttataccaataattcatattcattaccaaaatttggaaaatgtttgctttttctgatttgtacttttctgtacctgaaatgctattaaccatataaaactacactatgtttaccttgccagatttgtttccataagcccacacttccttc

SEQ ID NO: 147433 - DNA, 601 bp, Human
atcaaacttgctgatttaagagacagcattagatctgcataaatgagcttcactccacagatcaaagaaccctccgaaattacataccaaattatgcatgtgtgcttttctcaggaggtcttttaactcttgctagattctcaaaggaaactaagaactcccaaaagaaaaaaaataaactctgagaaggctgagaaggaaagggctcgagttttatcagaaaataaaactgtttctactagccagctccatcagcatttaggagggttagattggagaaattacccaatttctttatttwcttcaaatatttggctggggcaaagatttgacacatggttcaaggtgggaggattgcttgaacccagtagttcaagaccagcctgggcaacgtggcaaaaccctgtctctaccaaaaaaaaattttttttaatttgctgagcatggtggcgcgtgcctgtagtcccagctacggaggcagataaggtgggaggttcacttgggtctgggagattgaggctgcagtaggccatcatcacatccctgcactccagcctgggtgacagagcaagactttatcaaaaggaaaaattagccaggt

SEQ ID NO: 147434 - DNA, 601 bp, Human
gtggctgtattatagataatacagctagatcattttcctgataatgacattttcaccattcctacagagaaaatgtttgaatccagctcattcaaaaatattttgtatgaggccgggcatggtggctcacccctgtaatcccagcactttgggaggccgaggcgggcagactgcctgagctcaggagttcaagatcagcctgggcaacacggagaaaccccgtctctactaaaatacaaaaatcagccgggtgtggccgggtacactggctcacgcctgtaatcccagcactttaggaggstgagacggacggatcacgaggtcaggagatcgagaccatcctggccaacacagtgaaaccccgtctctactaaaaatacaaaaaattagccaggtgtggtggcgggcgcctgtagtcccacgtacccaggaggttgaggcaggagaattgcttgaacccaggaggcggaggctgcggtgagccgagatcacgccactgcactccagcctgggcgacagagtgagactccatctcgaaaacaacaacaacaacaacaaaaactttgaaagaaaaataaggaccttgatgagacactgaagg

SEQ ID NO: 147435 - DNA, 601 bp, Human
tgttcattaaagaaaatacttcaggggtgggcgtggtggctgtattatagataatacagctagatcattttcctgataatgacattttcaccattcctacagagaaaatgtttgaatccagctcattcaaaaatattttgtatgaggccgggcatggtggctcacccctgtaatcccagcactttgggaggccgaggcgggcagactgcctgagctcaggagttcaagatcagcctgggcaacacggagaaaccccgtctctactaaaatacaaaaatcagccgggtgtggccgggtacaytggctcacgcctgtaatcccagcactttaggagggtgagacggacggatcacgaggtcaggagatcgagaccatcctggccaacacagtgaaaccccgtctctactaaaaatacaaaaaattagccaggtgtggtggcgggcgcctgtagtcccacgtacccaggaggttgaggcaggagaattgcttgaacccaggaggcggaggctgcggtgagccgagatcacgccactgcactccagcctgggcgacagagtgagactccatctcgaaaacaacaacaacaacaacaaaaactttg

SEQ ID NO: 147436 - DNA, 601 bp, Human
gggactctgagacaggagaatcacctctgcccaggaggcagaggttgcagtgagcctggctgacagagggagactgtctcacgggggctggggggtgggggaaaggttaaaaataagagaaactgaatgcagggtatgtaagaactcactgtactattctcacagttcttctgtgtatctgaaactcttctaaaaaggtttatttaaaaacaaaaatcctatcacagtcatattgcttccccaatagccatgccatatggcttagaggctgaagagggtagcaggcaacacaataccctcrtctgtgccactgctgcacctgcaagagttaaatataaaccaaactggataacgagaattttgttgtatccatttggcaaatgctcagggcagaagaagagcaaaggtgtcatcctaagggagagatgtagaaataaccagagaagatagcaaaaatacagtattttcctaggggaactatcataccataaatgttcacagcagtctgaaaatcagaaattattctgagctttgtcagtgccaagtaaaagaagaaaaaagaatgaacagaaaaaagaaattagcacagcctaaagtacta

SEQ ID NO: 147437 - DNA, 601 bp, Human
gcatggtggcaggcgcctgtagtcccagctactcgggaggctgaggcaggagaatggcgtgaactcgggaggcagagcttgcagtgacccgagatctcaccactgcactccagcctgggcgacagagcaagacttcgtcaaaaaaaaaaaaaaaaaatttagccaggtgtagtggtgcgtgcctgtaatcccagctactcgggactctgagacaggagaatcacctctgcccaggaggcagaggttgcagtgagcctggctgacagagggagactgtctcacgggggctggggggtggggraaaggttaaaaataagagaaactgaatgcagggtatgtaagaactcactgtactattctcacagttcttctgtgtatctgaaactcttctaaaaaggtttatttaaaaacaaaaatcctatcacagtcatattgcttccccaatagccatgccatatggcttagaggctgaagagggtagcaggcaacacaataccctcatctgtgccactgctgcacctgcaagagttaaatataaaccaaactggataacgagaattttgttgtatccatttggcaaatgctcagggcagaagaagag

SEQ ID NO: 147438 - DNA, 601 bp, Human
taattggccaggcgctgtggctcacgcctgtaatcccagcagcttgggaggccgaggtgggcggatcacgaggtcaggagattgagaccatcctggctaacacggtgaaaccccgtctctactaaaaatacaaaaaattagccgggcgtggtggcatgcaccagtagtcccagctactcgggaggctgaggcagaagaatggcatgaacccgggaggcggagcttgcagtgagccgagattgcgccactacactccagtctcggcgacagagcgagattccgtctcaaaaaaaaaaaaaaattacatttaacctcaaattaaataaataaaaggacactgtaatataacatcttcacaatacccaaaatgagtttcaaaggcctgttacttatagcatacctattcaaagtgggagagaggggacctcaccatcttgctcaggctggtctcaaaactcctggactcaagcaatcctcctgcctcggcctcccaaaatgttgggattacagaagttaagtcactgcacccagcgcttaaaactttttcagaatcttcttatatacaaatgagcaaatttctatcttacatattatggctaat

SEQ ID NO: 147439 - DNA, 601 bp, Human
tctaaaaataaaatacatttaattggccaggcgctgtggctcacgcctgtaatcccagcagcttgggaggccgaggtgggcggatcacgaggtcaggagattgagaccatcctggctaacacggtgaaaccccgtctctactaaaaatacaaaaaattagccgggcgtggtggcatgcaccagtagtcccagctactcgggaggctgaggcagaagaatggcatgaacccgggaggcggagcttgcagtgagccgagattgcgccactacactccagtctcggcgacagagcgagattccrtctcaaaaaaaaaaaaaaattacatttaacctcaaattaaataaataaaaggacactgtaatataacatcttcacaatacccaaaatgagtttcaaaggcctgttacttatagcatacctattcaaagtgggagagaggggacctcaccatcttgctcaggctggtctcaaaactcctggactcaagcaatcctcctgcctcggcctcccaaaatgttgggattacagaagttaagtcactgcacccagcgcttaaaactttttcagaatcttcttatatacaaatgagcaaatttctat

SEQ ID NO: 147440 - DNA, 601 bp, Human
taaaggcgtgagccaccgcgcctggccagtttttttcattattactatatttgttatggtgatctgtgatcagtgatctttggtttttctattataattgttttggggcaccacgaattgtgcccatatgagaaagcaagcttaataaacgttgtgtgtgttctgactgctccaccaactgccagttcctgtctgtctccctgattctcaggactcccaattatcctgagacacaacaatactgaaattaagtcaaataataaccctagaatggcctctaaatgttcaagtggtctcactytaaatcaaacgctagaaacgattaagattagtggacacctggccaagaaattttaaaagttagccaggcgcaatggcgtgcacctgtagtcccaactacttgggaggctgaggcaggaggatcacctaagcccaggaggctgaggctgcagtgagctataaccacaccactgcactccagtctaggtgacagagcaagaccctgtctgtaaagaaaaaaataggccgggcgcggtggctcacgcctgtaatcccagcactttgggaggccgaggcgggcggatcacgaggtcaggagatc

SEQ ID NO: 147441 - DNA, 601 bp, Human
tcacaggcacatcttgttttaatgcacttcagttactgtgtttttaacaaattgaaggttcatcaagcaagtctatcagtgccatttttccaacatcatgtgctcacttgatgtctctgtgtcatatttcggtaattctcacagtatttcttcttttttttttttttttttttttggacatagagtctcgctctgtcacccagactggagtgcagtggcacaatctcagctcactgcaacctccacctcctaggtttgagagattctcatgcctcagcctcccaaatagctgcaactacargcaaatgccaccatgtctggctaatttttgtattcttttagtagatacaggttttcaccacgtggaccaggctggtctcaaactcctgacctcaagtgatccacccatctcagcctcccaaagtgacaggataaaggcgtgagccaccgcgcctggccagtttttttcattattactatatttgttatggtgatctgtgatcagtgatctttggtttttctattataattgttttggggcaccacgaattgtgcccatatgagaaagcaagcttaataaacgttgtgtgtgttctgactg

SEQ ID NO: 147442 - DNA, 601 bp, Human
ccttccattctctcaggctcataccaatccgtccagtgcaactgcctttctcaaagtaccattcacctctagtggtcactcatcagtccttatcttacccaaactcttttttgacacagctgatctctcttcccttgaagctttcttcacttggcttaaaggccacagcattctggtttgcctcctctgacacctcactgacgccgctcacactccttcactagcttctggttacttatctggcttcttaatgccagtgtgtcccaagacttagtcctcaatcttcttcacctatctacakttactcccttattgagcccatccaacttcatagtttatatgcaatccatatgctaacaatttcccactttatatctctaagctaaacctcctcactgaattccagatcaaatatagtaagctgcctatgtgacttctctacttcagtgtctaatagacaaatcaaaagtagcatattcaaaaccaagcccctgattatctctccttgtcctgcgtctttcttttccatttcagttaatgtcaactccatcctttcagatgttcaggccaaaaaccctgaaatcatccttgacacattctc

SEQ ID NO: 147443 - DNA, 601 bp, Human
cttcaaaaccataacatgaatataacaaaattacaatgtttctgattagaactatgaaaatcttgtctttccagggtgagttttaagttgatattctgtgtgagtagcacctttggtgcccagtgtctttacaaaaaaaaaaaaaaaaaaagatggcataactagaaattactgactgagccatctggctcaaatgaaaagccagtattttcagagtattagtcacacactgaaagaagctggtcatgcaaatcacattgtaactttataaatattacaaacttaacaatttcagtcaacrcttactgggtactatgttctgtaatcatccctttataaagtattaaacttaatactcacaaaaatcatgagataagtatgaaaatgttccccattttacccagacatatcgtctaacctgaatctctgccgatgtatttacttctctaccttctctcatgttactctggatcaactgcccttgctcctaataaggcttccaaactggccagtaattagatctgatctcattcttcccactcagatgtcctcaaagacactgctccagaaattcctaccctctcctgtgtcatcggttctt

SEQ ID NO: 147444 - DNA, 601 bp, Human
aagtacaatggtgcaaggctcactgcaacctccacctcccaggttcaagtgattctcctgcctcagcctccaaagtagctgggattacaggcatgcaccaccacacccagctaatttttgtatttttagtagaggggaggtttcatcattttggccaggctgggattacatgtgagccaccgcacccagccagaacaaaaatttcaaagaaatctaagaaaaacttttaggcagaagtaagaatataagagtatcatttcctgaaagatcaaatacataaacgacaaaatggctgaacatrtgaaagaatgagatcaagtctctatgcaacagttataaaaactgatcatcaatttaggccattaacacctcaaaaatttcaggaaagtagaaatagtctatacaatctgacaatgaaacaattaagctactccccttaatgcagtagacttgacatttatgtactctctctccttaaattacttcaagtaattgaatggagtaatgtaaatcaaaatcaatagagattacctagaaaataacaatgataaaaactgcccatataaaaatctctggtacgactgggcctagcggctcacac

SEQ ID NO: 147445 - DNA, 601 bp, Human
aataaatgagacaagttgaaagagcaactcacagacataaatatataaaattgaatgaagtactgaagccactggcaaaatgaaaaccccatcatatataggaagtagtcaacctgatactgatgaaaacaaacatgatatcaaacaaaatctcaagaaaatcacatcgagcacagcagaaaagaacaaaggaagcatttagaaaagtaatgaaatggaagacaggaaatgaagataaacaatcataaaactgatgtttcttgagtaaagaaaaataaaaatgaatgcatattaaaaggtrtataagaaaatattcctgaatctgcagtttgaatggcttaccatttaacaggaaaatgtaagagaatcacaccaagaccgagttatatcctgatgaagttactgaacttcaaggataaagaaagaattctagcaatactcaggcagaagtaggtcacctacaaagggaaaaaaacagtcaggctggccccagacttctctagagtaaccctagatgccagaagataatggaatagtgtctgctgggtattaagagaaagggaaacgtaacccaaaaattctgtaaccagccaaaacatca

SEQ ID NO: 147446 - DNA, 601 bp, Human
cagtataactttttcttactatcctgactagtccattgccattaggcttttttaaaggtatgcttttttttttttagatttatagtaacgtcagtaaggttctcttagactaaaactaaataaggactaaactatcaccagtagcagttcctaatcgaattaagccaaacagtgagaaattccctgatgacaattcatgactcaccaggagaaagcttaagtatcgtgctctttgagtggaaagactagcttagctagactacccagagccatgagttattgcatctacaaagttttacaygtatgacgtaaaagactagtttagctagaccacccagagccatgagtcatgcatctacgaagttttacatgtatgaagtacattcatggaagtgtctaacaatttaacaccatctatagtatggggcaacaggagacatggggacagcaacaatcgaaaatctaaatgatccacagatttttaacacaagccaaagcctaattgtttctaaatcaactgccgccaagtttctcccaggcacttttccatacgccactccaaattcaaagctatcttcacattttgcatactcttatttga

SEQ ID NO: 147447 - DNA, 601 bp, Human
aagtttatctgtgtgaggtaccaagaacccataaaacaaccctgaagttatttatacatttattcaaacttataaaagaaacctaagcacgtagaaaattggaatgtagctaagtttttttcaaaaacaaattaggaaattattgactgccacttgatgggcttctgtgctgcactaacaacatgacaatggtgggcggggcgcggtggctcacgcctgtaatccccgcactttgggaggccggggcgggcagatcacgaggtcaggagatcaagaccatcctggctaacatggtgaaacyccgtctctactaaaaatacaaagaattagccaaggatacaaaaaattagccaggcgtggtggcggacgcctgtagtcccagctactcaggaggctgaggcaggagaatggcgtgaacccgggaggtggagcttcagtgagcagagatcgcgccatgcactccagcctgggtgacagagagagactccgtctcaaaaagaaaaaaaaaaaaaaaaagacacttctgtaatcctagcactttggaaggccgaggcaggcggattgcctgagctcaggagttcaagaccagcctgggcaacat

SEQ ID NO: 147448 - DNA, 601 bp, Human
ttcttgaaaacaagaacaaagttggagaactcacatgtcctgattccaaggcttactacaaaacgacaataatcaaaacactgtggtattggcaaaaagacagacataatatacaccaatgaaacaaaataagagcctagaaataaaacccttgcatatatggccaactgattttcaacaaggttgactagaccgctcaatgaggaaagaaaatctttcaataaacaacactagggaaactgggtatccataagcaaaagaatgaaggtggattctttccttacatgatatgcaaaaaatwactctaaatgaactgaaaacttaaacgtaagagctaaaactttaaaactctcaggcgaaaaaataagagaaaatcttcaagacattggatttagcaacaaactcttggacatgacaccaagagcaatagagacaaaagaaaaaataaatgatctggatcaaaatttaaaactttagttcatcaaaagcaacccccaaaaaaatgggaaaaatattgtaaatcacctatctgataaaggattaatatccagaatacaaaaagaactcatacaactcaataacaacaagaaaaccaatgcaa

SEQ ID NO: 147449 - DNA, 601 bp, Human
atcccaacaacttttggaaaacccatcctaaaattcacaccccaaattgccgaaacattcttgaaaacaagaacaaagttggagaactcacatgtcctgattccaaggcttactacaaaacgacaataatcaaaacactgtggtattggcaaaaagacagacataatatacaccaatgaaacaaaataagagcctagaaataaaacccttgcatatatggccaactgattttcaacaaggttgactagaccgctcaatgaggaaagaaaatctttcaataaacaacactagggaaactggrtatccataagcaaaagaatgaaggtggattctttccttacatgatatgcaaaaaataactctaaatgaactgaaaacttaaacgtaagagctaaaactttaaaactctcaggcgaaaaaataagagaaaatcttcaagacattggatttagcaacaaactcttggacatgacaccaagagcaatagagacaaaagaaaaaataaatgatctggatcaaaatttaaaactttagttcatcaaaagcaacccccaaaaaaatgggaaaaatattgtaaatcacctatctgataaaggattaa

SEQ ID NO: 147450 - DNA, 601 bp, Human
gaaaacgtgtcaggctaacattgcttttatatttaaaaaattgagcgatgttaagctaaagcctttgctgatatactctgaaaacccaacaatacttaagagcaacctgtaaaacaaaagtaaggactcatcacaacctatgagattaaatatcaattactgatgccgtttctgatgcaggatgatgatgaagacaaaactcctttaattaaggattttaaggaagaacctaagaaggcatacgaattcatcaaaatgaaaatgaattaatcagataagaaactagtccctttcaatttaytgctgacctccaaagtttagagaaagtcatctcccaaaggaaaaattattagatcttactaaggagactgggctgagagaacagctttgtcgcccaggctggagtgcagtggcacaatcacagttcactaaagccttgacctcctggactcaggcaatcctcccgagcctcctgagtagctgggtctataggtacatggcaccatgcccaattcatttttatattttttgtagaggcagggtttcaccatgggcatcatggtctcgaagtgggctcaagcaatctgcccacctcggcctc

SEQ ID NO: 147451 - DNA, 601 bp, Human
tgtatcacacataagactgtttctatgcaacagaaatacaaatggaaggcaatgttgatgtctaacagttacggtaatacttcatacaaaaatgtataaccaccagcagcatggaaccaccgagcactgtggcaacagcaatgtgcatttcatatctccgaagtgatggaggtgaaaggagagaaacaggagaatttggtgagcagctcagttgcaaagcaagccctgaattgtttgagaggtttaagaacagtacataaatgcataacattaaatatcactgataaataaattagcttcygctgatagcgagactgcaacaaactttcccccaatgaattgcagaaaactattaataaaggagaaatattggaaagcaaatttataactgacaaaaatagacctttcttaaagaatgccatcttgtgctttggtaagaaatttaaaaagaaaacgtgtcaggctaacattgcttttatatttaaaaaattgagcgatgttaagctaaagcctttgctgatatactctgaaaacccaacaatacttaagagcaacctgtaaaacaaaagtaaggactcatcacaacctatgagattaaata

SEQ ID NO: 147452 - DNA, 601 bp, Human
tatgtgcttcttctccttataatcacattagcaaaagaagagagccctgctgcatgatcagaaatgttgtgcatgaaatataacttctactgaaaggcatcttgtacatgatcttctccacattaagtaaaaatggcttctaagaaaatggggtgtcctgggaaaatacaggtgaacctatgtaagaggcctaggaaagtacaaacactgaaagaaaaaattggaagtaatgcatttatttaaaggcaagggaaccaaaagctgagcccctgactttaagtatatcccctgtatcacacakaagactgtttctatgcaacagaaatacaaatggaaggcaatgttgatgtctaacagttacggtaatacttcatacaaaaatgtataaccaccagcagcatggaaccaccgagcactgtggcaacagcaatgtgcatttcatatctccgaagtgatggaggtgaaaggagagaaacaggagaatttggtgagcagctcagttgcaaagcaagccctgaattgtttgagaggtttaagaacagtacataaatgcataacattaaatatcactgataaataaattagcttctgctgatagcga

SEQ ID NO: 147453 - DNA, 601 bp, Human
gtcttgaactcctgagctcgccccccaaccctgcccacccaagtgccgggattacaggtgaacccagccaatttgcccaatgtttgttgctattacttagagtctaagggatgaaggcaatatttacatttaaacccctaattttcctaggctattagtgtgcgattcaaatgtgtgtctataaagtttattataattaaagcaaaagtttgaaatttgaaaattagcaacataatttttcttttttatattttgattggactaagtgtggtatgaaactcaaaagccaaacaagtcagartgacagctttgtctacattttgaaatgcaacaatctgaatgacaggtttctaacatatgaccaagtattaaactacttttaatggaagtataagaagtggattcacataaaatgcacaaagttaaaaactggaacaggtaatacaaatacaagatgttctactcacaaacacatattaagatggtgttgattcctcattcctctaagtagtctccacccacttcttgacataagaaagaaagaataatgtaagcagcagaccatgccaggtccaatccaagatttcttccaaaggggaac

SEQ ID NO: 147454 - DNA, 601 bp, Human
taaactataaactgaactgtaagtcaaaggaacatatatatcaagccacaaaatgtttacttcaatgtattatcccagaaacactgtaggcaactatttccctacagccttgctaacactgggcatccttctgccactggcaatttatctttggtgcatttacatatttttattcccccaccccgttttttttacattgagtgattctcttttttctgattatttggatgggctttttaagcattgtggccttctttctttttttggagacagagtttcactctgtggcccaggctggagygcagtagtgtgttcatggctcactgcaacctccgcctcctgggctcaagcaatcctcccacctcagcctcctgagtagctgggaccacaggcacaaaccaccatgtctgtcttttttttgtatttttggtagagacaaggtcttcctacgttgcccagactggtcttgaactcctgagctcgccccccaaccctgcccacccaagtgccgggattacaggtgaacccagccaatttgcccaatgtttgttgctattacttagagtctaagggatgaaggcaatatttacatttaaacccc

SEQ ID NO: 147455 - DNA, 601 bp, Human
actccagcctgaacaatagaggaagaccccatcttaaaaaaaaattaatttaaaaagaatactttgcactctccttgtacatctgtggaagtatatctagaatataaactataaactgaactgtaagtcaaaggaacatatatatcaagccacaaaatgtttacttcaatgtattatcccagaaacactgtaggcaactatttccctacagccttgctaacactgggcatccttctgccactggcaatttatctttggtgcatttacatatttttattcccccaccccgttttttttacaytgagtgattctcttttttctgattatttggatgggctttttaagcattgtggccttctttctttttttggagacagagtttcactctgtggcccaggctggagcgcagtagtgtgttcatggctcactgcaacctccgcctcctgggctcaagcaatcctcccacctcagcctcctgagtagctgggaccacaggcacaaaccaccatgtctgtcttttttttgtatttttggtagagacaaggtcttcctacgttgcccagactggtcttgaactcctgagctcgccccccaaccctgc

SEQ ID NO: 147456 - DNA, 601 bp, Human
tctctgccaagatttgtcgcagcaggaactcctcacaataccgaaattatgccctaacactagtttatagtgtcacacaaacagcttactttgatctcgcctattttatagaaataaatttgataaagatgattcctgaggatttctgaatgtcacttcacaatggaaaatttgggcacagcatatgatattatgtattactagcctgggcaacttaaacagatcatttctattttttgagtctcattttccttatcagtaaaggatggtaaagcccttggtaacgttgcaacacggagargatattgtatatgcgaaagtctgacccagcttaaggtacaataaatgttagttgtccattttcttcctttaaaattgctcattaattaggctacaggacataaaaggaatacgtctgtattcttcagaatcctgagaacaagcccatacctgaattatttcttttggaaaatactacccagcttcaaacctcacgcccaactatgtttctagtaggactgccaaacaaggcccccggtaccccaaggccacaggagggagtggtttttcagagttgggaagctgtgccataaaggcctga

SEQ ID NO: 147457 - DNA, 601 bp, Human
atatgcttcccaaagggatttgcttggcagaattctggaccacattcctaaaataacacttactgacattctgctacctgtaatatttcaccctgcttatcacagcttcttcaatcacaggcgtcagggttcttcaatattaagtcctaagtacgttgttgcttgtgcataaattatacacaatagcataagcatgcatctctgccaagatttgtcgcagcaggaactcctcacaataccgaaattatgccctaacactagtttatagtgtcacacaaacagcttactttgatctcgcctrttttatagaaataaatttgataaagatgattcctgaggatttctgaatgtcacttcacaatggaaaatttgggcacagcatatgatattatgtattactagcctgggcaacttaaacagatcatttctattttttgagtctcattttccttatcagtaaaggatggtaaagcccttggtaacgttgcaacacggagaagatattgtatatgcgaaagtctgacccagcttaaggtacaataaatgttagttgtccattttcttcctttaaaattgctcattaattaggctacaggacata

SEQ ID NO: 147458 - DNA, 545 bp, Human
ctgggcgaaagagcgagactccatctcaaaaaaacaaaaaacaaaaaacaaaaacaaacaaacaaaaaaacagaagaaaagaggctcctttttttttttttttttcctccctgagacggagtctcgctctgtagcccaggctggagtgcagtggcgcgatctcagctcactacaagctccacctcctgggttcacgccattctcctgcctcagcctctccgagtagctgggactacaggcgcccrccaccacgcccggctaattttttatatatatatgtttttagtagagacggggtttcaccgtggtctcgatctcctgatctcgtgatccgcccacctcggcctctcaaagtgctgggattacaagcgtgagccaccgcctaagtgtactttgccaagaccaattgttggctaagtctaacttctacaaagccaaatacaaactgaggtttacagcctagtaacgattttcctttgtgtctgggtgactgtggtctcctgctccgggaatgtgagttcctgtcaagtttatttatacaacac

SEQ ID NO: 147459 - DNA, 601 bp, Human
cacctcacaaacctaacctgtttgagcccctaagtacaataactaattcacaaagaacagaaacagagaaacatgttcaaggacatccctgggacacaattagcaagatctactctgcaggatattctaaagaacaagacctagaatcttcagcaaatatactgcaaggagcacaaaagagagaaatgaattcaaactttttttaaatttatgacgattatgacacaaatgaaaatgtgaagagtaatgagacattagacaatatccagaaattgttgtttcctttttgagtttggcagtrgtgttgtgctgggggttttcttaccatttttagagatacatactgaaatatttacagacaaatgatcatgtttagaatgtacttcacagtcattagggagagggctaagataggtgaaacgaggctgatccatgacctaatcacttcaggggctgggggagtacatggaggcccattatacctatctgtctactttggtattattgggcatttaaaattttcctcaaaagatttttttaatctaaaaataagtttaatatagcctaaaataatgttttcagtattgtcgatcattatgta

SEQ ID NO: 147460 - DNA, 601 bp, Human
gcaataaagtctaaatacaaatgactgggaaagaatatttgcaaaatagggagaagtttaaaattcctaatacaaacagagcttctgtaaatcaaaagggaaactaaaacccaaaagtgaccatgcttgaccttctacttatattcctaaggtattaggagttttgagaatgccaaagatgaagataacatcttttctgaatgctatctagagataaaattaagagttggaaagggctagaaagacctctctttctcacaaaagtcatgactgctaaaacacaaaagtttatagttctaawggaggcaaaactaaccaacagtattacaaatcaggacgatagtatttctctctctctctctctctgtcttttggagcaggaagtgagagtagtatctgggaagaggcatggaacggacttctggtgtactggtagaggcatgccgtccgtaatatgtgcgtactttcctgtcaatgttatacttcaatttttaaaactcagtaaatcctggagtatccagtgactgttaaatgggagttatgcttgcatgctatgaatctggaaatcactgtgggccagagtggtctacaagccatgaat

SEQ ID NO: 147461 - DNA, 601 bp, Human
caatttgagtggaggtggtcctcctatgcaggacacaaaactcaacagtcaaataatgctacacaaaatactttaaggttagtacagcaataaagtctaaatacaaatgactgggaaagaatatttgcaaaatagggagaagtttaaaattcctaatacaaacagagcttctgtaaatcaaaagggaaactaaaacccaaaagtgaccatgcttgaccttctacttatattcctaaggtattaggagttttgagaatgccaaagatgaagataacatcttttctgaatgctatctagagayaaaattaagagttggaaagggctagaaagacctctctttctcacaaaagtcatgactgctaaaacacaaaagtttatagttctaaaggaggcaaaactaaccaacagtattacaaatcaggacgatagtatttctctctctctctctctctgtcttttggagcaggaagtgagagtagtatctgggaagaggcatggaacggacttctggtgtactggtagaggcatgccgtccgtaatatgtgcgtactttcctgtcaatgttatacttcaatttttaaaactcagtaaatcctggagt

SEQ ID NO: 147462 - DNA, 601 bp, Human
tattaaatgccttttgttagggacaaaaaatacattgctttaaaaagaaatctactgggcacggtggctcccgcctgtaatcccgacactttgggatgccaaggcgggtggatcatctgaggtgaggagttcgagaccagcctggctaacacagtgaaacctcatctccactaaaaatacaaaaattagccgggtggtggtgggcgcctgtagtcccagctacttgggaggcaggagaatcgcttgaacccaggaggcggaggtcaccgagatcatgccactgcactccagcctgggcaayagagtgaaactccgactcaaaaaaaagaaagaaaaaaaaatctgagctgacgatagagacttcagggttatcagaatatggctgatcactgaggttgtaagttgatgcatcacccaaggataagcattaatataaactgcaggggatgtaaccgaatgaattctagaaaatattaacaactgagaaacaaaaaacaggaggcggcacaaggtaaactgagaaaggtaagccagtgaaatagggaggccgaggcaggcggatcacgaggtcaagagatcgagaccatcctggctaacacgg

SEQ ID NO: 147463 - DNA, 601 bp, Human
ccgctgtaatcccaaaactttgggaggctgaggtgggcagatcgtttgagcccaggagtttgatgccagcctgggcaacatggcaaacccctgtctctaccaaaaaaaagaaacaaaaaagtacaaaaattagccaggcacagtgatgtgcacctacagtcccagctactcggggaggctgaggtgggaagatgacttgagcccaggaggcggaggttgcagtgacctcagatgacaccagggcactccagcctgggcaacagagccagaccttgtctcagtttaaaaaataatttttttwaaaaaaagtaaaatgacatatgattaaaaagttgagcagagttaccatatgacccagcaattccacttctaggtatataccctaacatctgtccacacagcaagttgtacatgaatgtctgtagtagcatttgctgtaataatcaaaaggcagaaactcaaatgtccatcgacaaatgaataaactgcagtatatacatacaatgaaatactattcagccacagaaagaaatgaagtactaatatatgaagctcagtaacatcaggctaagttaaagaagcagacatataaagtcacatg

SEQ ID NO: 147464 - DNA, 601 bp, Human
ttttaaacaatggagtgacctcatgagatttacatttgcaaaaaccaatcttgtagtatgtagaagattgtttaaaaaggcatgatgagaacaaagaaacaaaaagcaagcaattcaagtaatcttgaaaagtgtacctcgagtatatagtagtcgaaacaatgaagaaaacaaggctatttagaagagaatcaatcaacctaacctggtgatgttaaagaagtggggcttaaagtagtaagtcaaaaatgacatgagctgggcatggtggctcaccgctgtaatcccaaaactttgggargctgaggtgggcagatcgtttgagcccaggagtttgatgccagcctgggcaacatggcaaacccctgtctctaccaaaaaaaagaaacaaaaaagtacaaaaattagccaggcacagtgatgtgcacctacagtcccagctactcggggaggctgaggtgggaagatgacttgagcccaggaggcggaggttgcagtgacctcagatgacaccagggcactccagcctgggcaacagagccagaccttgtctcagtttaaaaaataattttttttaaaaaaagtaaaatgacatatgatt

SEQ ID NO: 147465 - DNA, 601 bp, Human
ctgatctcatttccaacctttttctagagaaacaccattacattactcggaccattttctacaacactgtacacaagagtcttgtgaaagattctataatatatccagaaatcacctagttgttgcattttccaccagaagtccagggtttataaacataggtgagtaagctctgaaattagtatacatggtcaaaattacccttgaaaatttccttacactttccataaagcatatcattgcttcttactcttgtcaaaacccccaagttcttgaaatcttttgcccattctttccatgyatttcttctacaggcataattgtgtcctttgcttgttccatgtaagtaatacaaaagcaatgttgaaaaatgtccaatgtctcacttttgtcatggcttcagcccccagcatgaatcttcctaggtctagatgcatgaatatttaacaggcttaatccatttaaagtgatagaaccttaccatgccttcatgaatgcttccttcaaggtctctatcaatactagccccctccatgaagtcttccctaaataatttatcaaataatcttttggcttctgctaaattcctattaattgtact

SEQ ID NO: 147466 - DNA, 601 bp, Human
ttcttttcttgaaatgtgaggggagatttttataagtctaacatttttgcataacaggcaaactagacttttacaaatagttaaaatcagctctgtatttcaaaacacaagaaatgtacttttactttaaagtggctaatctaaaatactttttaaagatattgaaagtgcaaacacattaagaagggaacagcattttcactgttattttgtttatgcacgcatatgtgtactgagcgccaactatgttgcagacattctattaaaaaacagaaagtcccactttcctgtcaactgaggracagagtgcagcacacacaaatgcactgtgaggagttattttctacatgactgatctcatttccaacctttttctagagaaacaccattacattactcggaccattttctacaacactgtacacaagagtcttgtgaaagattctataatatatccagaaatcacctagttgttgcattttccaccagaagtccagggtttataaacataggtgagtaagctctgaaattagtatacatggtcaaaattacccttgaaaatttccttacactttccataaagcatatcattgcttcttac

SEQ ID NO: 147467 - DNA, 601 bp, Human
ctgtaatctcaacgctttcaggaagccaagatgggtggatcacttgaggtcaggagttcaagaccagcctggccaacatggtgaaaccctgtctttagtaaaaatacaaaaattggccgggcatggaggcggacatctgtaatcccagctactcagaaggctgagacaggaggatcacttgaactggaaggcagaggctgcagtgagccaagaccatgccactgtattccagcctgggtgacaatgcgagactccgtctcaaaaataaaaataaaaaatttatgtttaaacatgaagtgcwtcttttcttgaaatgtgaggggagatttttataagtctaacatttttgcataacaggcaaactagacttttacaaatagttaaaatcagctctgtatttcaaaacacaagaaatgtacttttactttaaagtggctaatctaaaatactttttaaagatattgaaagtgcaaacacattaagaagggaacagcattttcactgttattttgtttatgcacgcatatgtgtactgagcgccaactatgttgcagacattctattaaaaaacagaaagtcccactttcctgtcaactgaggg

SEQ ID NO: 147468 - DNA, 601 bp, Human
taaacaactttaatgaggtataactgacattcagtgaactgcacatacttaaattatacaatttggccgggcgtggtggctcacacctgtaatcccagcactttgggaggccgaggcaggtggaccacctgaggtcgagagtttgagaccagcctgaccaacatggagaaacgccgtctctattaaaaatacaaaattagctgggcgtagtggcacatgcctgtaatcccagttacttgggaggctgaggcagaaaaactgattgaacccaggaggcagaggttgtggtgagccaagatcrcgccattgcactccagcccgggcaacaagggcaaaactctgtctcaaaaaatatataaataaataaattagctgggcatggtggtgtgtgcctgtaatcccagttactcagaaggctaaggcaggagaactgcttgaacccgggaggcaaatgttgcatcaagccaagatcacgccattgcactccagcctgggtaacagagcaagactccatctcaaaaagaaaaaaaacacacacacacaatttaataagtactgatatacaccagaggaaccaacacaacaacaatcacaatagtga

SEQ ID NO: 147469 - DNA, 601 bp, Human
gctcaagcgatccacccttggcctcccaaagtgtagggattatagacgtgagccactgtatccaccctaaacttccgtactacaaacctattgccacttctacctgaaattttaatttctgtggatatgagtggttatccatactgtttgataatcagtctgaaaacagttggtataccacaccagtttcagaatgtacatttcatagaaaggccttagggactactgcactggaaagactcattaataaaaataaaaatgtaatgctatataaatatgagtatgactgaattaagacttstggcaactataggagtctcaaagtaatccttgaacggtcggtaccagttatcaatcacatagactgaaaagagagtggagcgccctctagtgactacatgagggctaatgatggcacagagagataatcacagcagcttttacagaattttggtacagtatttctattatctaattataaagtggtgaattaatcacttaggtctgggtaccatctgagcctatactaatttattttcaatcctataacacccctccccccagcacaagcctctacttcccttcacaggcagttatttaa

SEQ ID NO: 147470 - DNA, 601 bp, Human
aacatgaacttcgtgagttggctgtattctaagattgaagcttcgtggggttctgctggtcacacaacccctggggtcacacttaagattgggggtataaaatgtattctttcactaatctgtgccttccttggctcttgcttacttagatgtgagagcagagagaatccttcataaagaacaacaacaacaaaaaaaggggggggaagtttttacattaactgatgtaaaggatttctccttacccctgtggctcatatttatcatctgtgtctgctattgtgttgccatgttccctttyattggacttgggaaagttttctttacagacaaatttggattttctttccaggcagcaagtgcaatgaacagtgttgtatatgtcgttatcagctcccacaccccagtatttgggctcccagtggatgacacggggaagaacagcatctgggttctgcgtgtggttgcagccactcttgtgtcccacatgatgctggcctttatgatgtggagcccttgggttgctgtgtcttctgggaatctcctattcatcgcttgcctgtgcattttggccaacagtggcatctgtagttcctgaaca

SEQ ID NO: 147471 - DNA, 601 bp, Human
aggcagaggttgcaatgagccaagattgtgccactgcactccagcctgggccacaaagcaagactctgtctccaaaaataataataataaataaataaataaaataaaatttaaaaaggcaccaattaattcaaaatatctttcattacatattatcttcatcacagatactatagtataagtactatcatgatattaaaaagaggtatgtaggccgggcacggtggctcacacctgtaatcccagcactttgggaggctgaggcgggtagatcatgaggtcaggagttcaagaccagcakggccgagatggtgaaatcccatctctactaaaaactacaaaaattagccaggcatggtgacaggtgcccataatcccagctactcaggaagctgaggtaggagaatcacttgaacccaggcggcggaggttgcagtgagcaacagagtcagactctgttttcaaaaaaaaaaaaaagagagagagagatatgtaaccagcagtttcacatttgaaagtgtttaaaaacccaggcctagttcaatttttttccatgaggcctccattactgtttttgagttaaattataaaaatcttacaa

SEQ ID NO: 147472 - DNA, 601 bp, Human
tatggtgaaacgccgtctctactaaaaatgcaaaaattagccaggcgtggtggcaggtgcctgtaatcccatctactcaggaggctgaagcaggagaatggcttgagcctgggaggcagaggttgcaatgagccaagattgtgccactgcactccagcctgggccacaaagcaagactctgtctccaaaaataataataataaataaataaataaaataaaatttaaaaaggcaccaattaattcaaaatatctttcattacatattatcttcatcacagatactatagtataagtactaycatgatattaaaaagaggtatgtaggccgggcacggtggctcacacctgtaatcccagcactttgggaggctgaggcgggtagatcatgaggtcaggagttcaagaccagcatggccgagatggtgaaatcccatctctactaaaaactacaaaaattagccaggcatggtgacaggtgcccataatcccagctactcaggaagctgaggtaggagaatcacttgaacccaggcggcggaggttgcagtgagcaacagagtcagactctgttttcaaaaaaaaaaaaaagagagagagag

SEQ ID NO: 147473 - DNA, 601 bp, Human
tttcactctatctgaaaatggccttgcccactctgaagcaaccatagcatttctgagtttttctcctatctgtggacccctcttcttctattttacctgtggaaattctacctgcccctcccctcttttcctttttttagtttttttttttttttggagatggagtcttgctctgtcgcccaggctggagtgcagtggcgtgatctcggctcactgcaagctctgcctcccgggttgaagagattctcctgcctcagcctcccaagtacctaggattacaagcgcacaccaccacgtcccrctaatttttgtatctttagtagagacggggtttcactatgttggccaggctggtcttgaactcctgaccttctgagccaccgcacctggcctacctgcttttttttttttgatgcttaactaactagtacccaacttgtgcgtgcaaacttctaccgagcagccaagttagcaaagagaaagcccaaaacccatagagtagaataacactgtagactacacattaacatgtcacatatccactatttttcaaatatagaaagatgtgactgtggccaggcaaggtggctcacgcctgtaa

SEQ ID NO: 147474 - DNA, 601 bp, Human
ttgttaacaaaaatagaaaacagagtttatcacaagtagtttcagttatataatctatgtatgtgttttattcactaatctatatatacatatgtatgcactgcgtcatgatgtaaagtatttctaattatgggtttgaaagccacaattacagaaaacagccaaacatggtggcgtgcacctgtaatcccagctacttgggaggctgaggtaggagaattgttggaacctgggaggtggagggtgcagtgagccaagattgtgccactgcactccagcgtgggtgccagagtgagactcygtctcaacaacaacaaaaaaagagtcaatgtaaaaggacatcaaagccactgccacaaagcccctgcacttgattctactggcagccacttgccacttgattccttgacaacattaagtcagctttcccacgtcacttacttttgattggttacattcactaaaaagcttcataatagctgactggaatcctcatcatgaaaaactgacttagaccctctaaattgttttcaatctctaaaatgtcaaccaaattcaactaaaagagtagccctaaaaatttaaagcacacaattttcac

SEQ ID NO: 147475 - DNA, 601 bp, Human
gaatagctgttgtgaagagtgcattacaccaaaaagagttaagtctttatctactgatcctgttgctctgtgtaagttagtgccaaaatgggtcttaggatatactgattacatggactagtttttcaaacagggctgcaaaagcaatttaatgagtcactatcaaagtttttttgttaacaaaaatagaaaacagagtttatcacaagtagtttcagttatataatctatgtatgtgttttattcactaatctatatatacatatgtatgcactgcgtcatgatgtaaagtatttctaaytatgggtttgaaagccacaattacagaaaacagccaaacatggtggcgtgcacctgtaatcccagctacttgggaggctgaggtaggagaattgttggaacctgggaggtggagggtgcagtgagccaagattgtgccactgcactccagcgtgggtgccagagtgagactctgtctcaacaacaacaaaaaaagagtcaatgtaaaaggacatcaaagccactgccacaaagcccctgcacttgattctactggcagccacttgccacttgattccttgacaacattaagtcagctttc

SEQ ID NO: 147476 - DNA, 601 bp, Human
agggcttgagggaatagagactggaatagctgttgtgaagagtgcattacaccaaaaagagttaagtctttatctactgatcctgttgctctgtgtaagttagtgccaaaatgggtcttaggatatactgattacatggactagtttttcaaacagggctgcaaaagcaatttaatgagtcactatcaaagtttttttgttaacaaaaatagaaaacagagtttatcacaagtagtttcagttatataatctatgtatgtgttttattcactaatctatatatacatatgtatgcactgcrtcatgatgtaaagtatttctaattatgggtttgaaagccacaattacagaaaacagccaaacatggtggcgtgcacctgtaatcccagctacttgggaggctgaggtaggagaattgttggaacctgggaggtggagggtgcagtgagccaagattgtgccactgcactccagcgtgggtgccagagtgagactctgtctcaacaacaacaaaaaaagagtcaatgtaaaaggacatcaaagccactgccacaaagcccctgcacttgattctactggcagccacttgccacttgattcc

SEQ ID NO: 147477 - DNA, 601 bp, Human
tctgaataattaggaaatgccacaggactcagagtataaagtcagtgaccttgataatacaatttttttagtaaaaagcaataggaaaaaaagctgtaaagggttaaagaacagggtagtaaagtacttaagcataataaacaggacaatttatacaaaaaatttaacagttgaagatagtaactagatggggaaactgtacaaaacaagcgctttaaaagagatattcgaagaaatgtagaaatgaagtaaggcccaccatagcgccttacttttcacaactgatgaggttatctattgwaaggaagaagcatgagggcttgagggaatagagactggaatagctgttgtgaagagtgcattacaccaaaaagagttaagtctttatctactgatcctgttgctctgtgtaagttagtgccaaaatgggtcttaggatatactgattacatggactagtttttcaaacagggctgcaaaagcaatttaatgagtcactatcaaagtttttttgttaacaaaaatagaaaacagagtttatcacaagtagtttcagttatataatctatgtatgtgttttattcactaatctatatataca

SEQ ID NO: 147478 - DNA, 601 bp, Human
ccaaaagttcagagagactgttttataaatatagcttatctggcctaaactttggggactttattttactttatagagaattttttttttaatttttaaataagacgtagttattgggggcttatatacaggggagagagtccagtggcagctggctaggcaggagaactgccaccgtgtggatttgaagtggtagctcttctttaagtaaaaaaagtcaatgtcatcactacgtgcacagccatactagatgctttccaggcttaaaaaatgtaatatgttgtttcatatgacactgccrgtaatcttacacctatgaatacacatagaagagttatccatggtataaaaataatatgaaaaactataagttacagaaccaggtttcataatttctgtgttctttgtaatagccagtgaatcatctaataccttgataattatcccctcaattataggagttctattgatgttatccctcagtaaccatgccctctggtttaaaacacgagtctcaaaccaaactgaaaactaagtaaataaataaaaaataactttttccacatgatctctgtttctccttctcttttttgggacacgg

SEQ ID NO: 147479 - DNA, 601 bp, Human
ctagagttacacagctagtctgtggtgaagccaacattcagaatctgttacatcttcgaaataggtgcaaaacgattgcctattataatcaagtaatgcaagtgaaggtagaagaaactgtcgaaagcctaggaagagataaaagaaaagccaaagcacaagaggcaagtgtcacccattcatgcatgcccgcatcatgcaggaatacggttaatgcattctgccatcaactgttagagatattttcctcttcttactggtaggaaaaatcactatcttttacgatcactgctgccttagrtgcaataaaatacgctaagtcccttggctcccagtagttctccatttgccagttccagtctctcctaatgcccatctggttttcaagccttggcttctattacgtattccatatccttccgataaatccttgtttaacttcattcaatcattcattcctgtctcgctgattccagcttaaactaatctatatgtttctattccctgcacccagaagtcttgatgatgcgaagccaaatgcaaattagtataatagcctaaagagacaactctgattacatagtcaaaataattagaaaag

SEQ ID NO: 147480 - DNA, 601 bp, Human
gatgaaactaagctacctgggccgggcacagtggctcggcccactgtaatgtatggctggcctgtaatcccagcactttgggaggctgaggcgggcggatcacctgaggtcgagaccagcctggccaacatggtgaacccatctctaataaaaatacaagaattagccgggcttggtggcacgcacctgtaatcccagctactcgggaggctgaggcaggtgaattgcttgaacctgggaggcggaggttgcagtgagccactgcactccagcctgggcgacagagtgagactctgtctcaaaaaaaaaaaaaaaaaacccaaaccaaaaccaaacaaacaaaactaagctgcctaaacaatgcatatacttctagctacctcctttttcttgaggccatgcacctaaaattctgaaaaactgatttaccctcatcttctctatttacttactactcaggtattcctttattctcctagaaactggcttctccctagcaggatgctacaactgtgtccacaagtggtctggatagcatatttattctcctgggtactttcagctacctgaagtcacccctctgggccaagacaactaatac

SEQ ID NO: 147481 - DNA, 601 bp, Human
agggccagaataacaccgagggccgggcgtggtggctcacgcctgtaatcccaacagtttgggaggccgaggagggcagatcacctgcggtcaggagtttgaggccagcctggccaacatggagaaatcccatctctactaaaaatacaaaattagctggctgttgtggcacatgcctgtaatcccagctacttgggaggctggggcaggagaattgcttgaagccgggaggcagaggttgccatgagccaacatcacaccactgcagtctagcctgggcaacgggcgaaactccatctcaaaaaaaaaaaaaaaaaaaggaataacatcaaaacttgtaacactacaaaattcagcataaaaatttcatagagtattactattttacaatgttttctgtacttactgtgtaataaggattttttccaagtcatttttctttaaaaacatgctattaaatatgtgtacagaattctaccaccactatataagatccattttcctttttaaaaaaaatcaagttatcactaatccaggatctttacatttttaaccttctcatgtcattttaaacataccatttattttagaatgagaagat

SEQ ID NO: 147482 - DNA, 601 bp, Human
atagaatcagggccagaataacaccgagggccgggcgtggtggctcacgcctgtaatcccaacagtttgggaggccgaggagggcagatcacctgcggtcaggagtttgaggccagcctggccaacatggagaaatcccatctctactaaaaatacaaaattagctggctgttgtggcacatgcctgtaatcccagctacttgggaggctggggcaggagaattgcttgaagccgggaggcagaggttgccatgagccaacatcacaccactgcagtctagcctgggcaacgggcgaaackccatctcaaaaaaaaaaaaaaaaaaaggaataacatcaaaacttgtaacactacaaaattcagcataaaaatttcatagagtattactattttacaatgttttctgtacttactgtgtaataaggattttttccaagtcatttttctttaaaaacatgctattaaatatgtgtacagaattctaccaccactatataagatccattttcctttttaaaaaaaatcaagttatcactaatccaggatctttacatttttaaccttctcatgtcattttaaacataccatttattttagaat

SEQ ID NO: 147483 - DNA, 601 bp, Human
tttactaaaatagaatcagggccagaataacaccgagggccgggcgtggtggctcacgcctgtaatcccaacagtttgggaggccgaggagggcagatcacctgcggtcaggagtttgaggccagcctggccaacatggagaaatcccatctctactaaaaatacaaaattagctggctgttgtggcacatgcctgtaatcccagctacttgggaggctggggcaggagaattgcttgaagccgggaggcagaggttgccatgagccaacatcacaccactgcagtctagcctgggcaacrggcgaaactccatctcaaaaaaaaaaaaaaaaaaaggaataacatcaaaacttgtaacactacaaaattcagcataaaaatttcatagagtattactattttacaatgttttctgtacttactgtgtaataaggattttttccaagtcatttttctttaaaaacatgctattaaatatgtgtacagaattctaccaccactatataagatccattttcctttttaaaaaaaatcaagttatcactaatccaggatctttacatttttaaccttctcatgtcattttaaacataccattta

SEQ ID NO: 147484 - DNA, 601 bp, Human
ttggttttttgagacagggcctcactttgtcacccaggctggagtgtagtggtatgatcacagctctatgcagccttgacctcccaggctcaaacgatcctcctgcctcagccctccaagtagctgggaccatgggcacatggcatgatgcctggctaacctgactttttttttttttttggtagagatgggggtctcactatgttgcccaggctggtctcaaactcctgggctctagtgatcctcccacctcagcctcccaagtagttgggaccataggcacatggcaccattcctggctttttttttttttttttggtagagatatagtcttactatattgcccaggctggtcccaaactgggattacaggaaacagcccctgcgctggccgacaaatactttttcaatgcctactgcatgccaggcacacatctgacagagaagtacagcagtgaatatatgacaggcaaggcccgtgccttcaatgttttatgtatgaggttttctataattaaggttcctcttcccaacccatccctatctgctagtaaaatctatttactaaaatagaatcagggccagaataacaccgagggcc

SEQ ID NO: 147485 - DNA, 601 bp, Human
acttttgaaaattgaaaacttggggataataatatgaacttcagaccaggcattaaattgtcttaggtatgacaatcgcttttgtttttagagtccagatctcggctcactgcaacctctgcctcccaggttgaagtgattctcctgcctcagcctcccgagtagctgggactataggcgcccgccaccacgcccggctaatttttcgtatttttaatggagacggggtttcaccgtgttagccaggatggtctcaatctcctgacctcgtgatccacccgcctcggcctcccaaagtgcygggattacagttgtgagccaccgtgcccagccccgattccttactttttatcttttgtgttaactactgtaggactttgctccgtggttaaaatgaggcttacaaaaaaatttcacagttacgacaagccattttaagctgataaaaatctgattgcattgaaaaactacacttctgctctgcccattccacccccaattctaaatttggtgtcacagtttacatcctaataacgacgtatagtattcttgaaaactgctgagaggagaatttaagtgttctcacaataaaattagtaag

SEQ ID NO: 147486 - DNA, 601 bp, Human
tgtgaaacttttgaaaattgaaaacttggggataataatatgaacttcagaccaggcattaaattgtcttaggtatgacaatcgcttttgtttttagagtccagatctcggctcactgcaacctctgcctcccaggttgaagtgattctcctgcctcagcctcccgagtagctgggactataggcgcccgccaccacgcccggctaatttttcgtatttttaatggagacggggtttcaccgtgttagccaggatggtctcaatctcctgacctcgtgatccacccgcctcggcctcccamagtgctgggattacagttgtgagccaccgtgcccagccccgattccttactttttatcttttgtgttaactactgtaggactttgctccgtggttaaaatgaggcttacaaaaaaatttcacagttacgacaagccattttaagctgataaaaatctgattgcattgaaaaactacacttctgctctgcccattccacccccaattctaaatttggtgtcacagtttacatcctaataacgacgtatagtattcttgaaaactgctgagaggagaatttaagtgttctcacaataaaatt

SEQ ID NO: 147487 - DNA, 601 bp, Human
taacaaaggttctaagaataagaaaaaaaggcttttcaaagaaggagagaaggctaaggaactaggaactattctagattaaagccgactaataaaacttgaatacaaataaaacagaggttcctagactagcctctggatttaaaaagaaaaaaaaaactgcaggataggggcgtggcagctataaagaatactggacaatccaatccaatgtgaatatagattatatatgcataaacaataatagtactacattaacgacagacttgtactgtgtatatggaaagacagccttgttctyagggaacagatcctgaaacattttggggtgaagggttatggtatctataaactactctcaaactgtttaggaaaaaaagttgcaaaatttctacaactggtgaacctaggtgaaaggtatgctggtgttcatttaactaatacatttttttctatagatgtgaaacttttgaaaattgaaaacttggggataataatatgaacttcagaccaggcattaaattgtcttaggtatgacaatcgcttttgtttttagagtccagatctcggctcactgcaacctctgcctcccaggttgaag

SEQ ID NO: 147488 - DNA, 601 bp, Human
tctcagcactttgggaggcagaggcaggtggatcacctgaggtcaagagtttaagaccagactggccaacatggtgaaaccccatctctactaaaaatacaaaaaatttagccaggcatggtggcacgcgcctataatccctgttactcaggaggctgaggtgagagaatcacttgaactcgggaggcaaaggttgcagtgagccgagatcatgccactgcattccagcctgggcgacagagcgagaatctgtctcaaaaaaaaaacaaaaaataaataaaagaactgctagtgtgggtaytggtgccaaaaacaattactccttcattttggaatttaaaagacacctcttcctccaacccttacccttaccttcagtttagtagctttgtcatccaaatagccatatagctttgagtgacataaataccatttgtttttttccccccgagactgtcatttctttttcttttcttttcttttcttttctttctttttttttttttttttttttttggagatagggtctcactctgttgcctgggctgaagtgcagtggtgatcatagctcactgcaggcttgaacacctgggctcatgca

SEQ ID NO: 147489 - DNA, 601 bp, Human
cagttagacatactttttcaagacactaccaggatatacaggcagaaatctcctatgcaaattacctctacattaaaaattatctttaaaaaagaaaaaggtcacaaaagaacatttacagttttgtattacactgaaatagaaagctaaaatataccaataagacattcaggccaggggccgtggcgcacgtccataatcccagcaagctgggaggccgaggtgggcggatcacgaggtcgggagtttgagaccagcctgaccaatatggtgagaataaaagtacaaaaattagccaggygtggtggcacatgcctgtaatcccagctactcaggaggctgaggcaggaaaatcgcttgaactggggaagtggagcttgctgtgacctgagatggtgccactgcactgcagcctggacgacagagcgagactccatctcaaaaaaagacattcagttggtaatctgaaggattaccaactctccctattggaaacaaccagaaaataaacataaaagtgtctgcaacataaggtagataggtgggatgcatcatattgagatgatactaagtaccatttctactgtagaggaaaatatat

SEQ ID NO: 147490 - DNA, 601 bp, Human
tcaagccatggcaagcctgaggcaggaaggaacagctggctcccctctgctcacctaaagacttctagagccctggaatgcccccagccccaatcagtgatctgagagaagagccctctagggacccaagaaggctggaggcaaagctgaaaaagctgctgccggctgacccaaactcctagcacagacgcccacaccagggttctgcatcctgcagaacttgtgactgtcttgtacagatggggaaactgaggcccagagaggagcaggtaaccagtgccagctccaccacctactatgkgacctcgggcaagtggtttaacctctgggtgcctccgtttcctgctgtataaaatggggatgacaacagtccttcccttatggagttgttttggggaagaaatgagataatagatgaaaaatgctgagactagaacctggcacatagtaagtgctcagtgaacatcagcttttattattaatactatcaatgcccagaggatccaggggagcccagcaatatccctccccaacttttcccatcacaccccaacacacatccaccctctgtggacctacacaccacgccaagcccacagcc

SEQ ID NO: 147491 - DNA, 601 bp, Human
tagggttcaaagcctcatcagctccaccccagcagctgtgctagggacatctgcacctcctcctcaagccatggcaagcctgaggcaggaaggaacagctggctcccctctgctcacctaaagacttctagagccctggaatgcccccagccccaatcagtgatctgagagaagagccctctagggacccaagaaggctggaggcaaagctgaaaaagctgctgccggctgacccaaactcctagcacagacgcccacaccagggttctgcatcctgcagaacttgtgactgtcttgtacwgatggggaaactgaggcccagagaggagcaggtaaccagtgccagctccaccacctactatgtgacctcgggcaagtggtttaacctctgggtgcctccgtttcctgctgtataaaatggggatgacaacagtccttcccttatggagttgttttggggaagaaatgagataatagatgaaaaatgctgagactagaacctggcacatagtaagtgctcagtgaacatcagcttttattattaatactatcaatgcccagaggatccaggggagcccagcaatatccctccccaactttt

SEQ ID NO: 147492 - DNA, 601 bp, Human
ccccaggaatgcgtccttcagtgatattcacaagcgcgtgacatgatgtggcaacaaggatactctgcaatactgcgtgtcatagcagaggctgccaacaacacaagcgtccaccagaagtcagagaaaagccgcacgccgaaatgccatgcagccactaggaagccccaccgtgctcctcctggcaccggctccaagaatgactgtcaaggtcaaagcagggacaaagagcacttatcctcctcctgcttccgtgtgggaaaagatcacaagatcacagctccagatgtgtatatgcacrgactgtcttgggaagaagacacaagatattgggaggactgggaatgggtggctggggacggggcggagaatttactgtataccttttgaaccccttgaatgttgcactgtgcacatttttattcaaaaataaaaaagatgtacaagtaaaagccccccaaggaagctgaactctgggtacctctggcacctgcaaaggtgggctcacaggaggtgctggggccaggagcctccccactcactccctgttgggggttacggcagatggggttttatgtgtgagtggagggggtccctggct

SEQ ID NO: 147493 - DNA, 601 bp, Human
ggaagaggccctggctgggcaagacccgcccagcccacctggccctgcctgtgtctccggggtccacctagagtggacacctgaccttgctctgcgggagccactgcggggccttggaagtagctctccgctctgcagcggggcctgcagcacccctggcttatccggagctggagatgaagggtttgctcaacatctcttcgtccgactgtgctatgggaaaatacaggccctgccttagggtgtaagagggtgagggggcccagctgggcaggcctgatgctgctcctggggggcttcrgctgcccagcaggggccagtgggagtgaaaactagggtgaagcatgaaagacgttgagcttccaaagggctgtgggcaaaccacaccctctcagatcccgcaaggcccttaggggatcccagggtcccatccctgctatcctgaggagcagcaggtccagggagggccaagtctgcccaatgccacccagcaagcagggccactcagatggccccctcttcctgacacactccgttcctcttggcctggtttccgtgggctacgcatatgggttgcccgagtttcagcaccagctatggc

SEQ ID NO: 147494 - DNA, 601 bp, Human
ctgtgcccttctctgaccagttgtcagtattagggtccccccaccacactggaacacttccagggtggggcggggctgagtcatccctgtgtttatgctgagtccttacagtcattgtttactcagttgctccgtggtgcaggccagggccctgagcccacagtccagagccagggagaaggggggtaagcgatgcccctgggctgcccccaggctccacaccacctgctcccctcatcccccctctactccttccttcattggaaactggtatttcagcttctaaatgtcagttccagcygggagaggcaagcactcacccaggtcttcctcaaaggtaaatttacagagcaattaaatcgtcacttgcagagtcaggaagaggccctggctgggcaagacccgcccagcccacctggccctgcctgtgtctccggggtccacctagagtggacacctgaccttgctctgcgggagccactgcggggccttggaagtagctctccgctctgcagcggggcctgcagcacccctggcttatccggagctggagatgaagggtttgctcaacatctcttcgtccgactgtgctatgggaaaa

SEQ ID NO: 147495 - DNA, 601 bp, Human
tatatacacacacacacacacacatatatatatattgttttttttcagatggagtctcattctgttgcccaggctggagtgcggtggtgcaatcttggttcactgcaacctctgcctcctgggttcaagcgattctcctgcctcagcctcccaaatagctgggattacaggcgcctgccaccatgcctggctaattttttatttttattttttagtaaagatgaggtttcaccatgttggccaggctggtttcgaactcctgatctcaagtgatccacccacctcggcctcccaaggtgcygagatgccaaggtgctagccaccgcgcccggccttcctcctccaacattttgcttgtgccattccttctgtgcacagcagcatcctatctcctcatataaaccccctttccaggaagccttctctgaaagcccctcccctacctcatcgctgtgcccttctctgaccagttgtcagtattagggtccccccaccacactggaacacttccagggtggggcggggctgagtcatccctgtgtttatgctgagtccttacagtcattgtttactcagttgctccgtggtgcaggccagggcc

SEQ ID NO: 147496 - DNA, 601 bp, Human
gtccccatcccttcagtcggcgtgcccctctgtagagagcccacagcccaaatcctcctgtccaaaaggccctgctggcctcactgatggtgctttaggggtttacgaggctctgcctgctcaggcctgatctgcttctaaatgcaaccctgaaggacccaattctcccctcgcatgaatgagccccagggtgatggagggagcccagggctgggagatcccctaccccaggcattcctggaagatgctgcctccttccttgctctctcccaggctgcgtgttggaggctgagatagttcsccttgaaatggcggccttgggcctctggcagtgccagatgtcctatctgttaaatgagagagtgccctggctctgcccactctcagtgccatccgctgggctgcagggggcagagacaggaccaggaggtgccgctctctctgagagccacagtggggctggccactattctaatctgagcctccgccacggtgacccctgcctggctcatgttgccagactgagagggcctgtgttcacggaggcccagcgtgcaggcctgggagtcagcctgcagtcctgggaaaagagggaggtgat

SEQ ID NO: 147497 - DNA, 601 bp, Human
actttgaaggcctgctgtggtgatcatcatcatcattactgttaagagtcacatttaccaagcacctgccaagcaatgtaccaggtgccttaccgcattatcaccagagaacaaatgggaagacgctggggaccgagcacgtgaggtgcttagcggaggtcatagcagcagcagctggtggtgtgcgccagacaccctgctaactccttgcgtgccttattctcatgatccgcaaacaagctgggaaggaggatgccattgttatgcccattttacagagtacacaacagagaggttgagygactagttcaccgtcacacagcgggggagacagggaagggttttgagctcaggcagtctggttctcgaccccctgctgtgggcctccgatgctaactcttaggctgtcctgccttccctcctccactctctttaccgctcacccaagctcatctgaaaacccttggtgtcccatgtcctgaccgttgggctggatgtccccatcccttcagtcggcgtgcccctctgtagagagcccacagcccaaatcctcctgtccaaaaggccctgctggcctcactgatggtgctttaggggttta

SEQ ID NO: 147498 - DNA, 601 bp, Human
cctgccgctgagcacagctctggtcctgcccacacagccagctccttgtggggccttgagcctcatttgggaggtggggtacccacacccactttgaaggcctgctgtggtgatcatcatcatcattactgttaagagtcacatttaccaagcacctgccaagcaatgtaccaggtgccttaccgcattatcaccagagaacaaatgggaagacgctggggaccgagcacgtgaggtgcttagcggaggtcatagcagcagcagctggtggtgtgcgccagacaccctgctaactccttgygtgccttattctcatgatccgcaaacaagctgggaaggaggatgccattgttatgcccattttacagagtacacaacagagaggttgagtgactagttcaccgtcacacagcgggggagacagggaagggttttgagctcaggcagtctggttctcgaccccctgctgtgggcctccgatgctaactcttaggctgtcctgccttccctcctccactctctttaccgctcacccaagctcatctgaaaacccttggtgtcccatgtcctgaccgttgggctggatgtccccatcccttca

SEQ ID NO: 147499 - DNA, 601 bp, Human
aggcgattgctgcagtatccaagctgaacctgactgataccccctccgctgtgacctggcttcctccgcaaagctcccctctcaccccgcccacctggggaggcctgacctgccgctgagcacagctctggtcctgcccacacagccagctccttgtggggccttgagcctcatttgggaggtggggtacccacacccactttgaaggcctgctgtggtgatcatcatcatcattactgttaagagtcacatttaccaagcacctgccaagcaatgtaccaggtgccttaccgcattatcwccagagaacaaatgggaagacgctggggaccgagcacgtgaggtgcttagcggaggtcatagcagcagcagctggtggtgtgcgccagacaccctgctaactccttgcgtgccttattctcatgatccgcaaacaagctgggaaggaggatgccattgttatgcccattttacagagtacacaacagagaggttgagtgactagttcaccgtcacacagcgggggagacagggaagggttttgagctcaggcagtctggttctcgaccccctgctgtgggcctccgatgctaactcttag

SEQ ID NO: 147500 - DNA, 601 bp, Human
cctgcctgccccggctggtctctcaagttctcctttctcttattttattttattttattttttttttttgagatggagtcttgctctctcgcccaggctggagcgcagtggcgggatcttggcttactgcaacctccgcctcccaggttcaagcgattctcctgcctcagcctcccgggtagctggaattaccggtgcctgccaccacgcccagctaatttttgtattttcagtagaggcggggtttcaccatgttggccaggctggtctcgaactcctgacctcaggtgatccacccacytcggcctcccaaagtgctgggattagaagtgtgagccaccgcgcccggctcagttcacctttctctacctgtctacctggatcatctccccttctgctctctgacccaccctgacccaggatccagtctttggtgctcattatgttgttccccaaatatttctggttctcccccaccttgtgggcacatagtaggagggcacttcccggcccccgtgtgagttttgagaagaaggatgtgtattcgtgccaggttggagcattgacttttggtgggggactttctaggaggtcactgtcc

SEQ ID NO: 147501 - DNA, 601 bp, Human
catggggtacacgtgccagctccagtcctggacttccccacaaaggtccccatgatgcctcctgcctgccccggctggtctctcaagttctcctttctcttattttattttattttattttttttttttgagatggagtcttgctctctcgcccaggctggagcgcagtggcgggatcttggcttactgcaacctccgcctcccaggttcaagcgattctcctgcctcagcctcccgggtagctggaattaccggtgcctgccaccacgcccagctaatttttgtattttcagtagaggcrgggtttcaccatgttggccaggctggtctcgaactcctgacctcaggtgatccacccacttcggcctcccaaagtgctgggattagaagtgtgagccaccgcgcccggctcagttcacctttctctacctgtctacctggatcatctccccttctgctctctgacccaccctgacccaggatccagtctttggtgctcattatgttgttccccaaatatttctggttctcccccaccttgtgggcacatagtaggagggcacttcccggcccccgtgtgagttttgagaagaaggatgtg

SEQ ID NO: 147502 - DNA, 601 bp, Human
ggagcagtgtgctttcgaggtcaccccagccatgccccagcctcgaatcaggacagcactaacctcatggtgcgcatgggtgggcttgtgctgggctcttcccgggggatgcctgtaaccctcacctttctttattctgggcaggggcgaggcctggggttgggaagcgtgtcatggggtacacgtgccagctccagtcctggacttccccacaaaggtccccatgatgcctcctgcctgccccggctggtctctcaagttctcctttctcttattttattttattttattttttttttttgagatggagtcttgctctctcgcccaggctggagcgcagtggcgggatcttggcttactgcaacctccgcctcccaggttcaagcgattctcctgcctcagcctcccgggtagctggaattaccggtgcctgccaccacgcccagctaatttttgtattttcagtagaggcggggtttcaccatgttggccaggctggtctcgaactcctgacctcaggtgatccacccacttcggcctcccaaagtgctgggattagaagtgtgagccaccgcgcccggctcagttcacctttctctac

SEQ ID NO: 147503 - DNA, 601 bp, Human
ctccaatggagcagtgtgctttcgaggtcaccccagccatgccccagcctcgaatcaggacagcactaacctcatggtgcgcatgggtgggcttgtgctgggctcttcccgggggatgcctgtaaccctcacctttctttattctgggcaggggcgaggcctggggttgggaagcgtgtcatggggtacacgtgccagctccagtcctggacttccccacaaaggtccccatgatgcctcctgcctgccccggctggtctctcaagttctcctttctcttattttattttattttattttwtttttttgagatggagtcttgctctctcgcccaggctggagcgcagtggcgggatcttggcttactgcaacctccgcctcccaggttcaagcgattctcctgcctcagcctcccgggtagctggaattaccggtgcctgccaccacgcccagctaatttttgtattttcagtagaggcggggtttcaccatgttggccaggctggtctcgaactcctgacctcaggtgatccacccacttcggcctcccaaagtgctgggattagaagtgtgagccaccgcgcccggctcagttcacctt

SEQ ID NO: 147504 - DNA, 601 bp, Human
cctctccccggaccacctgtttggaagctttggggtctgcacctggcagctgaaccctggggagtatcaagcagcccactggactgtaggaatccaggagggaaatatatagcctaaaaatacactttctagcattttctccaaagtcctattttcggcagtggctgacattttccgtggaaaatgtaatctccagtgtcctgcgtcgagattaaaatcaaacagactttttccttctgatctatttagctgaggcgaacaggaaaggcggggggagggccaggactggtttctgggccarttctccaatggagcagtgtgctttcgaggtcaccccagccatgccccagcctcgaatcaggacagcactaacctcatggtgcgcatgggtgggcttgtgctgggctcttcccgggggatgcctgtaaccctcacctttctttattctgggcaggggcgaggcctggggttgggaagcgtgtcatggggtacacgtgccagctccagtcctggacttccccacaaaggtccccatgatgcctcctgcctgccccggctggtctctcaagttctcctttctcttattttattttattttatt

SEQ ID NO: 147505 - DNA, 601 bp, Human
ccttagcctcctgagtagctgggattacaggcacgcggcaccacgcccggctgatttttgtatttttagtagaaatggggtttcactatgttggccagggtggtctcgaactcctgaccttgtgatctgcccgcctcggcctcccaaagtgctgggattacaggcgtgagccaccgcccaggcctaggtgctgatttttatctccaacatttcccgaagcaccttttgtatcaggcagaggtgcctcgggcccctgaagtggttgaatcattcctacagcctaaagggcaggcaggtggcrgggagttcctgccctgcttcacagacccgggcacggaggatcagggtggcggtgtggcttgggcaaggccacacagtgagtgagtgggtctgtgtggggatgagaggggcgggagccaggctctgcagggtgggcttggagaagctcccccttcccaggccgcagtctaactgagccctgcctcctcttgtctcttgccactcaaaggacagtctccggacatctgtggcatctccccgaagctcgttagccatgcggaatctgaggccccggccatggctggctctcttccacctcctt

SEQ ID NO: 147506 - DNA, 601 bp, Human
cagtgaagaccccccagccccgccccacatacccagtcgccccccacacaacatggtgaagaacactgtttccaaactctaacagcacccacctcaattgaggtgctgatttttttttttttttttttaagagagtctcgctctgtcgcccaggccagagtgcagtggcgcaatcttggctcactgcaacctccacctcccgggttcaagcgattctcctgccttagcctcctgagtagctgggattacaggcacgcggcaccacgcccggctgatttttgtatttttagtagaaatgggrtttcactatgttggccagggtggtctcgaactcctgaccttgtgatctgcccgcctcggcctcccaaagtgctgggattacaggcgtgagccaccgcccaggcctaggtgctgatttttatctccaacatttcccgaagcaccttttgtatcaggcagaggtgcctcgggcccctgaagtggttgaatcattcctacagcctaaagggcaggcaggtggcggggagttcctgccctgcttcacagacccgggcacggaggatcagggtggcggtgtggcttgggcaaggccacacagtga

SEQ ID NO: 147507 - DNA, 601 bp, Human
gccagcaccccgcagtgaggatccctcccatggtgcagtcccccccaggccctgcactccatcgagctcagtgaagaccccccagccccgccccacatacccagtcgccccccacacaacatggtgaagaacactgtttccaaactctaacagcacccacctcaattgaggtgctgatttttttttttttttttttaagagagtctcgctctgtcgcccaggccagagtgcagtggcgcaatcttggctcactgcaacctccacctcccgggttcaagcgattctcctgccttagcctccygagtagctgggattacaggcacgcggcaccacgcccggctgatttttgtatttttagtagaaatggggtttcactatgttggccagggtggtctcgaactcctgaccttgtgatctgcccgcctcggcctcccaaagtgctgggattacaggcgtgagccaccgcccaggcctaggtgctgatttttatctccaacatttcccgaagcaccttttgtatcaggcagaggtgcctcgggcccctgaagtggttgaatcattcctacagcctaaagggcaggcaggtggcggggagttcctg

SEQ ID NO: 147508 - DNA, 601 bp, Human; identical to SEQ ID NO: 32155

SEQ ID NO: 147509 - DNA, 601 bp, Human; identical to SEQ ID NO: 32156

SEQ ID NO: 147510 - DNA, 601 bp, Human; identical to SEQ ID NO: 32157

SEQ ID NO: 147511 - DNA, 601 bp, Human; identical to SEQ ID NO: 32158

SEQ ID NO: 147512 - DNA, 601 bp, Human; identical to SEQ ID NO: 32159

SEQ ID NO: 147513 - DNA, 601 bp, Human; identical to SEQ ID NO: 32160

SEQ ID NO: 147514 - DNA, 601 bp, Human; identical to SEQ ID NO: 32161

SEQ ID NO: 147515 - DNA, 601 bp, Human; identical to SEQ ID NO: 32162

SEQ ID NO: 147516 - DNA, 601 bp, Human; identical to SEQ ID NO: 32163

SEQ ID NO: 147517 - DNA, 601 bp, Human; identical to SEQ ID NO: 32164

SEQ ID NO: 147518 - DNA, 601 bp, Human; identical to SEQ ID NO: 32165

SEQ ID NO: 147519 - DNA, 601 bp, Human; identical to SEQ ID NO: 32166

SEQ ID NO: 147520 - DNA, 601 bp, Human; identical to SEQ ID NO: 32167

SEQ ID NO: 147521 - DNA, 601 bp, Human; identical to SEQ ID NO: 32168

SEQ ID NO: 147522 - DNA, 601 bp, Human; identical to SEQ ID NO: 32169

SEQ ID NO: 147523 - DNA, 601 bp, Human; identical to SEQ ID NO: 32170

SEQ ID NO: 147524 - DNA, 601 bp, Human; identical to SEQ ID NO: 32171

SEQ ID NO: 147525 - DNA, 601 bp, Human; identical to SEQ ID NO: 32172

SEQ ID NO: 147526 - DNA, 601 bp, Human; identical to SEQ ID NO: 32173

SEQ ID NO: 147527 - DNA, 601 bp, Human; identical to SEQ ID NO: 32174

SEQ ID NO: 147528 - DNA, 601 bp, Human; identical to SEQ ID NO: 32175

SEQ ID NO: 147529 - DNA, 601 bp, Human; identical to SEQ ID NO: 32176

SEQ ID NO: 147530 - DNA, 601 bp, Human; identical to SEQ ID NO: 32177

SEQ ID NO: 147531 - DNA, 601 bp, Human; identical to SEQ ID NO: 32178

SEQ ID NO: 147532 - DNA, 601 bp, Human; identical to SEQ ID NO: 32179

SEQ ID NO: 147533 - DNA, 601 bp, Human; identical to SEQ ID NO: 32180

SEQ ID NO: 147534 - DNA, 601 bp, Human; identical to SEQ ID NO: 32181

SEQ ID NO: 147535 - DNA, 601 bp, Human; identical to SEQ ID NO: 32182

SEQ ID NO: 147536 - DNA, 601 bp, Human; identical to SEQ ID NO: 32183

SEQ ID NO: 147537 - DNA, 601 bp, Human; identical to SEQ ID NO: 32184

SEQ ID NO: 147538 - DNA, 601 bp, Human; identical to SEQ ID NO: 32185

SEQ ID NO: 147539 - DNA, 601 bp, Human; identical to SEQ ID NO: 32186

SEQ ID NO: 147540 - DNA, 601 bp, Human; identical to SEQ ID NO: 32187

SEQ ID NO: 147541 - DNA, 601 bp, Human; identical to SEQ ID NO: 32188

SEQ ID NO: 147542 - DNA, 601 bp, Human; identical to SEQ ID NO: 32189

SEQ ID NO: 147543 - DNA, 601 bp, Human; identical to SEQ ID NO: 32190

SEQ ID NO: 147544 - DNA, 601 bp, Human; identical to SEQ ID NO: 32191

SEQ ID NO: 147545 - DNA, 601 bp, Human; identical to SEQ ID NO: 32192

SEQ ID NO: 147546 - DNA, 601 bp, Human; identical to SEQ ID NO: 32193

SEQ ID NO: 147547 - DNA, 601 bp, Human; identical to SEQ ID NO: 32194

SEQ ID NO: 147548 - DNA, 601 bp, Human; identical to SEQ ID NO: 32195

SEQ ID NO: 147549 - DNA, 601 bp, Human; identical to SEQ ID NO: 32196

SEQ ID NO: 147550 - DNA, 601 bp, Human; identical to SEQ ID NO: 32197

SEQ ID NO: 147551 - DNA, 601 bp, Human; identical to SEQ ID NO: 32198

SEQ ID NO: 147552 - DNA, 601 bp, Human; identical to SEQ ID NO: 32199

SEQ ID NO: 147553 - DNA, 601 bp, Human; identical to SEQ ID NO: 32200

SEQ ID NO: 147554 - DNA, 601 bp, Human; identical to SEQ ID NO: 32201

SEQ ID NO: 147555 - DNA, 601 bp, Human; identical to SEQ ID NO: 32202

SEQ ID NO: 147556 - DNA, 601 bp, Human; identical to SEQ ID NO: 30317

SEQ ID NO: 147557 - DNA, 601 bp, Human; identical to SEQ ID NO: 30318

SEQ ID NO: 147558 - DNA, 601 bp, Human; identical to SEQ ID NO: 30319

SEQ ID NO: 147559 - DNA, 601 bp, Human; identical to SEQ ID NO: 30320

SEQ ID NO: 147560 - DNA, 601 bp, Human; identical to SEQ ID NO: 30321

SEQ ID NO: 147561 - DNA, 601 bp, Human; identical to SEQ ID NO: 30322

SEQ ID NO: 147562 - DNA, 601 bp, Human; identical to SEQ ID NO: 30323

SEQ ID NO: 147563 - DNA, 601 bp, Human; identical to SEQ ID NO: 30324

SEQ ID NO: 147564 - DNA, 601 bp, Human; identical to SEQ ID NO: 30325

SEQ ID NO: 147565 - DNA, 601 bp, Human; identical to SEQ ID NO: 30326

SEQ ID NO: 147566 - DNA, 601 bp, Human; identical to SEQ ID NO: 30327

SEQ ID NO: 147567 - DNA, 601 bp, Human; identical to SEQ ID NO: 30328

SEQ ID NO: 147568 - DNA, 601 bp, Human; identical to SEQ ID NO: 30329

SEQ ID NO: 147569 - DNA, 601 bp, Human; identical to SEQ ID NO: 30330

SEQ ID NO: 147570 - DNA, 601 bp, Human; identical to SEQ ID NO: 30331

SEQ ID NO: 147571 - DNA, 601 bp, Human; identical to SEQ ID NO: 30332

SEQ ID NO: 147572 - DNA, 601 bp, Human; identical to SEQ ID NO: 30333

SEQ ID NO: 147573 - DNA, 601 bp, Human; identical to SEQ ID NO: 30334

SEQ ID NO: 147574 - DNA, 601 bp, Human; identical to SEQ ID NO: 30335

SEQ ID NO: 147575 - DNA, 601 bp, Human; identical to SEQ ID NO: 30336

SEQ ID NO: 147576 - DNA, 601 bp, Human; identical to SEQ ID NO: 30337

SEQ ID NO: 147577 - DNA, 601 bp, Human; identical to SEQ ID NO: 30338

SEQ ID NO: 147578 - DNA, 601 bp, Human; identical to SEQ ID NO: 30339

SEQ ID NO: 147579 - DNA, 601 bp, Human; identical to SEQ ID NO: 30340

SEQ ID NO: 147580 - DNA, 601 bp, Human; identical to SEQ ID NO: 30341

SEQ ID NO: 147581 - DNA, 601 bp, Human; identical to SEQ ID NO: 30342

SEQ ID NO: 147582 - DNA, 601 bp, Human; identical to SEQ ID NO: 30343

SEQ ID NO: 147583 - DNA, 601 bp, Human; identical to SEQ ID NO: 30344

SEQ ID NO: 147584 - DNA, 601 bp, Human; identical to SEQ ID NO: 30345

SEQ ID NO: 147585 - DNA, 601 bp, Human; identical to SEQ ID NO: 30346

SEQ ID NO: 147586 - DNA, 601 bp, Human; identical to SEQ ID NO: 30347

SEQ ID NO: 147587 - DNA, 601 bp, Human; identical to SEQ ID NO: 30348

SEQ ID NO: 147588 - DNA, 601 bp, Human; identical to SEQ ID NO: 30349

SEQ ID NO: 147589 - DNA, 601 bp, Human; identical to SEQ ID NO: 30350

SEQ ID NO: 147590 - DNA, 601 bp, Human; identical to SEQ ID NO: 30351

SEQ ID NO: 147591 - DNA, 601 bp, Human; identical to SEQ ID NO: 30352

SEQ ID NO: 147592 - DNA, 601 bp, Human; identical to SEQ ID NO: 30353

SEQ ID NO: 147593 - DNA, 601 bp, Human; identical to SEQ ID NO: 20566

SEQ ID NO: 147594 - DNA, 601 bp, Human; identical to SEQ ID NO: 20567

SEQ ID NO: 147595 - DNA, 601 bp, Human; identical to SEQ ID NO: 20568

SEQ ID NO: 147596 - DNA, 601 bp, Human
ctctctgggtttcctctccccggacgtcgtgggcacgcgcccgacagactttcgcccctaggccggttcccagtccagctccggagccaccgtgccgagttctcccaggccgcactcaccccggaggaagccttggccccctcgtcctcttcgcccctccaggccggcgacgtggggctgacggccaggtcgcaaaaagcagggccgagcggagcccgctcccctcggtcggcggtggagaccccggcccaatcccccggccgcagcggtacggcgtcggcggcagcagctgacccggacrcagtgagaagccccggcggaagtgataacatcccgacctcctccgggcgcggcagccggcggtggaggcggcgggggcgtggcggcggcggaggcgtggcgtcttcttgaaacccacacagcatccccccaaccccctcagacgtcacgggctagcgctcgcgcctgcactcgcggggtcggccttccttgcctgtgggcggatccgtcgcgtcgactccttattggtggcgttactacgcctcaaggcgtttcttccctctttgctgttcgcagggacgctgcctggtagtttcagtta

SEQ ID NO: 147597 - DNA, 601 bp, Human; identical to SEQ ID NO: 29681

SEQ ID NO: 147598 - DNA, 601 bp, Human; identical to SEQ ID NO: 29682

SEQ ID NO: 147599 - DNA, 601 bp, Human; identical to SEQ ID NO: 29683

SEQ ID NO: 147600 - DNA, 601 bp, Human; identical to SEQ ID NO: 29684

SEQ ID NO: 147601 - DNA, 601 bp, Human; identical to SEQ ID NO: 29685

SEQ ID NO: 147602 - DNA, 601 bp, Human; identical to SEQ ID NO: 29686

SEQ ID NO: 147603 - DNA, 601 bp, Human; identical to SEQ ID NO: 29687

SEQ ID NO: 147604 - DNA, 601 bp, Human; identical to SEQ ID NO: 29688

SEQ ID NO: 147605 - DNA, 601 bp, Human; identical to SEQ ID NO: 29689

SEQ ID NO: 147606 - DNA, 601 bp, Human; identical to SEQ ID NO: 29690

SEQ ID NO: 147607 - DNA, 601 bp, Human; identical to SEQ ID NO: 29691

SEQ ID NO: 147608 - DNA, 601 bp, Human; identical to SEQ ID NO: 29692

SEQ ID NO: 147609 - DNA, 601 bp, Human; identical to SEQ ID NO: 29693

SEQ ID NO: 147610 - DNA, 601 bp, Human; identical to SEQ ID NO: 29694

SEQ ID NO: 147611 - DNA, 601 bp, Human; identical to SEQ ID NO: 29695

SEQ ID NO: 147612 - DNA, 601 bp, Human; identical to SEQ ID NO: 29696

SEQ ID NO: 147613 - DNA, 601 bp, Human; identical to SEQ ID NO: 29697

SEQ ID NO: 147614 - DNA, 601 bp, Human; identical to SEQ ID NO: 29698

SEQ ID NO: 147615 - DNA, 601 bp, Human; identical to SEQ ID NO: 29699

SEQ ID NO: 147616 - DNA, 601 bp, Human; identical to SEQ ID NO: 29700

SEQ ID NO: 147617 - DNA, 601 bp, Human; identical to SEQ ID NO: 29701

SEQ ID NO: 147618 - DNA, 601 bp, Human; identical to SEQ ID NO: 29702

SEQ ID NO: 147619 - DNA, 601 bp, Human; identical to SEQ ID NO: 29703

SEQ ID NO: 147620 - DNA, 601 bp, Human; identical to SEQ ID NO: 29704

SEQ ID NO: 147621 - DNA, 601 bp, Human; identical to SEQ ID NO: 29705

SEQ ID NO: 147622 - DNA, 601 bp, Human; identical to SEQ ID NO: 29706

SEQ ID NO: 147623 - DNA, 601 bp, Human; identical to SEQ ID NO: 29707

SEQ ID NO: 147624 - DNA, 601 bp, Human; identical to SEQ ID NO: 29708

SEQ ID NO: 147625 - DNA, 601 bp, Human; identical to SEQ ID NO: 29709

SEQ ID NO: 147626 - DNA, 601 bp, Human; identical to SEQ ID NO: 29710

SEQ ID NO: 147627 - DNA, 601 bp, Human; identical to SEQ ID NO: 29711

SEQ ID NO: 147628 - DNA, 601 bp, Human; identical to SEQ ID NO: 29712

SEQ ID NO: 147629 - DNA, 601 bp, Human; identical to SEQ ID NO: 29713

SEQ ID NO: 147630 - DNA, 601 bp, Human; identical to SEQ ID NO: 29714

SEQ ID NO: 147631 - DNA, 601 bp, Human; identical to SEQ ID NO: 29715

SEQ ID NO: 147632 - DNA, 601 bp, Human; identical to SEQ ID NO: 29716

SEQ ID NO: 147633 - DNA, 601 bp, Human; identical to SEQ ID NO: 29717

SEQ ID NO: 147634 - DNA, 601 bp, Human; identical to SEQ ID NO: 29718

SEQ ID NO: 147635 - DNA, 601 bp, Human; identical to SEQ ID NO: 29719

SEQ ID NO: 147636 - DNA, 601 bp, Human; identical to SEQ ID NO: 29720

SEQ ID NO: 147637 - DNA, 601 bp, Human; identical to SEQ ID NO: 29721

SEQ ID NO: 147638 - DNA, 601 bp, Human; identical to SEQ ID NO: 29722

SEQ ID NO: 147639 - DNA, 601 bp, Human; identical to SEQ ID NO: 29723

SEQ ID NO: 147640 - DNA, 601 bp, Human; identical to SEQ ID NO: 29724

SEQ ID NO: 147641 - DNA, 601 bp, Human; identical to SEQ ID NO: 29725

SEQ ID NO: 147642 - DNA, 601 bp, Human; identical to SEQ ID NO: 29726

SEQ ID NO: 147643 - DNA, 601 bp, Human; identical to SEQ ID NO: 29727

SEQ ID NO: 147644 - DNA, 601 bp, Human; identical to SEQ ID NO: 29728

SEQ ID NO: 147645 - DNA, 601 bp, Human; identical to SEQ ID NO: 29729

SEQ ID NO: 147646 - DNA, 601 bp, Human; identical to SEQ ID NO: 29730

SEQ ID NO: 147647 - DNA, 601 bp, Human; identical to SEQ ID NO: 29731

SEQ ID NO: 147648 - DNA, 601 bp, Human; identical to SEQ ID NO: 29732

SEQ ID NO: 147649 - DNA, 601 bp, Human; identical to SEQ ID NO: 29733

SEQ ID NO: 147650 - DNA, 601 bp, Human; identical to SEQ ID NO: 29734

SEQ ID NO: 147651 - DNA, 601 bp, Human; identical to SEQ ID NO: 29735

SEQ ID NO: 147652 - DNA, 601 bp, Human; identical to SEQ ID NO: 29736

SEQ ID NO: 147653 - DNA, 601 bp, Human
tcctcccagcccgctccgcccgggtctccggcccggcgccgttaccaccccttttggctcgtcatttcctctcttccccgccccgttcgcagtggcaggaccgcacacctccgtcttggagcccaaccaagcggtctccgtttcttgtccgggctgtaagaccagtccattcggtgcctggaacctcactcttagaagattgatacccttgcgtattctttccagaggctgcacaacttgctgttcatattactaatcttatccactgctcattttgtgaaatctccctcccttgggaatrtagtacagttttgggggttttttttccctttgtttttgccttcgcctttctatgttactttgtgtcaggcttgacccagtccactcatctcttggtttatgtttttctgatacactttcaagtcctgtgttaacgttttctcagcagatgtttagaaactaacagtgttgtggggttttccttagggtgagaggttgctgttggcaaccaattatccagcagttagtatatgccaggtataatccgtgtgttagggagggagtacgtagaggtcaataagaactgtgcctacctgatgga

SEQ ID NO: 147654 - DNA, 601 bp, Human
gaaagatggaagagcttgctcgaagagaagaaaagcatgtgcagaggaatcaaattacactgttggaggcaggaagatgggatagggaagtgggcagtagttgtgatagtttaggggggaaagcccagttggtaaaatacttgtatatcttgctaaggaatattttggaaacagttattattttgtatggaggttcaagtagaagggatctagagctatattttttcctaagattgaaaaaacgagtttctgacttgtttatgggttctgccccgtgatagtggctgagttctttggggakgaagaggagacttgtcctaggactctgaaaattatttttactcatgtgaatcatctagtgcattccctggcacataaaggtcttaagtatctggtgcccatttctaaattcacatttaatgttatacaactaataggtttcagaaaactcgtattccagtgctctttcattactaaaacttcggggacaggttttattttcactttttagggtgagtttttcattgttgcttaagtgattttcttaattcatttgattgtcacgttatccgcattagcagatgagatgatagagcttaag

SEQ ID NO: 147655 - DNA, 601 bp, Human
ccattcatccattttttgatgcatttcaaagtaaattttagatatcaatacacttctttctaagtacttggacatatagttgcacatattttggtttcttctttcacactgtattgagacaccttgcaaatgattaattccaccagcatgtgtggatttatggagagtggtactgtactttgccacgataatgagcagctcagttaggtcacgtcattttattattcagatgttggaatttatgagggcctagtgaaaaatcagagagaaagacctatctacatttttgtttatatatctrtcctccctcccatatttccaagatgaattgccgattgctaacttatatcattttaattttttaatgaagtctttattaaaggttctcagatatcattcagtttatctaattgtatccttatttttaaaagtggatcttcaactcttaaagtctatgagaagggtaaattttgcctaccatatgtagtggacctgagtaacatgtttggtgggaagcaattacgtgttacaacttaaagaagctttattctctaaagtatatgtgcaaacctgaaaatcagtgttaggtatgccttgtatc

SEQ ID NO: 147656 - DNA, 601 bp, Human
ctgtgagcactgcatgaacttctcctctcctcatgtctggtgctgtttgtgttaggatctccagtaggaatggcaaagtcagttgcatgtctttgatgctgctaacttgtctttgaggcttataagatgccagtttcctaatatttcatgccaagtcatatagagaccccgtatcaactttctgagaattggatttgactagcatgtttctttgagaatgcctggaaaagaaatggtataagtgacaggaagaaattcttataagtgacattagaatttattcagggctcggccgggcgcrgtggctcacgcctgtaatcccagcactttgggaggccgaggcaggcggatcacgaggtcaggagatcgagaccatcctggcaaacatggtgaaaccctgtctctactaaaaatacaaaaaaattagccgggcatggtggcgggcacctgtagtcccagctacttgggaggctggagcaggagaatggcgtgaacccaggaggcagagcttgcagtgagcagagattgcgccactgcactccagcctgggtgacagagcgagactccgtctcaaaaaaaaaaaaaagaatttattcagggc

SEQ ID NO: 147657 - DNA, 601 bp, Human
ctgtgataattcttggttaatcaatacagttctttagcatcgtgtatggctaagtatcctaaattgggttctaatttggccagttcctataaaacacaggagtagcagcactagtctactctgtgtatgtaggttacttttattaaaataactctatttttgagaaattggcaagatttgggtaccctactttttccctccattgaattagaaatgattcaaagtagaatctagaatgtagaactggcatctcactttattgctagtgctgctaagcatccagcagataactacctcttaytgtcatcactttatcctttcaatcccacccctacccctgccaccaatagtgtttggtaatgatgtacagccaactttgaacataaattaagccgaaagaaactgagcttgtaggcattccaaaattgtgttcaaatctcacagtccaacagcttgttaatgtttttcatgcttgcttcatcttactcatatataaaacagtattttggattgtcattaaccccttgtggaataggaatgtaacatgctcttaactgtatggcttcttgtttgatgcatgtgtctttgtaacatttttctg

SEQ ID NO: 147658 - DNA, 601 bp, Human
gtgtgatctcatctttgtaattcataaccaaccccccatgagtatatgtttatagtcatggaaaagagagtatgagataactattagttactctatctaaatgtttatattgtttcaacagttacagcagtcatattaatgtcttagttttctggaggaatttaagttgaaaaaagcagccatgatcccactgctcataaatcaaacttgtactttttgtgtattcttttgtgtttttatgcataatttttgggcataattgtaccatgcatgtggggttgtgttttcattttttttttttaattctttcataatgttcagtcaacttgatgaatcagaatttctaatttataaaatatagttaaggattttggttttcatttgcctttgtaggtaaacatttgggcacgatagttttatttttcaactgaattctcaggataatttctttggattggggattgcttgggtaaagggtaagagtatatttgagcccactggcatatttttgccaagatagaattgtacttgggattaaaaatagttttcacatttctctttgcataaatatatgaggctttaaatatcttttcagcatgtg

SEQ ID NO: 147659 - DNA, 601 bp, Human
attaaataagcattctgatcttggccaagttatttaattgtcggtttgctcatccaaaaataaaatttatatgagatgatatctagggttcattctagctctaaattctgtgatttttatggggttttattttgctataaggaaccttcaaatagttatttccctgcttccaagtagggctataactaaccaagctgaaaaaaatatattctgttacgtaaataaagctctctaggtgagattccatagcctcccttacaatacttaaggctttaatcccctttgtataggagttttttttctcattagtgttgagtagccattttttaaagaagactacttcttaaccttttttgaattgtattctctattttagaatcctagtaaagcttgcaccctctaagaaaaagtagagatgtccagtctcatgaaaaattctgcatataattttagattaaaatccttggcctgagaaagatactggaaccagagagacagccaagaaatagatagaagaatattggaagttggcatataataaaagtggtataaacatatcaatgaagaaatggctgaagaatgatacagaaaagaaactgat

SEQ ID NO: 147660 - DNA, 601 bp, Human
agttaggaatcctgacacagctgtgttggattctttcaaggtcctctcaaggcccttatcaaggtgttgtcctgggctgcagtcacatttgactagagtagaatacattttgggttttttctttgtttgtttttttgagacagttactcgctctgttgcctaggctggaatgcagtggtgcggatcttggctcactgcaacctctgcctcccaggctcaaatgatcctcccacctcagttccccaagtagctgggaccacaggcatgtcctaccatgcctggataatttttgtatttttcmgtagatacagggttttgccatgttgcccaggctggtctcgaactcctgacctaatctgctcgcctcagcctcctgaagtgctgggattatgggcataagccattgtacccggctttcagcatttttaatatatatagtatttcctctgtaaaaaagtacttcatcattcaccaaaatggcaagattaaaaaataataataaagcactttagagtgtattttatttttttatttttttgagacggaatctcgctctgtcgcccaggctggagtgcagtggcgtgatctcggctcactgcaa

SEQ ID NO: 147661 - DNA, 601 bp, Human
agttaatgcagatggcaccattctccagcaaggtaagtgtacccataagcttccctaggactttttggggcaacttttttgtcccttagacaactgacatctttagaatttgagtggtgaacttgacactacatattttttggacaaaaaaaaaaaagatttcctctagctctccattgattgttggtttcttgtcaccatctgtgaccaacagtgattccatgtgtagcagtttctatagtggttgctaatctagggattgtgtaagcttttagggaagaagtgtttctaaacagaagawtagaaatagggagttcattggtaaagagagaaatagatcaaaaatcaagttggctttagagtgctattgctgcttatgtttttttctgggtcattccattactttaaatgactattatgtatacagcacttttactaagaagggtcctcaaagagcctctagtctagtaagaaagacgtgaacaaataaatacaatgcagggccctcatggaagtatgttctaggaatagataacataaataatagatgtttggtctgggaggaggagtgcagaaactgaacttgaaggcttttggaagc

SEQ ID NO: 147662 - DNA, 601 bp, Human
tttggcaggagcacagattgttcaaacaggagccaataccaacacaaccagcagtgggcaagggactgtcactgtgacactaccagtggcaggcaatgtggtcaattcaggagggatggtcatggtaagaaaatgtatttttcagctttgtctttgaaattttcttgaacatgcaacttgatgcctcctaaaatttattatgttgacctcttgggattgagatcgatccttaaggcactgtcggtaatctactttgacaataacattatgacaaaccataattcattctgagcacctactrtgtgccagggactattcaccagggactattctagatgctggagataaagcaatggataaatagtgattttatggaattcttttcagaattcaaataacgaagggaattatatactaatctttgagaagtggaaagtagtattgcccatgatggacaaaataagaaataagctaaaaattagaaagattgtaattgatagagaaaccaaaaaaaaagtgtcatgtaaatgtattgggaagataggaagatttgggtggtgtaactgaaagctaaatcctcatatgtcaaaataggatgtta

SEQ ID NO: 147663 - DNA, 601 bp, Human; identical to SEQ ID NO: 147653

SEQ ID NO: 147664 - DNA, 601 bp, Human; identical to SEQ ID NO: 147654

SEQ ID NO: 147665 - DNA, 601 bp, Human; identical to SEQ ID NO: 147655

SEQ ID NO: 147666 - DNA, 601 bp, Human; identical to SEQ ID NO: 147656

SEQ ID NO: 147667 - DNA, 601 bp, Human; identical to SEQ ID NO: 147657

SEQ ID NO: 147668 - DNA, 601 bp, Human; identical to SEQ ID NO: 147658

SEQ ID NO: 147669 - DNA, 601 bp, Human; identical to SEQ ID NO: 147659

SEQ ID NO: 147670 - DNA, 601 bp, Human; identical to SEQ ID NO: 147660

SEQ ID NO: 147671 - DNA, 601 bp, Human; identical to SEQ ID NO: 147661

SEQ ID NO: 147672 - DNA, 601 bp, Human; identical to SEQ ID NO: 147662

SEQ ID NO: 147673 - DNA, 601 bp, Human
actaaataatctaagttattatgcaatctacaatatcagaattttgtttgttttgagacatggtctcactttcattgcccaggctggagtgatgtggcttgatcctagctcactgcagcctctgcttcctgggctcagatgattctcccacctcagcctcctgagtagctgggactacaggcgtgtgttaccacacctggctaatttttgtatttttttctagagatagggtctcactctgttgtccagggtgctctcaaactccttggttcaaacggtccacctgtctcggcctctcaaagtgctgggattatgcatgtgagccactaagcctgattttagaatatcagattttaatttaacttcttagtcccagccacttgtttgacttctttttcattgactgcactcttggaaatgatgatttaaatttaattctggtttgacaggaaaagataattaaaaatcttcctgatgatatcttgactctaaatattaagcatcaccttagtttattagctatattagttcaccaggaatcctcttatcaatctgtgtgtgtgtgtatttttttttttctatctttaaagaaattttagat

SEQ ID NO: 147674 - DNA, 601 bp, Human
aatttctctttttttgtttttttttggttgagacggagtctcactttgtcgcccaggctggagtgcagtggcacgatctcggctcgctgcaggctctgcctcccgggttcatgccattctcctgcctcagcctcccgagcagctggaactacaggtgcctgccaccacgcccagctaatttttttgtatttttattagagacgggattttacagtgttagccaggatggtctcgatctcctgaccttgtgatccgcccacctcggcctctcaaagttctgggattacaggcgtcagccacygtgcctggctttctctttttcttagtaaatttcttccctaaaatatccagtgaactcgagtgtcagggatatgattagttagaaacccaaggttaggccaggcacagtggcacacgcctgtagtcccaacactttgggaagccaaggtgggttttgggaggctgaggtgggaggatcacctgagcccaggagtttgagaccagcctgggcaatgtaggaagaccctgtctctacaaaaaaaaaaaaaaaaaaaaaaaaaagtttttaattagctgggctgggtatggtggtgcacacctg

SEQ ID NO: 147675 - DNA, 601 bp, Human
tagagacagggtttcaccgtgttagccaggatggtctagatctcctgacctcgtgatctacctgcctcaacctcccaaagtgcccagctatcaatgggttttatagggaagctggcattcattaaaagtaaatattcaccaggcgcactttgggaggctgaggtgggcagattgcttgagcctgggagttctagaccagcctgagcaacatggcaaaaccccgtctctactaaaaatacaaaaattagctggccatggtggcgtggtgcctgtagtcccagctacttaggaggctgagtcrggagaatcacctgagcccaggaggcagaggttgcagtgagctatgatcatgccactgcactccagcctgggtgacagagtgagaccctgtctcaaaaaaaaaaaagcaaatatttttgaaaaatatatgtttgggaatggtggagaaaaaaattccaggcagaatgaattgtaggaacaaaggcatgtgtacacaaaaacatgggatatagatataggaatttccaagcacacaaatctggagagggaatttccaggcagaaggtacaacacatacaaaggctcagcagcgtgagagcat

SEQ ID NO: 147676 - DNA, 601 bp, Human
aatgggttttatagggaagctggcattcattaaaagtaaatattcaccaggcgcactttgggaggctgaggtgggcagattgcttgagcctgggagttctagaccagcctgagcaacatggcaaaaccccgtctctactaaaaatacaaaaattagctggccatggtggcgtggtgcctgtagtcccagctacttaggaggctgagtcgggagaatcacctgagcccaggaggcagaggttgcagtgagctatgatcatgccactgcactccagcctgggtgacagagtgagaccctgtcwcaaaaaaaaaaaagcaaatatttttgaaaaatatatgtttgggaatggtggagaaaaaaattccaggcagaatgaattgtaggaacaaaggcatgtgtacacaaaaacatgggatatagatataggaatttccaagcacacaaatctggagagggaatttccaggcagaaggtacaacacatacaaaggctcagcagcgtgagagcattgcaggtttggggaatcacaagtaattaactattgttatggactgataagtgtattagtttcctagggctgctgtaacaaagtaccacaaat

SEQ ID NO: 147677 - DNA, 601 bp, Human
ccaacattttatgaaattatttatttccagccaggtgtggtggctcacgtctgtaatcctagcattttgggaggctgaggaaggaggatcacttgaagccaggaggtcaagaccagcctgggcaacagagcaagacagtgtctcaaaaaaaattttttttaaagaaattatttatttaccctataatggatcaattctttttcctctttggtcctctgtaaaaacttctatctcctatttagtatgtagtcaattctgccttatgttttgaatagttatttatgtgtctgtcttccactargctttaagttccttgcaagcaagaaccgtatctttttcatattttatgtctccctagttaatgtgcttttcacagttaagtactcaataaatgtgtatttaatttgtaaaaatgtgtatttttaagatatgccacaattgacaagaatcataaaattgtatggcagaaagatccttagaaatttatttagtccaacttcatccttttccagtttgaaaaactgaaatctttaggggttaaatgcctagggtttcgactaccactagaagttttttcctataagttattttatgttcattt

SEQ ID NO: 147678 - DNA, 601 bp, Human
ctaatttgtatatttttttgtagagaaggagtttcgccttgttgcccaggttggtcttaaacttctgggctcaagcgatcctcctgccttggcctccttaagtgctgggattacagacatcggccatcatgcctggcccttattattatttttaaagacacaggacctcaccatgttgcccaggctggccttgaacttatgggctcaagtgatcctcctgcctcacctcctgagtaactagtgaagctacaggcatgcttcactgtgttcagctttataaattattaattttttaaaaaaagataaccccaaatatcatcatgctaattgcctttatttttaaattttaattttggaggacatggtatcgttgctctggaagaaacattaacctttgccattctctgtctgaactgttgccaagactcttcactctcctgtaattacctgtaccttataattctctattctttttatatgatgggagccctgttttagtagtcctccaccctctctttcaggagacaagttcttcatttcagggtaagagaatatttcatgcatccagtagtcagaactgctgcctctgacctgacaacat

SEQ ID NO: 147679 - DNA, 601 bp, Human; identical to SEQ ID NO: 125308

SEQ ID NO: 147680 - DNA, 601 bp, Human
aagcagtggccgagtgccatgcacacgtgtaatctcagcactttgggaggccaaggcaagaggatcacttgaggccaggaatcgagaccaggctggccaacatggcaaaaccccatctctactaaaaatacaaaaattatctgggcatggtggcacgtgcctgtaatcccagctagggaggctgaggcacaagaatcacttgaacccgggaggcagaggttgcagtgagccgagattgtgccactgtgctccagcctaggtgacacagcaagactctctctcaaaaaaaaaaaaaaaaaaagtagaaatttaaaaaagaaatgtaggaggcttcagtttgattcatcttaccatactttatggagttatcaatacctcttttttgtaagactgtaaaaatcctttgcctaatttccagctaaaagagagttgaggaggtcagaatgaccttgttctactgcagaaagcataattatttttatttagatatgatctaggaaaattgagttgctaaggaaactaaaatgccacctataagccatttttcaagctgcccatcctgatgttaatcttcaggatgccaagaccccaagagagctcg

SEQ ID NO: 147681 - DNA, 601 bp, Human
caagaatcacttgaacccgggaggcagaggttgcagtgagccgagattgtgccactgtgctccagcctaggtgacacagcaagactctctctcaaaaaaaaaaaaaaaaaaagtagaaatttaaaaaagaaatgtaggaggcttcagtttgattcatcttaccatactttatggagttatcaatacctcttttttgtaagactgtaaaaatcctttgcctaatttccagctaaaagagagttgaggaggtcagaatgaccttgttctactgcagaaagcataattatttttatttagataygatctaggaaaattgagttgctaaggaaactaaaatgccacctataagccatttttcaagctgcccatcctgatgttaatcttcaggatgccaagaccccaagagagctcgctagtttaactgtcttgttaaacagccataaagaacaaattataatccaataaatgctttagttgtgagccaaagaagatagaggattgcagcacttgtggtattttaaagaacaacattgaagaattaagtaattaagagtgtgggctttgaagtctgatttaaatctaggctctatggctggctagc

SEQ ID NO: 147682 - DNA, 601 bp, Human
atttaaatctaggctctatggctggctagcttatccctgaacatggtacttaattactctctacagtttcctcacgtgtaaaaagtgaataatactagtatttacctccaccactattgtgaagattaaattaaaatgcctgtaaagtgcttagaagatgttccctccataataaacatttaaagagtgcttactttttgagggcatgagctgtatttgttggtgagcattttgtaaactggaattactctaaaaaaacccacaaaatctaataatggattagaaaagttaacattaaaartgggtaatacagttgatcaaagtcaaaactattattagcctggcatggtggcataagcctgtagtcccgcatacttgtgaagctgaggtgggaggatcacttgagcccaggagcttgaggctttagtgagccaggattgcaccactgtactctagcctgggcgaaaaagtgaaaccccatctcaaaacaacaacaaaactagtgatatttatttgattagctaaaagcatcaaatagacacttaatgacttcatttttttgagacatagtctcactctttttgttcaagctggagtgcag

SEQ ID NO: 147683 - DNA, 601 bp, Human
gataccaagttttttaaaaagtttccttctattgctgttttgataaaaattttaaaatatctattgaattttattattttttgacatcccttggtcatggggtttctgtcttaaatctgttatatggtgagctgctttactggagtggactcaacgtggttattgtatattgtcttttttgtattttttattgatatagttgtacatatttttaggatacacatggtattttgatatctgtatacaaagtgtgatgaccaaatcaaggaatttgggatattcatcacctcaaacatttatctttttgttgagaacattagaattcttctagctcttttggaacatacgataaattattgctaactgtaatcttcctgctgtcaaatactagaacttattccttctaattgtatttttgtacccattaaccaacttctcctcatcctgccctgccttcccttctcagcttctgggaatcaccattgtaccctctacctccatgagatccatgtttttgactcccacagatgagtgagaacacttgacatttgtctttctgtgcctgacttctttcacttaacgtaatgacctccagttccat

SEQ ID NO: 147684 - DNA, 601 bp, Human
ccctctacctccatgagatccatgtttttgactcccacagatgagtgagaacacttgacatttgtctttctgtgcctgacttctttcacttaacgtaatgacctccagttccatccatgttgctctaaataacaggagttcattcttttttatgcctgaataatagtccattttgtatatataccacgccttctttttttttttttttttttttttttgacacagggtcttgctctgtctcccaggctggagtgcagtggtgcaatcatggcccacttcccttgacctcctgtgctctggkgatcctcccatcatagcctcccaagtagctggggctacaggtgcatgccaccatgcccagctaatttttgtatttttagtagagacggggttttgccacgttgcctaggctggtctcaaactcctgggctcaagtgatgtgccctccttggcctcccgaagtgttgggattacaggtgtgagccaccatgcctggcctataccacatattctttatccattcatccattcatggacacttaggttgattccatatcttgactgttgtgaatagtgtgctggaataaacatgggcatgcag

SEQ ID NO: 147685 - DNA, 601 bp, Human
acaaaggtgtatcacttagtttgtttagttactagtttagtcatttatagctaatattggtaaaaattctagtgtgtagtgttttctacagggatattgcctcaaacacttgtttttggagttaacatacatcaagtggtcacatctggtcaaatgatcagaagttgaaattctaccttgtggtaaatatattcttgaaaaaagtgataggtatatgcaaagactcattttagtgctcagctcaaatagtaaagttttacttcgcataagtttagatttccctgaaatacataaactcatkaatttcttgatcattgtattgtactagcaattaacttagctttcagaattatggaggaaaagctaataaaagtaattatagaacaccagttttggagtaaagggtttttttttttttttttttgggacggagtctcgctgtgtcgccccagctggagtgcagtggcgcgattttggctcactgcaagctctgcctcccgggttcatgccattctcctgcctcagcctcccgagtagctgggactacaggcgcccgccaccacgcccggctaatttttttgtatttctagtagagacaggg

SEQ ID NO: 147686 - DNA, 601 bp, Human
ttgttaggttgagacccaaaaagtttagttgggaaattaaaccagagaattcagtagaatgtctgaggctaaatctggggtctcatgaggtctctaatggccttgcacatgattttccttaactagctcagtggtcagcttcatgctattttccccatccttccagctctcccttttccattttcattagtccctctactctgtatctcagaagttctttaccttttttgtgctgtgggccaattggcaggccctgtaaagcctgtggacacatccccagaataatgtttttaaatgtatraaataaaatacattaaaatatgaaggaaaccaattatattgaaattcagttttaataaattaaaatgattttacattaataacatacttaaatagagatgagcataaatgagactttgagatctataaaaaccataatctcatataaaaatatctaatatcagttacaatctcaggtacttctattatggtttgttgcttatctttatgattaatgtatatgccaaatttcagttcaaggttaatgaaaatgaaattataataattttattcccatccaagttcatagattaccccctga

SEQ ID NO: 147687 - DNA, 601 bp, Human
aaatgattttacattaataacatacttaaatagagatgagcataaatgagactttgagatctataaaaaccataatctcatataaaaatatctaatatcagttacaatctcaggtacttctattatggtttgttgcttatctttatgattaatgtatatgccaaatttcagttcaaggttaatgaaaatgaaattataataattttattcccatccaagttcatagattaccccctgaagtatgtggctaatggaccccaagataagaacccctagtttaactccttaagctatggagttmaactctagtttgtagagttaggtacaccctattctgaaatccagtggacattgaatgtccattctcccaagcacaaatacttttagtgcatctgtgccagttttgaaacgtggtgggagaggagtcactgtctgctgtaggctgaataatgccccccttccttttcccaaagaagtccacatcttaatcctgcaaccagtgagtatgttaggttatgtggcaagggggagttaaggttgaagatggaattaagattgctaatcagctgaccttaagatatggaagttatcctggattatc

SEQ ID NO: 147688 - DNA, 601 bp, Human
gcagtgagccaagaccacgccactgcacaattaaagaaaaaaaaagaaaaagaaaaatgcacacctaagtaatgccaacttagcatagaaaaataggtgaagaacataaagacaagtcacagattcaaatgaccagcaaatgaatggaaagaaattttcactactcaacctagtgaagatttttgttttgttttgttttgttttgttttgtttttttgagacagagtctcgttctgttgtccaggctggagtgcagtggctcgatagctcactgcaacctctgcctcctgggttcaagcarttctccctgcctcaacctcccaagtagctgggattacaggtacccaccaacacacccggctaatttttgtatttttagtagagacagggtttcaccatgttggccaggctggtctcaaactcctgacctcaggttatgtaggcacctctgcctcccaaaggttgtctgcccacctctgtctcccaaagtgctgggattacagatgtgagcaactgcacccagcgcaaagattttttaaaagaatgcttagtgttgctgtggatgccgcactcttacacacttctgggggaatgtaaattg

SEQ ID NO: 147689 - DNA, 601 bp, Human
gaacctcctaaatggctttgttaagttgctgagttaaagtcaaaaccaaaaaaaaaaaaagtattgggaacataactttatgtaaagtacttttgtggaggattccaaagtacatgaaatacaggccctgccatcaagattctttcagatttagggagtaagatataaatacacaattgtttaagaaggtgagttaaactgttaaacaataacagaaatgcagttggaggaatgatagaaatactaagtcacaggagctcagaggagtgtgagaccagtgactaaagcagtgcgtgtagcyttgtgtgaccaagactaggagtaagaattgcatttggtgtcataatccaaaaatgtgcatactggtacaaaacagaaacaaaagttttattaaatgacttgcccttactacttctaatacagcctgaaactttctattgtttcctttttcagtgctctttgcaacacattgaattgatttcacaatccaccaacaagctgtaacctccagtttgaaaaacactagtataggacagtttctcaaccttagcactattaacattttgggctggataattctttgttgaggggtgctgcactg

SEQ ID NO: 147690 - DNA, 601 bp, Human
ggcagagaccagataatttttcgaaggtaatcacaaactagttcaagaatgaaatagcaaagactgaacataaggtaataaaagcaggaaaggaaaggtgaaaacttttcaaaagggaaatcaacaaaatctgattttagtgattgaatataatggatatcaaaaaaaagtggggattgaagacaaagtcaaaaggtttcaagtccaagggttgagaagaaaatggtatcattatagaaccccattctaaagaagaaactggctttgggaaaaaagtaagctttggttttagatactttamatttgaaatgcaaagggaaatacccaggaggtgacttgaacttttctttcctacctgagggaagacaagagctggacatatgggaatcatctttctagaggtggtagttgaaacttccatgtgaacgagatcctcaaaagagtgaatggtgaggagggagaaagacaagggtggagggtaagatcttgggacgactcttacgttagaaccttggtaggaaatttaaaagacatacaaggaaagaagagattagaagaaagaatagaaaaattgagattttccacttcccttcatccctga

SEQ ID NO: 147691 - DNA, 601 bp, Human
agtccaagggttgagaagaaaatggtatcattatagaaccccattctaaagaagaaactggctttgggaaaaaagtaagctttggttttagatactttaaatttgaaatgcaaagggaaatacccaggaggtgacttgaacttttctttcctacctgagggaagacaagagctggacatatgggaatcatctttctagaggtggtagttgaaacttccatgtgaacgagatcctcaaaagagtgaatggtgaggagggagaaagacaagggtggagggtaagatcttgggacgactcttaygttagaaccttggtaggaaatttaaaagacatacaaggaaagaagagattagaagaaagaatagaaaaattgagattttccacttcccttcatccctgaaatttaaatatacaatatttattctgatactgattattttttggataaaatttctggaggaggccaggcacggtggctcaggcctgtaattccagcactttgggaggccaaggtgggaagattccttgagcccaggatttaagaccagcctgggcaacgtagcaaaacctcgtctctattaaaaaataaaaataaatttct

SEQ ID NO: 147692 - DNA, 601 bp, Human
ttaaaccatgacaaaataacagtgctgtcatcaggtgtggaaaagtgccctttcccaaatgttactgtgcttgtgtcttggctccatttttttctagcttatagctttcctgacacttgctttgacgtcatttttttcctgtcagtatgcctgcctcttctatcatattggtgtgtaaagcaaatatctgaacttcttttacaaacaattttttttcttttttggagacagagtctccctctgttgcccaggctgaagtgcagtggcgcgatctcggctcactgcaacctctgcctccccrgttcaaacaattctcctgcctcaacctcccagtagctaggactacaggctcaggccaccacacctggctactgtttttttgtatttttagtagagacggggtttcaccatgttgcccagggtggttttaaactcctgagctcaggcagtcctcccaccttggcctcccaaagtgctaggattacaggcatgagccgccacgcccagccttttacaaacaattataacaagaataaatagggctcatataatgttctaaaggaatactccgaagattaaaattgacagactaaattagctg

SEQ ID NO: 147693 - DNA, 601 bp, Human
cttgctatgtttctaaggccagagactgctgttactcaatgcgttagtcagtcttttcttggcttcaggaagaaaaatcagagtcatcaaatactactagaatccctttttatttttattcttttggttttttgttttttagagacaaggcctcattttgtcacccagaatggagcacagtagcactatcatagctcactatcatctccagctcctggactcaagcagtcctcccgcctgagccaccccagccgcccaagtagctgggactgcaggcacgtgctaccatgccgactaattytttttttaagagatggggtcttgctatgttgcccaggctggtctcaaactcctggcctcaagtgatcctcctgccttagcctcttaaagcaccgagattacaggcatgagccaccgcacccagctagagtctctttttaaaaaccccaacaggccagccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgc

SEQ ID NO: 147694 - DNA, 601 bp, Human
tgctgttactcaatgcgttagtcagtcttttcttggcttcaggaagaaaaatcagagtcatcaaatactactagaatccctttttatttttattcttttggttttttgttttttagagacaaggcctcattttgtcacccagaatggagcacagtagcactatcatagctcactatcatctccagctcctggactcaagcagtcctcccgcctgagccaccccagccgcccaagtagctgggactgcaggcacgtgctaccatgccgactaattctttttttaagagatggggtcttgctrtgttgcccaggctggtctcaaactcctggcctcaagtgatcctcctgccttagcctcttaaagcaccgagattacaggcatgagccaccgcacccagctagagtctctttttaaaaaccccaacaggccagccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgcgcctataatcgcacctactcaggagg

SEQ ID NO: 147695 - DNA, 601 bp, Human
aaccccaacaggccagccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgcgcctataatcgcacctactcaggaggctgaggccagagaatcgcttgaacccgggaggtggaggctgcagtgagctgagatcatgccactgccctccatcctgggtgacagagcaagactgtgtcttaaaaaaaaaaaaaaacacacacacacacacaaaaaacattatcttctccttcagagttgataagaccattttactgtcttttgagatagtaaatccaatgtaagcaccctaaaaaatacatgttctaaaattgagggacactgaacttattttttccctcaagaagtttgaaactctcatttatacacatacttttgataaccttatgaggtggggaagtctatctgtgggatccaagttgaattgtactcaaaattgaagttagatcttcaaaaagcataacacttaactttgtctggacttggatttttagga

SEQ ID NO: 147696 - DNA, 601 bp, Human
gccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgcgcctataatcgcacctactcaggaggctgaggccagagaatcgcttgaacccgggaggtggaggctgcagtgagctgagatcatgccactgccctccatcctgggtgacagagcaagactgtgtcttaaaaaaaaaaaaaaacacacacacacacaaaaaaaacattatcttctccttcagagttgataagaccattttactgtcttttgagatagtaaatccaatgtaagcaccctaaaaaatacatgttctaaaattgagggacactgaacttattttttccctcaagaagtttgaaactctcatttatacacatacttttgataaccttatgaggtggggaagtctatctgtgggatccaagttgaattgtactcaaaattgaagttagatcttcaaaaagcataacacttaactttgtctggacttggatttttaggatggctttcccctcta

SEQ ID NO: 147697 - DNA, 601 bp, Human
gctttccgagaagcactctcagaatggcttcattgtccctccgcccccggagaagagcctcataggtaagcctgtggtctttcattccacttggattgttttcctttgcattctctccaaaattcactcactgttcagtatatgagactacttctattaacagtcttgtggttagaaaagagacatttccagtgttttcctacactggaggtctagagaaaaatagcatattttggcatgttctccttgggtgcagtaggagctctgggtttagcctccagagatgttcgtttgttttctrttggtcttcaggagtcttacatgattgcggttgcctccagattgaaatagactacattggattaggggtcagaggaagaaacctcttcattttgtttgtttgtttggttggttttttggtttttgtttgtttgtttgtttttgaggtggagtctcgctctgtcaccaggttggagtgcagtggcgcgatctcagctcactgaaacctccaccttccgggttcaagagattctcctgcctcagcctcccgcttagctgggactacaggtgcccgccaccatgcccagctaatttttgtatt

SEQ ID NO: 147698 - DNA, 601 bp, Human
ggttgtaagggtcaaatagcagcctagtattgtcttactggatcaacacagtgatctatttggcaggtccttggcatgttgtaggttacttcttggctcagattgaatgtatattttatgccaggcgggtcactggttaacagttaccacaaaccacagaactaccatgtaggaaaagtgttgattgaagtagacagtctctttcacaggctatgcgtaggctagtcatgattgtcaaaaactgaaaacagcccaattgctaacagtggaagaattaagtaaaatatatcaatataaccawatacttgattctcatcataaacaaagtatacagaaatgttagtacatggacatgtatgttaaaagaattacaaaatttgaaacatgaaatagcatataaatacagctgtagaaacatgtaagtcattaaggatcaaaagaaacactggagtgaaatgttttatctcacaggaaagcaaactagaaggaagtaagtgactgggtagggctatcattttgctttaatttttatttttaaatttttctttcatttgtatgtagtatgtgttactccagtgaagaaaatgatactaaataaatg

SEQ ID NO: 147699 - DNA, 601 bp, Human
gggttgtcctatgcattgtagagggttttagcagcattcctggtacctacccactagatccaggtagcaccccctccccagttataacaaccacaatcatctccagacattgccaaatgtcccctaggaagcaaagtggccccaagtttagaactactgccaggccaggcgcggtggctcttggctgtaattccagcactttgggaggctgaggcaggaggatcacctgaggtcaggagttcgagaccagcctggccaacatggcaaaatcctgtctctactaaaaatacaaaaattagckggtcgtggtggcgggcacctataatcccagctacttgggaggctgaggcaggataatcacttgaaccctggaggcagaggttgccgtgagctgagatcgtgccactgcactccagcctgggcgacaagagcaagactccgtctcaaaaaaaaaaaaaagaactactgccatagagtcctgaacactaaaatctgactttttagcatagtgtgctgtatatgctatagatttttcagcgtcctttccatgccctaggagagtactggggagactgaacagcaatcagattgtttctaaata

SEQ ID NO: 147700 - DNA, 601 bp, Human
tagcgggtcgtggtggcgggcacctataatcccagctacttgggaggctgaggcaggataatcacttgaaccctggaggcagaggttgccgtgagctgagatcgtgccactgcactccagcctgggcgacaagagcaagactccgtctcaaaaaaaaaaaaaagaactactgccatagagtcctgaacactaaaatctgactttttagcatagtgtgctgtatatgctatagatttttcagcgtcctttccatgccctaggagagtactggggagactgaacagcaatcagattgtttctraatatttggcatgcttgactactaggttatccctgaaagtagccttgatctgaatcaataattttcttgtcctcggatatttgttcactgaagaaaattcgaacacagcacgatttcagtgtcttaagacttttaagtctggttttgtacaaagtgtgctaatccaagggaacttttgacttttaacaagagtatgcttggtacttaagcagttcatgcctgggtaggcagacaatctcaatttgaggtcacctggccacgtaacaccccagtctactttttttctgtataaaatatcaa

SEQ ID NO: 147701 - DNA, 601 bp, Human
tcgtggtggcgggcacctataatcccagctacttgggaggctgaggcaggataatcacttgaaccctggaggcagaggttgccgtgagctgagatcgtgccactgcactccagcctgggcgacaagagcaagactccgtctcaaaaaaaaaaaaaagaactactgccatagagtcctgaacactaaaatctgactttttagcatagtgtgctgtatatgctatagatttttcagcgtcctttccatgccctaggagagtactggggagactgaacagcaatcagattgtttctaaatatttggcatgcttgactactaggttatccctgaaagtagccttgatctgaatcaataattttcttgtcctcggatatttgttcactgaagaaaattcgaacacagcacgatttcagtgtcttaagacttttaagtctggttttgtacaaagtgtgctaatccaagggaacttttgacttttaacaagagtatgcttggtacttaagcagttcatgcctgggtaggcagacaatctcaatttgaggtcacctggccacgtaacaccccagtctactttttttctgtataaaatatcaaaagctga

SEQ ID NO: 147702 - DNA, 601 bp, Human
ttggggcgtggtggctcacgcctgtaatcccagcactttgggaggctgaggcagatggatcacctgaggtcaggagttcgagaccagcctggccagtgtggcgaaaccccatctctactaaaaatacaaaaattatctgggcgtggtggtgtgtgcctataatcccagctactcaggaggctgaggcaggagaatcgcttgaaaccaggaggtggaggttgcagtgcagtgagccaagatcgcgccattgcactccagcctgagtgacaagagtgaaactccgtctaaaaagaaaatattyggggaacttttgcagggcagtgagggagccgctggaacccggctgggcggctggccccaggcacagatccttgatccaggctgctgcttggggcctattaagcaagtccgggtgggcgtggttagtcaggccagcagcttccttccctggaaatgctgattgtggtcaaggaactggaaacaaggaaaactagcaaatagattttggggagcttcttggaggccttggtagcctagagcaggtgagtgtgtggttgggaaaaagcaatgtggccctatggtggttttaggtgttgattta

SEQ ID NO: 147703 - DNA, 601 bp, Human
gccgtggctgctgaggaagcctctgagaatgactccaggccttcctgaggcctagtccccctgttctttttctactctacgcagacttgtcaaatcagaatctctggcccggcatggtggctcgcgcctgtaatcctagcactttgggaggccaaggtgggcggatcacttgaggtcagaggttttttttgtttgtttttgtttttgttttagatggagtctcgctctgtcaacaggctggagtgcagtggcgcgatctcagctcactgcaagctctgcctcctgggttcacgccattctyctgcctcagcctcccaagtagctgggactacaggctcctgccaccacacctggctaattttttgtactaccgtgttagtagccaagatggtctcgatctcctgaccttgtgatccacctgcctcggcctcccaaagtgctgggattacagcgtggccaccgcgcccggccgaggtcaggagttttagaccagcctggccaaccatgtaaaaccccatctctactaaaaatacaaaaaattagccagggctgggcacggtggctcacgcctgtaatcccagcactttgggaggccaaggtg

SEQ ID NO: 147704 - DNA, 601 bp, Human
tgccggactctgacttacgtgtggaatcctctgtgacacctcatcttacccacagggacagacagacataatgatcaattgagccctcatatgtaaaatcgctgtccaaatgtgaaggcttaataatggtgccataatatgaggtgatcctttctttcctctttcttcccagtgggagtctcgggtgactcaatatgaaagggacttcgagaggatttcaacagtggtccgaaaagaagtgatacggtttgaggtgagatagaaaatcctacttctcacttagcatgcagtgcttgttttrggagtactcttggtgttgtccaactctgttgggtaaagagagaggtgccagtaacttggcagttctcgtgagcaggcgtggccttctttgggggggtgtgtgcttgatcctaggaacagtggcaatcttacacttgtggctggaccacagcagttaaacacaaatcttgcagctgccatataccctcggtcccctgtcgtttctcctccacttcccatctcctgccctccaacaaagcctttcaaggccttggcagaccctctttggctggaaattacagctgttccacctgctgcctct

SEQ ID NO: 147705 - DNA, 601 bp, Human
aacacagtttcatgtcacatgagtaagcactctagccacaggatcctatgtgccacagccctccatggatgtgagtctgtcttgagcacatgaagcctttacacagacctgaaaggctaggaatggaaaggagaaaccagatgtcacttaaattttactattaaaacctaagagcaaatccctaacttggagaggattttattccacttaccctatttttaaaattttaagacatgtcaataaaaatgatataacctgttagtgtgttttacattacatatttttaaagttatttctgtargtaatcaattacatattttttccttcaggcgagttagattcagcactatcaatttcaagcaatacaatttcaagggataaaaggtatgtccagaaagctctaaaaatgtctgctatttgccaaaacaaagctttcactgacaggtgtgcctgaggctaacagtagaatagactgtgtccacaggttcgctgtgccagcagatttttctttttgttcttttggaggaaaaagtcaggcctttaccatacaagtctttcacaatcactgatggttaactcacatgagtctttttcattcatc

SEQ ID NO: 147706 - DNA, 601 bp, Human
aggacagaaacaattagattttgagagtcctctgtaaacctctgtcctaagcctaattttttgttttatcccattgtatgtctactaggtctaacaaggatttcttttgagtttctgtgttaataatggtgatggatttgtacttactcatccacaatccttccaatttccctgcagcctatatgcaggttcaagttggtgaaacgagattagagttgtagtctgtgtctttgaatagggtagagtaaataaagccaagtagggacaaaaccctgaccttaggtttcaatggcttttgctycaaaacttagcaaactcattcacagatgataccaaaaatcaaatcaaacccaagaactgcttgatttctacgtgtgactaactgattatctaaggaagttgctttatgtagcatgctttaaaatagtatgtgtagacagttcacaaaaccagataaaaattctataagagttatcattccttagaccttgaaaatattatgctaagtgaaagaggtcagtcacaagggaccacatactgtatgattccatttatatgaaatgtccagaataggcaaatctgtaaagactgaaagtagatt

SEQ ID NO: 147707 - DNA, 601 bp, Human
agaattgctttgcctattctcagtcctttattctttcaaataaattttggaattggtttgtcaaatcacatgaaaacccctgctggggggaattaaaatctttaaaatatcaagccttctcatctacaaactcggtatattttttcctttcattcaggtcttttaaactgtctttatataaatttttctacaaaattatattttattatttatattacttatttaaaatatctttttaaaattatatttcttaaattatcttttcatctatttatcccaatttactatactatgttaaatkaatttcatcaaattatttactaaagttataaactctaagattggcccggtggctcacgcctgtaatcccagcacttgaggaggcagaggcagttggatcacctgaggtcaggaattcaagaccagcctggccaacagggcaaaacccgtctctcctaaaaatgtaaaaattagtgggcgtggtggcgggcacctgtaatcccagttactggagaggctgaggcaggagaatcgcttgaacctgggaggcagaggttgcagtgagctaagatcacatgactgcactccagcctgggcaaca

SEQ ID NO: 147708 - DNA, 601 bp, Human
aaagaaatctttgcttatccaatagtcatacataatttgtacactttattctaaaaatatttttctaaagtattttttcatattttggtatttaactcacttagatttcatttttttgtgcatggcttaaaatggggatagaactttattttatttttccaagcagataaagaaattttcccagtatcattactacagattccatcctttcctttacagctcatgaagctgattctgccataaatctagactcatgtatatcttagtctgttccaggctgtctcttgtattccagtgcttygtttgtctatgcctatagccatactgcaatatcttaatcattacagctttataatgagtcttgttaactggtggagcaagtccttccaccttgtgcttttccagaattgctttgcctattctcagtcctttattctttcaaataaattttggaattggtttgtcaaatcacatgaaaacccctgctggggggaattaaaatctttaaaatatcaagccttctcatctacaaactcggtatattttttcctttcattcaggtcttttaaactgtctttatataaatttttctacaaaatta

SEQ ID NO: 147709 - DNA, 601 bp, Human
accaaactgctttccagaaaggtctttaccaattcacattctcaagagcagtgtaggagagtgacttttacagtgtacccatgcaaaaataaattattctcatctcttctcatctttgccaattgattacaacaaaaaagaatagctcaaatttgattactcttaagggtgaatagttttcatatgtacacttactcttgcaataactgccccaattctttaaacaacaatgcaaacccatattctgagaaggctggaaagatgggaagagatacccttggaagagctctgcaggggaggmaggggcggggctgggggtgtagatttaatcttggaggctatgaagaacagtaaagatttaggaggaagggagtgacagcaaatatggggaaaatctaaatatttcatgcaaggggaatagtcacattaacctattatgattaatctatgctgtcagatggaaccacgaaagcagaatcttccagggcaaacaatttcacattgttaaaaaattccctaagcaattctgatgttctcagccagatttgcaaacaatcgctttggttcactaagtgaaatcactcctattcttccatattct

SEQ ID NO: 147710 - DNA, 601 bp, Human
tttttcaaaaccacaattttcttctgggtatatacttaaaataattaaaagtagaaccttaaagagatatttatacaccaatgtttaaagtagcatcatttacaatagccaaaaaagttggaaacgatttaaatgtccatcaagagatgaatggataaacaaaatgtggtatatacatacaacacaattattattcaaccttacaaaggaagaaaattcagacatatgctacaatgcagaggaagatttgagggccttatgcttagcaaaataagctagccacacacacacacacacacaaaaaacccaaagcaaatataataccacttacatgaggtacctagagtagtcaaattcagagagatttatagaaagacagaaagtaatggtggtgcccagggccggcggaaggagagaatgggcaactgttgtctaacagatacagacttttagtcatgcaagatgaaaaaattttctgtggatggatggtgatgatggttgcataacaatatgaatgtacttaatgccactgaactgtacacttaaaatggttaaaagagtaaattttatgttatatatattttaccaccaaattttgaat

SEQ ID NO: 147711 - DNA, 601 bp, Human
atttaccacattttgggctgggtgcactggctcccagccctttgggaggacaaggtaggcggatcacttgaggtcagtagttcaagatcagcctggccaacatggtgaaatcctatttctactaaaaatataaaaattagccaggcatggtggtgtgtgcccgcagtcccagctactcgggaggctgaggcaggagaatcacttgaaccccggaggtggaggttgcagtgagccaagatcacaccactgccctcctccctgggcaacagagaaagactctatctcaaaaaaaaaaaaaaaagaaaaagaaaaagaaaaaaagcaatctaccaaattttggagaataaagagctaaacacaaaactctcaaggacagataagaaatctccgacagtatttaagggataagaagatagaaatatgcctgcctatcaattaaaagttcaagagggtcacagctaagaagcagagataaaacagaaacagataaggtcaatgaaaatgaaaacccagacccaacccgactcaactgcatttgttgaagtaatcagcttcttaccctatctggctaacagaggaaaaggagaatctctgtgagtga

SEQ ID NO: 147712 - DNA, 601 bp, Human
cgcataattaattcctgactgtagtgttggctcagattcaaatgcctttttgaacctataaaaaaccacaaatgtacaagttaactttctcaatcatgaaaccctgggtgtgtaatagcttctgtttgtataactccaatgcctgagcaagtaaaaatattgcactggccttcaccccagaatctggtgtgctattaggacttaacgcttcagaaactgcttatctttgtccacagctctgttgctttcccccgcttagctcaccctcaacctacctagtaaccctagtctttaaaaaaaatcctctcttcaaccatctaccagaaatatgtgaatgtgaaaatttagttacaagggcatttgttacaagatgaaaaattactctaaatatccaataatattatacagtatgatatggaataacatatattccaaatgttagaaagctatgtagtcatttatgttgtagaagcatgttaaaagtcagaagaaaactagtgtttccaagtaaaatgtagtcgtctacttggaagccatcattcagggtgtgtgtgtgtgtgtgtgtgtgtgtgtgtgtacaataaacatttaaaaatgagaa

SEQ ID NO: 147713 - DNA, 601 bp, Human
aacaccggtgaaatcatagggaaaggtgtgcttgagaaacagataaaggaaacagcagaggtttttgaaaaaaaagcaccacaaaagcgcaatctaaaataggaaatattcctgatgtctcacaaaacagtaaccttatttaggagttgggggttgaatgcagaacccatatcctcaatattagtttgagctggaatattaaccagggggacttttagaaacaggtaagataaattaaaaactgaattatgtcctaatatcaggattctgtacaacagtatgaaacaccaaacaaggagayataataagtttcttttttctctttgggaagtatgaaaagacagaaagcaaaagatttatctattcatgattctttttctttgcaccaagttgggtccagtttcttgatttccatgtaaaatatcaagttgtaattaccaactttccggagctcaaaggaagattcaaactggtgtccagctgccaggaggaggaccgcataattaattcctgactgtagtgttggctcagattcaaatgcctttttgaacctataaaaaaccacaaatgtacaagttaactttctcaatcatgaaaccct

SEQ ID NO: 147714 - DNA, 601 bp, Human
attcttttagtctgggcatttaaaaaaataaacaaataaatattctgactttatttagcttcagagattctccagaacattacataaagatacaagctcttccaaaataatgtcttttttttaaagtctaggattcatttctctttaagaaaagtaacaagaaattcgccaaagtgggcccggtgcggtggctcacacctgtaataccagtactttgggaggctgtggcagaactgcttgaagccaggagttcaagaccagcctgggcaacatagtgtggccacgtctttataaaaaaaawtttttttaattagtcagctgtggtggtgcacgcctacagtcccagcttcttaggaggccaaagtgggaggatcacttgagcttaagaattcaaggctgcagtgagctatgatcgcaccactgcacccttgcctgagtgacagagtgaaacctggtttccaaaaaaatttttcttttattttgaagaaaaagtttcttctacaattcatagcttcactaagatgaacgtgttattttttccctatgaaaaacaaggctgaatatttctatgtctgtagtaattcctaaaagagttggaaag

SEQ ID NO: 147715 - DNA, 601 bp, Human
tgtgccattgtgccctgagcagcagagtgagaccctgtctcagaagaaaaaaaaaattatttcaaacagacctttatgcctttaatacccctgctatcccacagtaataaatactttatcattcttttagtctgggcatttaaaaaaataaacaaataaatattctgactttatttagcttcagagattctccagaacattacataaagatacaagctcttccaaaataatgtcttttttttaaagtctaggattcatttctctttaagaaaagtaacaagaaattcgccaaagtgggccmggtgcggtggctcacacctgtaataccagtactttgggaggctgtggcagaactgcttgaagccaggagttcaagaccagcctgggcaacatagtgtggccacgtctttataaaaaaaattttttttaattagtcagctgtggtggtgcacgcctacagtcccagcttcttaggaggccaaagtgggaggatcacttgagcttaagaattcaaggctgcagtgagctatgatcgcaccactgcacccttgcctgagtgacagagtgaaacctggtttccaaaaaaatttttcttttattt

SEQ ID NO: 147716 - DNA, 601 bp, Human
ataaataaaatagcagaggtttttgaaaaaagcactaagaaagcacaatctaaaccagcctgggcaacatggcaaaacctcatctttacaaaaaatacaaaaaaattatccgggtgtggtggtatatgcctgtagtctcagctacccgggaggctgaggtgggaggatcacctaagtcttgggggtcgaggctgcagtgagctgtgattgtgccattgtgccctgagcagcagagtgagaccctgtctcagaagaaaaaaaaaattatttcaaacagacctttatgcctttaatacccctrctatcccacagtaataaatactttatcattcttttagtctgggcatttaaaaaaataaacaaataaatattctgactttatttagcttcagagattctccagaacattacataaagatacaagctcttccaaaataatgtcttttttttaaagtctaggattcatttctctttaagaaaagtaacaagaaattcgccaaagtgggcccggtgcggtggctcacacctgtaataccagtactttgggaggctgtggcagaactgcttgaagccaggagttcaagaccagcctgggcaacat

SEQ ID NO: 147717 - DNA, 601 bp, Human
atttgggtgcactccaagaacaatttcaaattagaaaaacacacaaatataagaaacactcaaatgtgtcatcagtcaaatcctaagtaagaagaaaacaaaatcaagaatgagaattccaaaactgagattagatcacagaggaaacaaagggcatatgtttggagtagaggtctaacagctgcaatggaaatgtggtctcaggccccgaacataagttatatttgcaggtgcaaaatgcatggcctctgcatgattcacatgggtgacactggccaatctgggccagtgggttggtcartgtgcaggagaggctaagtcaggaacctgctgacatcacctatgtccaaagtcatcagaattgatgtgtaacacgttttatgaatatcacaattttcctctatattctgcattttattttataagcaaataaaatcatctaattgtcagttcaataaatataatatgggaacaatatggagctgtttattaattgtatcaacatataatagctaattattaccatgctggtgtcttcagtttaaaaagcttttcagatgcttgaatgactctcatgtggtcattggctaggacgctggcc

SEQ ID NO: 147718 - DNA, 601 bp, Human
tgaaatgacaaaatgtgagaaatgcatagcacacattacagaggtcacagaaaggctgggaaacagaccagggaatggaggcaatttgacaaagtcttaaaggtagatatacctcacttatgagtttatatattcttgcttttagttccttgtttttaggttaatattataattaactgctaatttcatgtatctgaatcaaaaaggaagactgcaaggcctataaaggatagatattaaccagatgtttaagtttctacagggtctttgaagtaccatacgtctctccttcctctttccygacgttagataatgagttgatggtctccaaacttttcaatgtaagaaggaaaggaaatataccaagaggagaggtaagaaaaaagaataaattgaagtgataaatgatggtaccattcaaatcatttcccaaataaactttcaattttcttttgcccagagtcacagttaattcttggagaaatgagaatgaatacagtattgagataaataaaaacaatcaaatattttctaaaataggccatcctggattttatttagatgcatttcaaaagaaggataatgttatcatcctaatcaa

SEQ ID NO: 147719 - DNA, 601 bp, Human
aaggtgctatgattcattatctacttgtatagatgcttaaaggcatcttcctggcccaaatttcctaggcagacttcactaggaatgtttaaaaaaagaaaagtcaatacttaactattagaggaactggaataatcattctactctactgcttaacactcaagaaaattatctttagaactaatcttgaatcaagcaagttttccaaataaaagtggaggaaaactccttcagaaggctccacccataaggaattacagattcataatacagtaaaacatgaaatgcactctcagaaagmaggcacaagaatctgggcatatttgttttactctcaacttaccttaacagcgcatttacttaaggtacagggaactagagaaagggaggtagaaaaaaacaatttttctttactctttgaatattaaaaacgttaagggctccaagaattctcagtcagtctctagctgtgaaaataagatgggctatgcaacaaataaacacacagtgagagcccataagtgaacatattctgactcaggaacaaactcacccagtgaatcaaaatcttaattccaatcaacagagacataagcggtaa

SEQ ID NO: 147720 - DNA, 601 bp, Human
atggtaccagtgtaagattaaaagtggcatcattctgacaggcttcctaaaattaacatatgcatcttttatgtcacgtattttaagtattagttcttcggtgcataacttacggcatgaatttacaaaagagaaatattccaattctgagtatgctttggatggttatgccatctataataaaaatccaaatagttcaattatattttattaatactgataaaaattcataattcaaatttaacaagttttataatacggaatgcatttatgccaagacagacacacagctgagctattycttcttaactaacacagacatttgctggagtatgtaaatgctagaagggtgtaaagtcccttgttactaatgctcttgtgttaataactgcacaatttaccttgtcatcaggaagcacgtgccaaatagagattgtcttttcctcaacttcattgttgatagacaaataagaaggttgatagattttggttggttctaatattaataccttgaaaagatacggcaaagaaactaatatcagtgacttaagactgaaaccacttagagctgctataacaccccagcaccaacgtagaggat

SEQ ID NO: 147721 - DNA, 601 bp, Human
cacaaactgggattggagaaagaccacagttctgaaagatgctgctcggtattgctcagtgctactagatggacttggtgttgagagcatgagaatggatgtttttctccatgcttattatgtaatttcatgttgccaacatttagtgtgcctgctaaaatactaagttacaagacttaacgtgaccaactttatctaaacatagaacaaattaaaatataaataacatgcattctgggtgctgcttagtatctattcattttaaacacaagatactgcccttcctagaaactatagcacygggactggtgatttcttgccactctggtagaggtcacagggcctggccatgattgacatccaggaaggatctgtcccagctgatttggacacatcaaagcacgggacattcttcttgctagattatggacatgctgtgttgttttcctgttgaacttcctaaggtggtggttcacatacgtgaggtctgaaagtctacctcatagaattgtcctcagtaggtctgacatgcagattaggaatctgcaatttattttattttatttattttttgagatagagtcttgctctgtcgcccagg

SEQ ID NO: 147722 - DNA, 601 bp, Human
ttgtattattccactctaggatctctacctgcctcatatctagctagttcctctaacagtcttctctgtgaccctccagagcctcagacttcagaaatcaaatgtcaagaccagatcagtcttatagctacactagcaaccattatggagcacttgttccaagccacttagcactgtgctaaatgatttccattcatcctctcacttaatcttcacaacaattctatgaggtactgttattctcattttacatacatggcaactaaagcatgaggagttgaagcgcatgcctaggccacgmagcatgcaagagctaacatcaaccttcacacctatgcactttgatgctgaccctgggttcataattcacattctgttctgccttcctgccagctctcagattttcagaaacgtcagtgacatcctgtttcctaccgacacatgtttaaaattcttcttcctagcttacatagcactctagagttttatgtcatcctgcccaaccaatcatatctcccacctccctcaacacgtttccccttgtagaatgagtcagactctgccggcccctgaacgtcccatgcttgctttcactttggtg

SEQ ID NO: 147723 - DNA, 601 bp, Human
atggaaaatggacagtacataacttaaatttgtaaccctatttaatgcacttgtttatatcctaatatatatcctaatatttcttagcataatataaaaattgtctctatgattgtcacaaaacataagagaatgaaaacgaggctcactttactgagcaaagaacctccaggaaggagaaaacaataacaaattgctggaaatagtactcattttccaaaaatctctggcttactttctgttctttttctgtcttccaaattcttctggctctctactcattctctaggccttgctaatygctaattcctctagcctcactctgtttccaagtgtccttggataaccttgctcttttcaatcaagcctttgaaaatctcctcctccagtcctgctctcgtctccataatgttcatgtctcctaactgttcttagtttttgtagtttccactggatgattagtgtatctcagcttgtgagaacatgtatgtgtatacttgcatacatgcaaaacaatataaatattgcactgcactttaaagcaatatcactaacatgtatatagacagttatattgattattcccaattttgccactgga

SEQ ID NO: 147724 - DNA, 601 bp, Human
gaaaggaggggagcatttccagaatgcttggttcctgaaaggttgccagtgctgccagggaacgttccatttcagtgatgtaaataaagcccaagccctgagatggaaggtggaaggaggcctccctccccacctacctgtaggacacaccacaaggaggcgctgatgagctgtaaagccaacaggtagtttaaaggctcctgggatctgtctgggaatcagggaaaacagcaaggccaaacgcagcgctagctataattagccccaacaggcctcaaaccaacactcaacctaatttaawcagcacaagcaccattttctaggaacgggttagcctcagatcccaggccccagttagggctagaataggagctggaagttaatactgtattgactgaaggtggcaggagttatactgtagtaggcactgtcagctccctcagcaactgtcattccatccttctcctctgctgacaaaaaaataaattttgcccaggttcaggtggcaatgtttatgaatggtgaaactgattagtctaaattggccacggtaagtccatttgccttgctggggatgggtgtaagcatggtcatgtgatac

SEQ ID NO: 147725 - DNA, 601 bp, Human
ttctgtaaagttaaaacaaccatgaaaaggagttcttacccacccactgccaggaggctgaggtcttgcctgggctaataaaatgggtgacaaagccttgtggctctgaggtggcctagaaccctccttttggctaaagcaactcaaaagcgacaatttatatctacagcccataattctttgctaggtccatgcaacttaaagtaaaaatagatcctctcaagtcagatgtgaatttactaaaaagctagtttcagtgcatgtcagtcaggtcatggggatgtgatctgaatgaacgcasagcaaattttgttgcatgaagtccaggagggaagataccataaaaaggtatgtggtggctgtcttaaccagagtacagagggagtgaaattaaaatagcagactgcagcctcagctggtaatttggaaagttgcttctaaatcctgttggcctcaggtgaacttctaaatatatatatatatatatgacccaggagctgcagctgttacctgtacactacttgcatacaatgcagccttatcctcagagcctgcagctgagctgctttccaagaccatgtccaggagcaggaggtgggag

SEQ ID NO: 147726 - DNA, 601 bp, Human
tgtttctgttcagatcattcatgaggtaacaggtagctttaccaggagaactccaattattagtgactcagaccgctctaccaatttatgctctaataaaaccaattattattattccaaaagcaacaggatattgcataaccaggctgcaaaaatctgttgtctctcattgctatgacgtgggggtaaacagtagttagcacatctaatttggtttgaaatctgcaagagttgatttagcatgagcttcaatagaacaattatttaaagacttaaccactgactcttgattcttaaaaawatatatatatattatttctaaatcccaagaaatggcattttctaagctactggcattgtgacagcagtcagaactgaaccaaactgaagttcaccactgtaatctcaagatcaatgcaggaaagtgaccttacagaaggttttttttttttttaatggactccttatcatctgaagtcattagtgttagtgacaggggccgggcggagtggctcacacctgtaatcccagcattttggaagccctacacgggcggatcactgaggtcaggagtttcagaccagcccggccaacacggtga

SEQ ID NO: 147727 - DNA, 601 bp, Human
cgactgaaagatatataatgagtcagtccatcatcttgcttgtttctgttcagatcattcatgaggtaacaggtagctttaccaggagaactccaattattagtgactcagaccgctctaccaatttatgctctaataaaaccaattattattattccaaaagcaacaggatattgcataaccaggctgcaaaaatctgttgtctctcattgctatgacgtgggggtaaacagtagttagcacatctaatttggtttgaaatctgcaagagttgatttagcatgagcttcaatagaacaaytatttaaagacttaaccactgactcttgattcttaaaaaaatatatatatattatttctaaatcccaagaaatggcattttctaagctactggcattgtgacagcagtcagaactgaaccaaactgaagttcaccactgtaatctcaagatcaatgcaggaaagtgaccttacagaaggttttttttttttttaatggactccttatcatctgaagtcattagtgttagtgacaggggccgggcggagtggctcacacctgtaatcccagcattttggaagccctacacgggcggatcac

SEQ ID NO: 147728 - DNA, 601 bp, Human
ctgaggtgacgcaaggcaagctgctgacctagttggattttcttccatagtttgtcatctcttctttgtggaggaggaggccaggaagaatgagctctctttgaagtcacagactacaactcaagtttctcagcatataagccagcaatagtaagatagatagtagcagcctatgtataagtcataaatcacaacaactgttacatagggctaccatacctaattaaagaaaatttattcattggaaaacagatatgataaagtgaaatttacatttaccatactttcttaagtggattgmttaaaaatgcagcaataaatagtgagtgccttgctaatgactggctttaaaaattaaatattaagagtacagttttatttgagaaagtatcgactgaaagatatataatgagtcagtccatcatcttgcttgtttctgttcagatcattcatgaggtaacaggtagctttaccaggagaactccaattattagtgactcagaccgctctaccaatttatgctctaataaaaccaattattattattccaaaagcaacaggatattgcataaccaggctgcaaaaatctgttgtctctcat

SEQ ID NO: 147729 - DNA, 601 bp, Human
tctcttcggtaatggtgttcaccatctcaaaaaacctacaatacaagttagcacgtgagcattcataacacaaacaatagtaaatataagcaagtacatctcaaagtgacttcagaaccaaaactgagagctaagagagtctccagaaccaggcaataacacactatcaagatcatgtgaaaaatacaatttttcaaaaagaaaatgcaggttggtaggattttctagaaatttctaacctaatgcctcacttcaaatacatttttcttcaggaactcttcttgtaaagttttttttttttcttctagagaccatttcagagacaagcaaagtgattacagtgagaaacagattggcatcctgctcgctgtgactaggccattcagagaggaggctgatggttcacagacataaagccgggaagcactgtgaacgtgggctgatgatcccacaggcaggtcatgctatgcgatgccagcttaagggaagagcaggttatggtgtgataagaaaagttcccctaacacaactcagaacctttcttacccacccatccatccattcattcaacaaatactcactgagtgtctactaggataaa

SEQ ID NO: 147730 - DNA, 601 bp, Human
gagaccacagagagctagccagcttcttctaccatgtaaggacacagcaacagggcaccttctatgaggaacaggccctcaccagacactgaatctaccagcaccctgatcttggacttcccagcctccagaagtataagaaaataaatgtctactgtttacaagccacattgtttacagtattttgttacagcagcccaatggactaagtcacttggattcagagttctctcccaagtcaaacactgggaagggcttggagaaaatggtggccatgtgtcaagcctggagaagtgtcatycttcagacattgaagatgctggagtcagcattgttgacacactccagcattggtccttgcagtggaggaaggctcttcttcacacagcagacatggcagagaaaatggacacaaactaaaagtaggtgtccagcagtcgggtgcggtggctcacgcctgtaattctagtgctttgggaggccgaggtgggaggattgcttgagcccaggaattcaagaccagtctgggcaacataacgagaacaagtctctataaaaataaaaataaaaaccatataaaagtaggtatccatagtgctct

SEQ ID NO: 147731 - DNA, 601 bp, Human
ccccaaggtgcagttattaggaggtgaggcctttgggaggtgattaggtcttgaaggcagagcagggtaacattagtggccttgtaagagagaccacagagagctagccagcttcttctaccatgtaaggacacagcaacagggcaccttctatgaggaacaggccctcaccagacactgaatctaccagcaccctgatcttggacttcccagcctccagaagtataagaaaataaatgtctactgtttacaagccacattgtttacagtattttgttacagcagcccaatggactaagtyacttggattcagagttctctcccaagtcaaacactgggaagggcttggagaaaatggtggccatgtgtcaagcctggagaagtgtcattcttcagacattgaagatgctggagtcagcattgttgacacactccagcattggtccttgcagtggaggaaggctcttcttcacacagcagacatggcagagaaaatggacacaaactaaaagtaggtgtccagcagtcgggtgcggtggctcacgcctgtaattctagtgctttgggaggccgaggtgggaggattgcttgagcccaggaa

SEQ ID NO: 147732 - DNA, 601 bp, Human
accccaaggtgcagttattaggaggtgaggcctttgggaggtgattaggtcttgaaggcagagcagggtaacattagtggccttgtaagagagaccacagagagctagccagcttcttctaccatgtaaggacacagcaacagggcaccttctatgaggaacaggccctcaccagacactgaatctaccagcaccctgatcttggacttcccagcctccagaagtataagaaaataaatgtctactgtttacaagccacattgtttacagtattttgttacagcagcccaatggactaagwcacttggattcagagttctctcccaagtcaaacactgggaagggcttggagaaaatggtggccatgtgtcaagcctggagaagtgtcattcttcagacattgaagatgctggagtcagcattgttgacacactccagcattggtccttgcagtggaggaaggctcttcttcacacagcagacatggcagagaaaatggacacaaactaaaagtaggtgtccagcagtcgggtgcggtggctcacgcctgtaattctagtgctttgggaggccgaggtgggaggattgcttgagcccagga

SEQ ID NO: 147733 - DNA, 601 bp, Human
agaacttaactacgggcagagttaacaactagctattataggccaggcatggtgcttatccctataatcccagcactttgggaggccgaagagggagaactgcttgagcccaggagttcaagaccaacctgggcaacaaagtgagatcccgtctccaccaaaaaaaaaaaaaaaaaaaaaaaaaagttagccaggtgtggtggcatgctctggctgaagtgggaggattgcttgagcccaggaggtcaagaggctacaatgagctgtgattgtgccactgcactccacctccagcccgggyaacacagcaagagccggtctcaaaaaacaaacaatttattatattaaatttttttctcaactgttaccttactaattcagtgtttctataaaaattttagtttatgagatgacattatcaaagtgatctaataaataagtatgccaattagactggtgagctatagattcttcattttcactttaacattaaaaatataattttcagtatggcttggtgctatggactgaatatttgtatcctccccaaattcctatgttgaaatcataccccaaggtgcagttattaggaggtgaggcc

SEQ ID NO: 147734 - DNA, 601 bp, Human
ctaatgcacaggaaatctttttttccaaattaggcctgtcatctttttacatctttaatgaaagaggcttaggcttaactacaaatatcaaagctatacaattgctagataatcatagaacttaactacgggcagagttaacaactagctattataggccaggcatggtgcttatccctataatcccagcactttgggaggccgaagagggagaactgcttgagcccaggagttcaagaccaacctgggcaacaaagtgagatcccgtctccaccaaaaaaaaaaaaaaaaaaaaaaaaaagttagccaggtgtggtggcatgctctggctgaagtgggaggattgcttgagcccaggaggtcaagaggctacaatgagctgtgattgtgccactgcactccacctccagcccgggtaacacagcaagagccggtctcaaaaaacaaacaatttattatattaaatttttttctcaactgttaccttactaattcagtgtttctataaaaattttagtttatgagatgacattatcaaagtgatctaataaataagtatgccaattagactggtgagctatagattcttcattttcacttt

SEQ ID NO: 147735 - DNA, 601 bp, Human
agtatctattacttctatagacagcaagctaatgcacaggaaatctttttttccaaattaggcctgtcatctttttacatctttaatgaaagaggcttaggcttaactacaaatatcaaagctatacaattgctagataatcatagaacttaactacgggcagagttaacaactagctattataggccaggcatggtgcttatccctataatcccagcactttgggaggccgaagagggagaactgcttgagcccaggagttcaagaccaacctgggcaacaaagtgagatcccgtctccmccaaaaaaaaaaaaaaaaaaaaaaaaaagttagccaggtgtggtggcatgctctggctgaagtgggaggattgcttgagcccaggaggtcaagaggctacaatgagctgtgattgtgccactgcactccacctccagcccgggtaacacagcaagagccggtctcaaaaaacaaacaatttattatattaaatttttttctcaactgttaccttactaattcagtgtttctataaaaattttagtttatgagatgacattatcaaagtgatctaataaataagtatgccaattagactgg

SEQ ID NO: 147736 - DNA, 601 bp, Human
tctaagaagtctttcaaattctaggaattagtttcacatttgtagtttatagaatcacattaatagttactgttttgctgactgctgacaacaccctaagtgaagttaaaaacattaagtagcatttcctggcctttccaacatttttattttgttctgggccaaggtagccaaaggcttcaggaataattgacgcatgtattgaaacaatgttaattctaccttcaattgaggtaaacatcagaaaataattattctgcatacaaatcttaatcactgtgttcagatgatctctaaagtmattctttttgtttccactgtaaagaatgggaagtggaggaattatttttagcttgttattcatgggctgaagtttgagttcaatttgtggtaatgaaattaaagaattcattttaatcaaatatgcaggatgctgataaaataactttaataaagaatgttgaaaacatctaagaaatgtaaccaaatatataatggagagttataagttatgcaaaaatgtaagttaaggcttaataattcatattggaaagatgccctggctacaaaaggacattcagggagagggacaaccacgatg

SEQ ID NO: 147737 - DNA, 601 bp, Human
gtggcacaatctcagctcgctgcaagctccgcctcccaggttcacgccattctcctgcctcagcctcccgagcagctgggactacaggtgcccgccaccacacccagctaattttttgtatttttagtagagatgggctttcaccttgttagccaggatggtctcaatctcctgacctcatgatccacccgccttggtctcccaaagtgctgagattacaggtgtgagccatggcgcccggccatatctcaccttcatttatttatttatttatttatttatttatttatttatttattttgagtctcactctgtcgcccaggctggagtgcctaggttcaagcgattctcctgctttagcctcccgagtagctgggattacaggcgcttgccaccatgcccggctaatttttgtattttcagtagagatggggtttcgccattttagccaggttggtctcaaactcctgacctcaaacaatccaactcctctgcctcccaaagtgctgggattacaggcatgagccaccacacccggcctaaatcttaccttcttaatgagcttcccaggccttcctatctaaaattgcacgtccctgct

SEQ ID NO: 147738 - DNA, 601 bp, Human
catctcacctttttttttgagaaggagtcacgctctgtcgcccaggctggagtgcagtggcacaatctcagctcgctgcaagctccgcctcccaggttcacgccattctcctgcctcagcctcccgagcagctgggactacaggtgcccgccaccacacccagctaattttttgtatttttagtagagatgggctttcaccttgttagccaggatggtctcaatctcctgacctcatgatccacccgccttggtctcccaaagtgctgagattacaggtgtgagccatggcgcccggccayatctcaccttcatttatttatttatttatttatttatttatttatttatttatttagagtctcactctgtcgcccaggctggagtgcctaggttcaagcgattctcctgctttagcctcccgagtagctgggattacaggcgcttgccaccatgcccggctaatttttgtattttcagtagagatggggtttcgccattttagccaggttggtctcaaactcctgacctcaaacaatccaactcctctgcctcccaaagtgctgggattacaggcatgagccaccacacccggcctaaat

SEQ ID NO: 147739 - DNA, 601 bp, Human
cccctcttcagcgccctcaaaatctgtatgttgaaaccgaatcacaatgtattaagagttaggccctttagaaggtgattaggtcatgaggctagagctctcatgaatgggattagtccccttatgaaagaggcttgaaggagcctggttgagccttcagccatgtgagcacccacagaaggtaccatctagaggaagtaggccctcaccagacactgaatctgctggtgccttgatcttggatttctcagcctctggaactgtgagcaaagcatttctattgggtataaattacccagcytaaggcattttgttatagcggcctggatggaccaagacaatgcccttcaagatcttacggctacctctgtcatcctcgtctggacacttgagctcttcgagacttgggacttcatccttaattactctatccccagttttagcatgtagcttgtagtagatgctcagtaattatttgcttaactaattaatcaagttatagaaaaatgtgatgagaacttttttagaaaagaactagatcccaaaacaaaacatttagagtcattattggtttattcttgggtgaaagcatttttccaat

SEQ ID NO: 147740 - DNA, 601 bp, Human
agcttacagggtgattattagttgtttccaaataccagtgttataaagatattacagtatattgttaatatccatggaacatccatttgcttttttttagcagacatctggtagccactgtcctcttagaattttgtttttttccttcttttactatgtatttcaaatttattgccaactgttctcagatttttcttcttaaaatctcacaaatccattttacctccttattctcaccggagttgcctcagaatctctgtagaagtagcacagaagaaaagcacttctctgcaaaaaaaaagttcagaggcttttctcctctcttgttgctccattccccaatttattctccactaaattgacagtgaactttccaaagtccaaagttccacatgaactttccatgtcagtgccactgcatctattttattggcagcttgttactttccggatgaaatccaaactccttagcacagcataaatgcctgctatggtctgaatgtttgcgtacccccctcttcagcgccctcaaaatctgtatgttgaaaccgaatcacaatgtattaagagttaggccctttagaaggtgattaggtcatga

SEQ ID NO: 147741 - DNA, 601 bp, Human
gtcagaaatgatagaatatagttataaaatatgtacatttaacataaagatataaaatatttaaaaatgagaagataagatattctaaaaaaggccagacttgaaagagaattgaatacaacttccagaaattcagccctaaataggaaaaataaaaacaaactcactgagatatgacatagggaaactacaaaatacgaaagacaaaaagatcataaaagggcaaattacctacaaaggtagctcatcagatcgctctgcaaactcttgggtacacacgcatgactcgagaggatggggmtggggtggagcatgtccctaccagctccaggttatttgtttccaacaggttttcaggcccttatagaaggcagtcgggtggtgtcttctggggaaaattatgcctaatacaatgctagggctggagtgagcactggcctccttagcatgaattcttctctggctcaggacagaggccaagctctggaagggagatgactacttacccattgccaagtatccagtggcacattagagaatagccctgttctggctgcctaacataaagctgaagactgtcttggtccagggtagatgatca

SEQ ID NO: 147742 - DNA, 601 bp, Human
agtcagaaatgatagaatatagttataaaatatgtacatttaacataaagatataaaatatttaaaaatgagaagataagatattctaaaaaaggccagacttgaaagagaattgaatacaacttccagaaattcagccctaaataggaaaaataaaaacaaactcactgagatatgacatagggaaactacaaaatacgaaagacaaaaagatcataaaagggcaaattacctacaaaggtagctcatcagatcgctctgcaaactcttgggtacacacgcatgactcgagaggatgggrctggggtggagcatgtccctaccagctccaggttatttgtttccaacaggttttcaggcccttatagaaggcagtcgggtggtgtcttctggggaaaattatgcctaatacaatgctagggctggagtgagcactggcctccttagcatgaattcttctctggctcaggacagaggccaagctctggaagggagatgactacttacccattgccaagtatccagtggcacattagagaatagccctgttctggctgcctaacataaagctgaagactgtcttggtccagggtagatgatc

SEQ ID NO: 147743 - DNA, 601 bp, Human
catctcaaagaaaaaaaaatgatttataacatgtataagtcaacaaacttaacgttaatactgatgagtaatctatgaagagggcaatgatcatgagtttttatgctctttaacaacatagccttgaaatataaaagcagagttgataaaatttcaaagaaaaatacacaaatatcaaccacaatagattttaacagaactcttttagaaaggaatatatctggcacacagattttaaaatagagaatctaatggcacaatgaacaagtttgatataacatctacagagagagctctgtayccagatacagattcctttcatgcatacatgaaaaatatattataactgattacatattagacaacaaagaaaaatttcaacaaattccaaagaactgatatcataaagaccatgatctctgagcacagaatactaaaaataagacagccaaaagtatattttactttcctttaaaataaccaatgggttaaaaaggaaatgaccatgggaattacacagtaattttttaaatgagaagaaaaacattatttatcaaattccatagatatggagttaggtagatgaaaaatttcatgatct

SEQ ID NO: 147744 - DNA, 601 bp, Human
gaggcaggagaattggttgaacctgggagacggaggttgcagtgagctgagatggcgacactgcactccagcctgggcaacagagcaagactccatctcaaagaaaaaaaaatgatttataacatgtataagtcaacaaacttaacgttaatactgatgagtaatctatgaagagggcaatgatcatgagtttttatgctctttaacaacatagccttgaaatataaaagcagagttgataaaatttcaaagaaaaatacacaaatatcaaccacaatagattttaacagaactcttttakaaaggaatatatctggcacacagattttaaaatagagaatctaatggcacaatgaacaagtttgatataacatctacagagagagctctgtatccagatacagattcctttcatgcatacatgaaaaatatattataactgattacatattagacaacaaagaaaaatttcaacaaattccaaagaactgatatcataaagaccatgatctctgagcacagaatactaaaaataagacagccaaaagtatattttactttcctttaaaataaccaatgggttaaaaaggaaatgaccatg

SEQ ID NO: 147745 - DNA, 601 bp, Human
gggggtgtctttttcagtttgggacagtcagagaagacctctctgagggcttgacatttgaattaaagcttaagtgatgaaaatgaggcaatcctgccaaggtctgggttgatcttggtatgcccgatagagagacaccagtgtggctggagtggaagtgaggccacagaggaagcagatcacctatggccttgtgattcaaagtaagggttctgggtttcatgctggttgcaataagaatccactgaagggttttaggcagtagtgacgtgatgtgatttttaaaaatagatgttatttyttagagcagttcgtaagttcacagaaaaattgagagggaggtacagagatttcccacacactcctggttcccacacatgcacaacctccccccttatcaacattccccaccagagtagtccatttgttacaactgatggaccttcactgacacatcattatcactacatgatttgattttaacttcagaaagacctctgtgactcctcaaagaaggatggactaggagtggaggaaagagcgaaagcagagaccagttaggaggtgattgcagagactagaagggagtcccagcgacagg

SEQ ID NO: 147746 - DNA, 601 bp, Human
gggcttgtcatgtgcaaatcacatataccaactgcattgttacagaacaggagctgaaacatcttgttggtgttggtgtgctttgtgtgtgtatagtagcatttgaataaacttaaactacagggtgattttaaaagtgagtttcttccaagtgttcacctaaatccatcaggagtagagaagagaggagctgtggctaaaggttagtgaatttggctgcagcaatttgatagtgatgacctcgttaaatttcatattgtttcaaagtctacactatctatacatatgctccttaagaacrcataggactaaaagaaaaattttaagatgacaactttatatatattacctaggtatttaatgagtaatttctattactgtttcataagaatccataatcatgtctcatgaattaactaagaggaaactctggaacgacaccaaacaaatatgaaattgaatgaaactacacatgcggcaggcagcaacagctgtttgcttacctagtatctattcttccctctttctatgattttgtttggagaaacaaatggctggctaaaaagccggagttcctagttccttgtaggtaggggtaggc

SEQ ID NO: 147747 - DNA, 601 bp, Human
ggaagaatacagctgaagaagagctcttggcttgactgagtagctgatctctttacaagaagggatacaagccctgcagtggaactcactgctgatccttcagacttggtgagtttcttcaccagcccatttttatgagatgcatgccacactcagaaacggaggtgtgcatcattcatatttcaaagacaaaattgttgtttcttgggagtaaagagactagtacagactagactagaagagtacaagatgagggattcctatcgtgtgtttccgtgtttgtgtgtgtgtgtgtgtgtggtaaatgtatgtgtatctaaagaagagaaggagtaaggacttgaattatcctgtattttggctttttggtcatatcatgtggtttgattatccagtaatgagaggacttgtgtcacgcctgtgaattttaacgttgctgtgactaccgactgcctaaaaggaggcctaatgaggtaaaactgtatatgcttaaggatggaaccgagtgcctgtcactatggctcgttaaggaaataaagggacttacagatattctgcatgttctatgtgcagagccctgattccctcctcggtttgattt

SEQ ID NO: 147748 - DNA, 601 bp, Human
atggaagaatacagctgaagaagagctcttggcttgactgagtagctgatctctttacaagaagggatacaagccctgcagtggaactcactgctgatccttcagacttggtgagtttcttcaccagcccatttttatgagatgcatgccacactcagaaacggaggtgtgcatcattcatatttcaaagacaaaattgttgtttcttgggagtaaagagactagtacagactagactagaagagtacaagatgagggattcctatcgtgtgtttccgtgtttgtgtgtgtgtgtgtgtgtggtaaatgtatgtgtatctaaagaagagaaggagtaaggacttgaattatcctgtattttggctttttggtcatatcatgtggtttgattatccagtaatgagaggacttgtgtcacgcctgtgaattttaacgttgctgtgactaccgactgcctaaaaggaggcctaatgaggtaaaactgtatatgcttaaggatggaaccgagtgcctgtcactatggctcgttaaggaaataaagggacttacagatattctgcatgttctatgtgcagagccctgattccctcctcggtttgat

SEQ ID NO: 147749 - DNA, 601 bp, Human
atttatgggtctcagttttcatatttatcaaattcagggtcagattgataatctttaagcctgttcttcaggggcttaagtgtctccattagcatcttggggctgccttggttgggatgagtgagtgggatgctgtaggtctagaccacaggttccaatcctgttatacctgaaaccagagaaaatatgctgactgtcatatatcacagttctgcttaaggattcatataaaaaaggattcatcactgaaaacaaattttggaaacagatggactagatgatctcttaggtctgtcctggktctcagatactatgattctctagtagacatgagctgcttctttatttggatggagaataagacagtggagttgcctatatttcctcaaacattggttttaaagaaagcttcataggttgctctgggtgtcaacatctttccagcagatggggaagaaagagtaggaggatctcataggaagtttttatgaatcatgcttgggtgagttgccactcgggcccaccatccattgcccaagcctcagtccaccagccacagttacttgccaggaggctgggaaaccccagaaggaaaaggaaa

SEQ ID NO: 147750 - DNA, 601 bp, Human
aaagaactccaagggctgcccagctgctctctccatccagcttggttcctcttcttgggtcaacccagtcctattctcagtctttgaatgatcaccgtgagccaaaggaaaggccagagagaaagctgatggctcgagaccactccagtctccaccgccacgaagcatgcatgacactcatcctccctggactcagaggccagctacccctcactctagagcaccttcttcctgggcctcagagtaactgcccgagacagctttcctttaggacccaagtcaaggtttttgagagtgtgtrgaaaacactcatttcagctctccttgtactgaggccctactggcacatatatggcctttcagctccttctatgagatctaaagaggtggacattagggaattcctaaggcgataaaatgtttagcaaagaagcacagtgagtttctcaaggcagagacaggctgagattgtttactaagagccaagagagagctttgctccatttacatctcaataaaagatgagaacaggtaaactgttgtactgagagactttaaaaacttggctagactcctctagccccaacctttttttgcagct

SEQ ID NO: 147751 - DNA, 601 bp, Human
ttttatatatatgtatagtttttcttcttctgctagaatgtcaacttcaaggggatgcagatatttttgttcagttcgccacagcatccccagcacatagtacagtgcctggccttcgactgatgctcaataagtatttgttgaatgaataaatgaaagaactccaagggctgcccagctgctctctccatccagcttggttcctcttcttgggtcaacccagtcctattctcagtctttgaatgatcaccgtgagccaaaggaaaggccagagagaaagctgatggctcgagaccactccagtctccaccgccacgaagcatgcatgacactcatcctccctggactcagaggccagctacccctcactctagagcaccttcttcctgggcctcagagtaactgcccgagacagctttcctttaggacccaagtcaaggtttttgagagtgtgtagaaaacactcatttcagctctccttgtactgaggccctactggcacatatatggcctttcagctccttctatgagatctaaagaggtggacattagggaattcctaaggcgataaaatgtttagcaaagaagcacagtgagtttc

SEQ ID NO: 147752 - DNA, 601 bp, Human
ttcaggctctgagaagttaaatcggttgcccaaattgcacagcctttaagtgatggaaccaggcctcaaacagcaagctaagcccaagctcctaaccattctattctactgccccaatgacctgcaatagcagctgtcaacctgggtcaggacctgttctaccactgaatcaccatttgatgtcacaggaaaggattcccaacatccttaacagcagtcagaagggccccaccatcatgtggccattatggattcagcatgtgattctgatcagcagtttcgggtactcactggtagcttyatgctggtcccctaaggcatgccctctgatggttgcttttaaggttttctttcatttctccttttacagaggacattcaaatgcactttaaaaccaggaggcaccaaacaattgaatatgactaaccactcccacatttaactatttcagcacagtcatagaagtgatgaccaaggcagtcctatccctgatgatgctatggtccagcagggagacaaagaatagaccccaacaaactggcatttcctgtactggaaaagcacattctttgggggtaattagagatttaggcaattcctg

SEQ ID NO: 147753 - DNA, 601 bp, Human
cttctgattgattgtagaaaaaaattaaagatattagataactattattagcctgcttgataatgataacaataacagttaacaattgtggaatattttctgttatgatttaaatcactcacaatctcagttactcctgatagcaagcttataaagtagactcctctatcatagatgaggaggttcaggctctgagaagttaaatcggttgcccaaattgcacagcctttaagtgatggaaccaggcctcaaacagcaagctaagcccaagctcctaaccattctattctactgccccaakgacctgcaatagcagctgtcaacctgggtcaggacctgttctaccactgaatcaccatttgatgtcacaggaaaggattcccaacatccttaacagcagtcagaagggccccaccatcatgtggccattatggattcagcatgtgattctgatcagcagtttcgggtactcactggtagcttcatgctggtcccctaaggcatgccctctgatggttgcttttaaggttttctttcatttctccttttacagaggacattcaaatgcactttaaaaccaggaggcaccaaacaattgaat

SEQ ID NO: 147754 - DNA, 601 bp, Human
attacttctgattgattgtagaaaaaaattaaagatattagataactattattagcctgcttgataatgataacaataacagttaacaattgtggaatattttctgttatgatttaaatcactcacaatctcagttactcctgatagcaagcttataaagtagactcctctatcatagatgaggaggttcaggctctgagaagttaaatcggttgcccaaattgcacagcctttaagtgatggaaccaggcctcaaacagcaagctaagcccaagctcctaaccattctattctactgccscaatgacctgcaatagcagctgtcaacctgggtcaggacctgttctaccactgaatcaccatttgatgtcacaggaaaggattcccaacatccttaacagcagtcagaagggccccaccatcatgtggccattatggattcagcatgtgattctgatcagcagtttcgggtactcactggtagcttcatgctggtcccctaaggcatgccctctgatggttgcttttaaggttttctttcatttctccttttacagaggacattcaaatgcactttaaaaccaggaggcaccaaacaatt

SEQ ID NO: 147755 - DNA, 601 bp, Human
gtctgtgagactcggctaggcactatgattggaattccttaagagtctacttcccttattgctatgcgtgtctacctataacatgtccttggtacttcagttgtcctaacggtgtgtcagttccttgcaaccaagaggggctgatctcaaacttcatttttgaaactaccccttacccatcaatgaagcaattgcttctaagaacggaccgatggactattttattacactaaaatatattacaatgttcaaacaaatgctctttctcaaaatgattttttctttttgtttttttttttttgtttttttttaagagacagggcctctctttgtcacccaggctggagtgcagtggcacaatcatagctcactgcagcccctaactcctgggttctagctctcttcccacctcagcctcctgagtagctagggactataggcatgtgccaccacacccagataattttttttaaaactttttgtagagactgggttttgctaagttgcccaggctggtctcaaattcctgggctcaagtgatcctcccacctccgcctcccaaagtgctgggattatagatgtgagccactttccccaacct

SEQ ID NO: 147756 - DNA, 601 bp, Human
gaatataggatgagcttttaccacttgtactcattttggtatacaagcttgcctttaaaaacctaaactttatgactggaaataagatatttttaatctccctggtgaataactagcattttcaattaaggtttctaaatatttgaacaacttttattgattcgcttaaaaaaaagtttttaatgcaaacccagagtcataaagtcagtttcccacatgtcaactgtaggcagcacaggaagctataaatcataaaaattcagaccttgaactgtaccaacaacatctgcaaagaacaggraacatttgctgttaataatctgatcctgtgggttctatgctagcaaattatcaaaggcaaattatactccagatatgttacagcatatcaaaaataaaatagaatcataaatgtggtcaattatcttcctttttaggttctaaaatacaaatctttagcaccattaattagttttgttccctcgacctcagtgatcttcctctcctataaagacttgactgggctttcaaaaacatgagctttctgttcttttcagctatctactggaaggtacatgctgctctgagcctgtttcttaga

SEQ ID NO: 147757 - DNA, 601 bp, Human
aaagtaatcactttttgtaaactatgaaaatttgagaaacagtcataggtgaggtcgcctagaatatctggcatataacaaattctcagtaaatgttcacggttgttgctacaattgtgattgttactattattcctcttccttctaagggggcgggggtgaagtgggtaaaaggatagctgtgttcctggtacattcagttcctagttggcatctgatgcagtctccaaagaaacaaggagaaactgtgatattcataccaaagttcttacccatagaaggttcactatgcaactgagarccaactggtaacctactcaccatttccaatagaatttctcaaagaaaacattccaagttatgaaaagaggtgctctaattttttagaaaagtatcttaatgtaagttggattcagaaataataatttaaaatatatcgttattaagattatcaggataaatcgttgcataaactacagctcttaacaaactctatttgtttcattttctgagtattgatagatttaactcaagagtttgtttctgcttcacttgacataatctgaaggcagcatcgtgcaactgacagatctgggcttgt

SEQ ID NO: 147758 - DNA, 601 bp, Human
aaaatcttcagagatgtgtcctgatatttcttgttatgaccataaatgtcaaagatataaatatgggatacagatattaacaggcctatattttacatgtatggacccccattaaaaaaagttggcaaatgtgcataatttcataatcaatgcaaatcagaaaagtaatcactttttgtaaactatgaaaatttgagaaacagtcataggtgaggtcgcctagaatatctggcatataacaaattctcagtaaatgttcacggttgttgctacaattgtgattgttactattattcctctyccttctaagggggcgggggtgaagtgggtaaaaggatagctgtgttcctggtacattcagttcctagttggcatctgatgcagtctccaaagaaacaaggagaaactgtgatattcataccaaagttcttacccatagaaggttcactatgcaactgagagccaactggtaacctactcaccatttccaatagaatttctcaaagaaaacattccaagttatgaaaagaggtgctctaattttttagaaaagtatcttaatgtaagttggattcagaaataataatttaaaatatatcgt

SEQ ID NO: 147759 - DNA, 601 bp, Human
gctaaataacattctccccagctatgcctttttactactacatctttattctatttaagcctcttcaaattataaggaaaaaggctagaatacacagaatataaatgcaaaatgacaaaaaatagtattatttattctagtaagctcattgtgaaatctttaaaaataaagactaaaaacagagagccctgtttacctcagtaatacataatctcaggaaaagatgattatgaataatctatttttactgcacttataagaaatgagtttgctacagttaaaaactggattttttttttttaaaggaattcctgcttgcagtcatggtagaagtgagaaatgctgacttagccacaaataaaacttcctgttggctttcttggctttttgtggcagcctggctgaacagtattactataaaactttctgctattcacctatgggttgggacttaagcttcaggtgtttaatttcttggtctttttcttcaatagctcgatgaaggagtgcttgtaattctttctctttccgaaccaattcttccagtaatctgcagaagaaaaatatattgtttgacaggaggtgacacagggtgaccttc

SEQ ID NO: 147760 - DNA, 601 bp, Human
aagtggataaatttcacaatttgctccaaggttttcagtgtttggttctcatatcacttcccatctataaatttcaaagtgctagattatacccaaagaatattactttcctttgacataaataagctcagctaaagaggcaatttgatttacttcaacccctggaaattactaggagaaattagaacctgttatttctgatccttcgatccttgagaggccaatagtaggtggcatgtttgtatttctcctggcttgttaatctcccatatcaatgtgcaatgtctgttttttttagcastttcagggacacagagacttggagtaattctttccacactagagataaccttccctacccagaccctcaaaaatgctttttggaagaccgaattgagccattagaccaatgcaatatgggatacagcctgcgggagctctattggtctctctgacctttccttataccctgaatgggctgttccagctacccacggaagttacacctttgacagtctctagactgagtggatttccaggtcctaggcatgtggtttctccaagcaggacaaggatgagcaaggggttccatttcactgtt

SEQ ID NO: 147761 - DNA, 601 bp, Human
gttccatttcactgtttcatatagaccagaacgctccaacggcatcccattttgaaagtcggagggagaaaacaaccgaaaggcctcttttcaatagtagatgagtgttagttcatggtttctaatatgaaccacaaaggaattaggaaaataaggggatatttctgtttataattccaaagtttcattattttaaaaccttaatcccagtgttaataagcaactttactgctaatggtggttatgtttgcaggtgggacagtggaatatttaattatctacatcataggattctgcaacwtttttttttttttttttttttacaatttgcctcttttacttttgtaatctgaaaaacaactgcaaaaataaataacatttaaagagaaactcattgcagataataattcagtgtcatattgttcaccacgtaagagatcatctgccagcagctgctatcctgtcttccctttgctggagatcctccaggacttctgagcacctgggctcaaccccagcctcatttccctggccctggatgctgcctgcccctctacccccatttcaccccacctggtactcacaatcctccactcatcga

SEQ ID NO: 147762 - DNA, 601 bp, Human
tagaccagaacgctccaacggcatcccattttgaaagtcggagggagaaaacaaccgaaaggcctcttttcaatagtagatgagtgttagttcatggtttctaatatgaaccacaaaggaattaggaaaataaggggatatttctgtttataattccaaagtttcattattttaaaaccttaatcccagtgttaataagcaactttactgctaatggtggttatgtttgcaggtgggacagtggaatatttaattatctacatcataggattctgcaacatttttttttttttttttttttacaatttgcctcttttacttttgtaatctgaaaaacaactgcaaaaataaataacatttaaagagaaactcattgcagataataattcagtgtcatattgttcaccacgtaagagatcatctgccagcagctgctatcctgtcttccctttgctggagatcctccaggacttctgagcacctgggctcaaccccagcctcatttccctggccctggatgctgcctgcccctctacccccatttcaccccacctggtactcacaatcctccactcatcgagtgacagtgctggccatccac

SEQ ID NO: 147763 - DNA, 601 bp, Human
ccactcatcgagtgacagtgctggccatccacccggaaattccctttagggtctcctcagcattccattccggataactctttcacccatgtctcttactctgtaacatattgcagatgcaatattaattttcctttagcatattttcctttataggtggtctccagtttttttaatgtatcaaagacaccccaaaaagactataagatcctaaagacagtcttctctttatccctaaatagactatcagatcctaaagacaatcaattgctattgatcatttactaactatagttaactkaccaattattaaagggtctcctcgaaaacattatattaaataactatgaatgtaaatcatcccctgtgtttaactgaacaacacgggtaggaatgaaggcctctaagattttcctttgtgatacgatttacctcttggtataatgcaccaaagaccccattggtgagttgaaactagaacagataacattactgtggtcgccctccacggttcctaacttagtttgcaattacaacagcttgtcaccatggagcagagatgtatgaacatctgtgttatgcacagtcacataaggtatat

SEQ ID NO: 147764 - DNA, 601 bp, Human
tgagacttgtggacccagaggggagagttgcagaagcaattacaaccttctgcagagcaggcggctccagcagccccgtctacagctctgtctcctgatttaatataatcagcagcctgagtagataatgactaggttgagatgttcccgtggcaaccatctcagagcaacacaaagtgatttccacaccggctcagcagaggaagtgacatacaaagaaaacgtgctcagggactgtggagcttgaggaaaagaaacagcttcagcctgaggttttagggcaccaagtatccactgctasagagaacccagagctccagaccagcccctgggctttgcagtagtaggttaattggctatttggcttttcctgactgttaatttgctaatcttgatctttaaagctctattccttcagacttgactctcctgtcagggtcatcttaactgcacaagcatgaggtcattttagtagagctacaaaaatatttccctttacttattatttcccaaatggaaccaatatatacaaacatatatattttttaacctttctatgaagaagtgacccagagactcaaatatttttttaaagctgcca

SEQ ID NO: 147765 - DNA, 601 bp, Human
tgactgcagctagttcacttctaggcaggggttgggagatgtcccctccttgctttcctgtgattctggatcctataatgctaatcttttctcccaagagatgccaagaaattaggcaagtagaagcccagtatccccttccctctcctacctaccatttttcgacaattctttatgtgtaaggaaaagaattccccatctcccatcttcttttcccattctttcatttcatgttctaccacattagctttattttctgttttggagagaattcttggaaaagaccagaaagctaaaaatrtatttttagaaagtcctccttggaagacctaagatcatccctttttaaaaaaaggagaaagggtaaactagattacactattcacatttattgagcaactactgtgtaccaggccataagtgctaaaagaaataaaggatgaacaaaacattttgggaaagggctgatacagaactcactagaacaccagctaaattggcaagtgtcacgaggttctaatggagaaagcactggacattctagtgaaggaccttgtggaaaggttggcattggcatttggacaatgactggatttttgta

SEQ ID NO: 147766 - DNA, 601 bp, Human
aagacaagtaaatatgataacgcatatatggctgaagaactgctttgctgaatataattagggtggggttgctttggagcccagcacaaaacactagccaccatggggaaaagactaggaagactttccacccaatcaccttctttctcctctctctgtccctttgtcccacctttctgctccccccaaagccaccaccccatgacttcccttctgagatagaaccccaagctttagactgttccttctgcccccttccatcagaacttatccatccagcattgcctacctaattgcaaaytaattcaagctaaggcattcattgattcattaactctttctgagtgatatttgcattctgactggagctgtccttacacactctaccaatctgtattgggcatataccatgtagattcatttcaatcttttacctaaaagactgataagtggaagaaccaatccttgaacctcattctaggccaagtatccttttctcagaaatagtttcttattccatttcatcacagtctgcaggctctgcctagcttgtcagcacctgtagcagagactccgtgtacagcaataggatggtgctaag

SEQ ID NO: 147767 - DNA, 601 bp, Human
ctctccaggagcagaagctgtaacttcctcatctttgcatcatcagcacccagcccagtgtctgagccaaagtaaaccctcagttaatgtttggagaaggggaaggaaaggaagggaagggtgagctgttgagacaatcgaggatagttcttctctttggccattctaaaagtactcagctaaatttattctaaaatgctaggtctccaccttctgcttctctctgtcccctccttcagacacagcaattaaactcttcattctgagcaatccagtgttaacctaggatgagagaaggcargagaaacctcagtgccaacagtgcacatccttttttgtgcatttctatgccccctcactttcatcccctgccagttgcatctccacaggtcccacctgagtgggtttctctgtggctttagcacggtatgtgtatattcatattttttccaatataggtgtatgtaagcttgttctcagagctctatagtttccatagtcgtaagaataaaaacatttttctgaccgaccactccatccctgccatgatgctttacctcatctggaagggtgtgcaggacccagtccattaccagaaagg

SEQ ID NO: 147768 - DNA, 601 bp, Human
cagaaagacccaggttccatccctgctctgttacttatccattgcatgactttgggtaaattattaaacctttccaaactcatttcttcatctgtaagatgtacctattttaatatcaacttcacaatacctacttttatgaaaatcaattggatcacaaatgtaaattacctagtaggtgctcaatattttgattccatcaccccagctgcaaaccctagcctcgtatggattgaatacatggaataggagacccagtgtgtttgttctagatgaaatacatgagatatgtctttgggawccattcagacatgcaggtggacactgcagtagtcatctaaaacaattctttcttctctctgaactagttcaatgtgaaaatatatagctttccatgccctgttaatgtcttaatgaaacctgcttccttaagagtgtcctgcaccaagaatacagacatgattagtcctaaggtgccactacaatccatagagcgccgtgggcactaagagagaaatctcaatgcacaggtaaatttctcaagttctctgaggaactaaggatatttacacttaaagagttatattccaaccacatataa

SEQ ID NO: 147769 - DNA, 601 bp, Human
tgaggcaggaggactgtttttagggcaggagtttgaggttgtagtacactatgattgcacacctgtgaacagccaccacactccagcctgggcagcatagcaagactgtcacttaaaaaaaaaattcctataaaaggaagataaacaaagcctatgaatagccactaaccaagcaagaaattttattagaattactagctcaataattatcaaagtagggcttaataacacattattaagaggttcagttggactgatgctcgaaagtgctaatattaggtttatgtagttggatctccaygggtgcttaacagtcagctctgctcacttaaacacaaaggctttctttgttctcagtatcaccctagctacttctgcaccagttagtcactactcgacttctggaaacagttgacatagacctatttcagggaaccagatatacagttgacagaaacagccttataatatggatatatttacagctttcttaaatctcagatatttattctagatttaaggtttctcctggtaccaaaattaatcagcccctatacagagactattccataaagaaggtactcaaaaatgaaaataattt

SEQ ID NO: 147770 - DNA, 601 bp, Human
tttaacaattactgtaccagcagtgccaatacaaactttgtattcctaaaattagcaccaaagtagtgcaaaaatgtgttaatatgtagatatctgtgatatttacaaaagaaaagtgaaaagaaaatgaatttcacagttcgggtcaatgctcacatggattaggcaatgaaacattctggaacacctttttataactattccaaatgagaatttggaaaccataaaacaataaaatccaaacaaaggtgcattaggataactgtaaatgcctttaagtaatgatttgtaaaattgtatragggtcttaaataaacctagcattttattaccaggcacactgttaacattccccagatttttacaagaggaatttagcgagctatctgtaagatttagcttagctaatcatttacgtttctacccagaaatacatatcaatacattatcaaagtaaatatggtagctatgcactgggagtccttttggaaacaaatatatcagatctttatcaataattgattaacacatttaaatacttcaaaaaccaggaccttgtactattatacagagggtgctttattcagattgttatatgaat

SEQ ID NO: 147771 - DNA, 601 bp, Human
ctgtaccagcagtgccaatacaaactttgtattcctaaaattagcaccaaagtagtgcaaaaatgtgttaatatgtagatatctgtgatatttacaaaagaaaagtgaaaagaaaatgaatttcacagttcgggtcaatgctcacatggattaggcaatgaaacattctggaacacctttttataactattccaaatgagaatttggaaaccataaaacaataaaatccaaacaaaggtgcattaggataactgtaaatgcctttaagtaatgatttgtaaaattgtataagggtcttaartaaacctagcattttattaccaggcacactgttaacattccccagatttttacaagaggaatttagcgagctatctgtaagatttagcttagctaatcatttacgtttctacccagaaatacatatcaatacattatcaaagtaaatatggtagctatgcactgggagtccttttggaaacaaatatatcagatctttatcaataattgattaacacatttaaatacttcaaaaaccaggaccttgtactattatacagagggtgctttattcagattgttatatgaatttttttcctcc

SEQ ID NO: 147772 - DNA, 601 bp, Human
cctttccatgtttagtgcttccttcaggagctcttttagggcaggcctggtggtgacaaaatctctcagcatttgcttgtctgtaaagtatttaattactggggttttttaaacaccatctgagtttatgtttcaaagactggcccaatatggtagctcacacttataatcccagtatttatggtaggcctaggcaggaggatcacttaagcccaggatcatcagccctggcaacacagtgatacccccatgtctattatattttttttatttaaaaaaaaaatgcaagacaggctagagkcaggggaatgaggcactagccttacttaaaatttaggggaataccaaataacttggtgatcacagtgtatcatatcttaatgtaatatttttaaaaatcaaaattaaaaccaaaaaaagtcatgagaaacaatatatcaaaaatttaaataaagatccaaagaggtctgcattctgtcatgttgctgaactaatgttactattattcatttgactctaggtgaagaaaaataggtaaggaatcatgctgttttcttctttgttgtaaagataaaaacagatctaaacttaatatctccag

SEQ ID NO: 147773 - DNA, 601 bp, Human
ccctggcaacacagtgatacccccatgtctattatattttttttatttaaaaaaaaaatgcaagacaggctagagtcaggggaatgaggcactagccttacttaaaatttaggggaataccaaataacttggtgatcacagtgtatcatatcttaatgtaatatttttaaaaatcaaaattaaaaccaaaaaaagtcatgagaaacaatatatcaaaaatttaaataaagatccaaagaggtctgcattctgtcatgttgctgaactaatgttactattattcatttgactctaggtgaaraaaaataggtaaggaatcatgctgttttcttctttgttgtaaagataaaaacagatctaaacttaatatctccagctcatggcatcattagtttagtaatattttagtcaaagttagtgaatagtaaccattatttcctatcatctacacttaggatatgtcacttaatttcaatgtcattatcttaactatgaatcttcctaaagtactacactacttggaaaactaaagggaagtttaagaagtaatccatcatttcaatttgctacatttgtggcatatttccatcattcagggcta

SEQ ID NO: 147774 - DNA, 601 bp, Human
catttctttactttcctatgtagcaaaactccttaaaagagtggtctacacttgatattgtttcaaacttcttcttcacattttttctcttcttaaattttttatcataaaataacttcaatttatcaaaaatctgcaagaatactcatatactctttctccatatgcaccatttgttatattttgcaatctttgccttactgcacacatttttgcttaacactttattgtacatatgctactttatcactaaatatttcagcatgtattttctaagaatgaaggcattcttttgtaaccmcacttcaattatcagacattcaaataatgtgtttggggtatttctggacaatcactgtgatgtcaacattcaagttttgaaaggcacatgtgaaatgagtattaaaatatttataaatactgtctcatgcataaatccatatccaaaattgtgctaataatgtcatttatgacattttttctgatacagaatccagttaagggtcatgcattgcatttagtgcactgtctctggtattcattattatgaaacaatacctaaggctgtctttgtctttcatgatattgacattttttaaga

SEQ ID NO: 147775 - DNA, 601 bp, Human
tctaagaatgaaggcattcttttgtaaccccacttcaattatcagacattcaaataatgtgtttggggtatttctggacaatcactgtgatgtcaacattcaagttttgaaaggcacatgtgaaatgagtattaaaatatttataaatactgtctcatgcataaatccatatccaaaattgtgctaataatgtcatttatgacattttttctgatacagaatccagttaagggtcatgcattgcatttagtgcactgtctctggtattcattattatgaaacaatacctaaggctgtctttgtctttcatgatattgacattttttaagagagcacaggctgattgttttgtgaagtgtccttcaacaattttttctaatgtttcctctttattagaatcagatgtgcatttggggcaggaacacaatatgtgtgaggttgtatcctcagtgcattacattaggaagagcatgatgtcagtttctggtggcattaactagggttacttagggaagatgatgccccctccacatttttccactaaaaactacccatttttttcttctccaattaataagtcttctgtgggtaaatgctttga

SEQ ID NO: 147776 - DNA, 601 bp, Human
atgacattttttctgatacagaatccagttaagggtcatgcattgcatttagtgcactgtctctggtattcattattatgaaacaatacctaaggctgtctttgtctttcatgatattgacattttttaagagagcacaggctgattgttttgtgaagtgtccttcaacaattttttctaatgtttcctctttattagaatcagatgtgcatttggggcaggaacacaatatgtgtgaggttgtatcctcagtgcattacattaggaagagcatgatgtcagtttctggtggcattaactwgggttacttagggaagatgatgccccctccacatttttccactaaaaactacccatttttttcttctccaattaataagtcttctgtgggtaaatgctttgatattgggtaattaccccattgctttttaaacattcatttaataattttagtatccattaatgattctggcctgaatcagtcattaccatatcggctgcaaaatggtaattttccagctctattatttcttctacatttatcagttggcacattctacaaggaagagatttcacttttccttattcatttacttattta

SEQ ID NO: 147777 - DNA, 601 bp, Human
gcacaggctgattgttttgtgaagtgtccttcaacaattttttctaatgtttcctctttattagaatcagatgtgcatttggggcaggaacacaatatgtgtgaggttgtatcctcagtgcattacattaggaagagcatgatgtcagtttctggtggcattaactagggttacttagggaagatgatgccccctccacatttttccactaaaaactacccatttttttcttctccaattaataagtcttctgtgggtaaatgctttgatattgggtaattaccccattgctttttaaacwttcatttaataattttagtatccattaatgattctggcctgaatcagtcattaccatatcggctgcaaaatggtaattttccagctctattatttcttctacatttatcagttggcacattctacaaggaagagatttcacttttccttattcatttacttatttaccttatcacctgtatgaactcattggttcttacttcagccaatggtttataatccattctttcgttattcattttgagactcaaatttcccgtattttctcagagagatcccttgatgttgtcacttctgtcat

SEQ ID NO: 147778 - DNA, 601 bp, Human
tataagaaatactagttaggccgggtgcagtggctctctcctataatcccagcactttgggaggctcaagacgagcctgggcaacatggcaaaaacttgtctccacaaaaaatataaatattagctaggcatggtggcacatgcctgtagtagcatctactcaggagggtgaggcgggaggatcgcttgagcccaggaggcagaggttgaagtgagccaagattgcaccactgcactccagactggatgacagtgtgagacccagtctcaaaaaataaataagtaaaaattaaaaaaaaaacaaatatcaggtatgttcatgaaacatttcaaatgtagagttcaatagaccatatttttaaaagtatagaaagcatcttttaaatttctcttcttttaatgcatttatttttacagagtggagaaaattggctctcttttaaatatataaatttcttgacttgatgactttccacaggtacaacatactcaggggagattggcaccaagaaaaaggtgaaaagactattaagctttcaaagatacttccatgcatcaaggctgcttcgtggaattataccacaagcccctctgcacctgc

SEQ ID NO: 147779 - DNA, 601 bp, Human
gcgccactgcactccagcctgggcgacagtgcaagactctgtcttaaaaataaataaataaataaataaatgacagggaagagaaaatgtatttcctattcatcaagtggatgtggatcatcataaagctcttcatccttgtcatcttcacactgagtaggctgaggaagaagaggaagaggaggggttggtcttcctgtctcagggtggccaaggcagaaagaatctgagtacaagtggactcacgtggtttaaacccatgttctcaagggtcaagtgtagttatgtttataataaattrtatataaagaaaaccatcaggaacataccgttttcaaagaagatactggtctgctgacatattaacaaacctccagcagcatgcgcctcaaataattttaatcaggacatgagttgttgaaaattttcaataggctttttaaaaaataataataactaccatttatgtagtgcccactatgagcagagtacttttggcaagttatttctaaccatttaaacaaatctgcaagtaggatattattatcaccatttgtcccatagtttaggagaggtacaaagaggtttcattacttgccca

SEQ ID NO: 147780 - DNA, 601 bp, Human
atatattgcatcctaagcatcgccttggttatgagctgaagcaggttagcgtcttccataaaaagcaaaccaaaatcgccttgcctgtgtctctacttggttccaagagtactctaagccttacattagactgcaggagcatgaaagatgatactctaacttgaataaggtagaaataaatccaagaagtccacagttggatcaaggcaataccctgaatctctgccctaagaggcccggatttgctttcattggtatttgttattcaagtgttaaaccagtctttggatatcagtattcwgatgctacttgggctctttgaaggaaacctcatttgtggcatattatttataaacagcagaaactcaattaaactatagtgtgagataaagttgtgcttttcctacatatttatttttcctatgaatgacagcctttatgaatgtcagaaaggggggatttatgaaggaggtgagaaatcccaacgcttcacaaatccttttggcctttctcccctctgctgtccatctctgctctctgctaaaaacagcctagcagaactgccaagcttgcaaaccacgtttatttttaaagcatctct

SEQ ID NO: 147781 - DNA, 601 bp, Human
aagtgatcatcccacctcagcctaccaaaacactaggattactggcatgagccacctgggactacaggcatgagctaccatgcccgaccgagaaggatctctttgattatgactagggagaaattggggtataggtctagggaccacattcaggatactacctatatcagtcacctgttcaactggtcttaggatctcttggaggctatagatccatgtcttttaagatttagggacaaagttgaaggcaaagcaatatcacatagtaccatacagatatcttcagtgtcctatagctggytagaaaaaaagctgaaacttttcttagccaaattggtgcttgtcaatactgaaaataaaaattgtttaaaaggacttgaaaataataggaaacttcaattttgtcaaaaaattgtgatccctttatttttggctatataccatcactattaactatactaaggaacatcaaaaagatgaaaaaaatttcttttaaaaagttcagttcaacaaactgtttaactaacctttattcaacacttactatgacccaaacactgtgccaaatgcctttgatgtagtatattattaatcttcacaa

SEQ ID NO: 147782 - DNA, 601 bp, Human
ttgtagtaaggcagacaagagggttctagaaagtgatcgaggcctggcgcagtggttcacacctgtaatctcagcactttgggaggctgaggcaggcggatcacttgaggtcagtagttggacagcctggccaacacggtgaaaccccgtccctactaaaaatacaaaaattagctgggcatcgtggcacatgcttgtaatcccagctacttgggaggctgagacaggagaatcacttgaaccctggaggcagaggttgaagtgagccaagatggcgccactgcactccagcctgggcaamagagggagactccgtctcaaagaaaaagcaaaggaaagaaaagataagtgatctaaagtgtgagaggcttgatagatactttaaagtatttagctacaaacaaatgtgatgggaagatgggggaaggagaaactgattctgcagatagttgcagcgggaaaaaaaagaacatagaaaaagaatgctataaactgggccttaaagtgtgagtaacattaatagctgagatgaaaagagggcattagagtcaggatgagctgatgtacttttgggattaaattccacaactccagaataact

SEQ ID NO: 147783 - DNA, 601 bp, Human
aagaccaggtgtgctattagcaaacaaagggattgttttgtttttagggtgaaaaatacttgataattcaggcacaaagggaaacgaaggttttgccttagaagttggaagggttttgtttttttcaaattaaagttctaataggttttgttgtcacaaaggtagatgcttactccttcaactttaagatgaagattactcttaaaactgcaagtaggaagggtttgagccactagaacacattgtcatcaggataatgtgaaattactgaaccgatacttcttaaagatagacagacatrgtacctgatgtggtattctagaaccggttagggtttcaaaggatattaaatggtatcctctcaccacatgtttagatctccatgaccatttctgatgcttttcttctttttctcagtctacctttggttgatacgagtcactgagcctctgtgaaagatgagtctgtaggagtagagctgctttttgctagggaggatacagcattcttatctctggcaagtcactaagaaaccccagtgtatgcaagcctgctcgccaccctttgcctctcccctaggttcagggcacaccagcatcat

SEQ ID NO: 147784 - DNA, 601 bp, Human
ggtttgagccactagaacacattgtcatcaggataatgtgaaattactgaaccgatacttcttaaagatagacagacatggtacctgatgtggtattctagaaccggttagggtttcaaaggatattaaatggtatcctctcaccacatgtttagatctccatgaccatttctgatgcttttcttctttttctcagtctacctttggttgatacgagtcactgagcctctgtgaaagatgagtctgtaggagtagagctgctttttgctagggaggatacagcattcttatctctggcaaktcactaagaaaccccagtgtatgcaagcctgctcgccaccctttgcctctcccctaggttcagggcacaccagcatcatcctctcatccacctactctcagccttgcctggtttcagccctttttccactatgaagacagaaagagtttcctgaaactcaaatctgaccacatcgattcctgcttaaaaccctaccatgcctcaggattgagtccaaatgacttaacacaatttaccatccccgttctgatctgacccctgccagtccttccagcctcacttcccaccattcccctccca

SEQ ID NO: 147785 - DNA, 601 bp, Human
taccagccctgactatatctgaaagtggggactctcagatgcccactattctgctcttctctccatgcatttactatcttctaacatgctatccaactctttccagcatgaaagtatttattatgtttattgtttattgcctgtctctccccatctgatatggtttggctgtgtccccacccaaatctcatcttaaattctgtgtcatgggggggaacagtgggaggtaactgaatcatgggggcaggtctttcccatgcccttcttgtgataataagtctcacaagatctgatggtttcrtaaaggggaggtttcctgcacaagctctctctcttcacctgctaccatccatgtaagatgtgacttgctcctccttgccttccaccatgattgtaaggcttccccagccatgtggaactgtaagtccattgaacctctttctttggtaaattgcccagtcttgggtatgtctttatcagtagcatgaaaacggactaatataccatctctaccaccactagtttcttgtctgttttgttcactgatgtattccaagcacatatcacagtgcctagaacatagtaagtgctcaatatattt

SEQ ID NO: 147786 - DNA, 601 bp, Human
tactgtcacattgtggattaagtttcaacgtgtgttttggaggggacattcaaaccatagcaactatccttttatatgttttgtaagattataactactcttgaaaccaaatggagactgaataaacaaaatattgcctgaggtcaagaggagttctattctgtatctatgaagtcaatggtacagacataatgtttcctaattagaacaaaacacaattgagtataagaaatattcatcatttaaatggttaattgttcagataaaaagcatattcaaaataacaggtcaagggagagaytgaatataacacaggttccctcaaggacaggaatgttaagataattgagcaaggaagcaattgtagattccaactcacagatttaatcagctaaatgccaaggtgctggtcacaaagattaccggcagagctgcctgcaaggtaatggttctcaaaccttagtgtacatatgaatttattaccacaagcctatcaaatcagaaccataatgactgcgactcaggagtctgaatgtgtcaccagctaccctggtggtttgggcttaggaggttcttatcagcgttgagaaatgatggtcag

SEQ ID NO: 147787 - DNA, 601 bp, Human
aactactttaaagttcatatcgaaccaaaaagagcccgcattgccaagtcaatcctaagccaaaagaacaaagctggaggcatcatgctacctgacttcaaaatatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccrtatgtagaaagctgtcactgcttcactttctttcttacatttagcgtggcctgactgagctattggaagaggggcagaggcaggagtgaatgatgctggaaatagatcctcattcaaccctgcagcagagggtgagccgcaggccctgctgttctcccatcatcatcacagccttgagactagacctcatggttgttttatcttttgggtttttttttcctggtctgcctctgggtcatcaagtacaaactggagggaaaatgctagcgtccgtggagctgtgttcagcatgaaagatca

SEQ ID NO: 147788 - DNA, 601 bp, Human
attgccaagtcaatcctaagccaaaagaacaaagctggaggcatcatgctacctgacttcaaaatatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccgtatgtagaaagctgtcactgcttcactttctttcttacrtttagcgtggcctgactgagctattggaagaggggcagaggcaggagtgaatgatgctggaaatagatcctcattcaaccctgcagcagagggtgagccgcaggccctgctgttctcccatcatcatcacagccttgagactagacctcatggttgttttatcttttgggtttttttttcctggtctgcctctgggtcatcaagtacaaactggagggaaaatgctagcgtccgtggagctgtgttcagcatgaaagatcagtatctggcttccctctcatttataactcttattttctt

SEQ ID NO: 147789 - DNA, 601 bp, Human
agcctacacatcatgaaggaatttcaaaaacataatgtttagctaaagaagtcagtcactgatacataccatataacttaaagttcaaaagcagttaaaattaagttgcgtggtttatagatgcactcacaggtggtaaaatcataagtaacaagaaaattgttaaaacaaagagcaagaaagtggttacttccaggcttgaaaggaaaggggatgtgatgagacaggcaacatgacctctggggtactggcaggcagtgttcttgacctgagtggtggttacaaggtgttcattttctayttattcattaaattatgtatgtattccctatgcattctacttaaatatatttcatttttaaaggtaaattttacaaatatttatggattgttcctttattactttttatatgtgagggaaagctccaacttgctttacctttctaagatatcccattttctctataccatttgttgactaatatatctcttgcccactggtttgtaacagtgccttaattagtttttgtgtttgaagttccagaatctcttcctggcctatgtattgtgttccgttgatggatctttccatcccatggta

SEQ ID NO: 147790 - DNA, 601 bp, Human
taccgcatttggtggcttggtataaaatcagctactgcaatacccacacattttaaaagactgtttctgaaacacaaaagcatattatattaactatagtacatacaaaaattggaaaacaagtgacctccctttaccttaaacctatttaacctgctttatttccttttactacctaaacttctattttcatctgagtcttaaacatttttatctggtcttatttttaggcagcaaaaaataaaattgaactgaattgaattacattggatcaagtccattcctttctgttttactccayggcaagaagccatttgtgacatgacaaattacatcagggcagagtggatgtcacaaataaaaatgtgacctggtatccaaaccagaaccttctttcttgatcttccattttctcttgtcttccttcttttcttttggtgcaaaaaaacatagtgaatggacctagactcatctagatagatgagatggagctacacctggagattgaatggtgcagtcttttttgttccaggctttcatgctaccctttgtagctgtccaaagtgctccatctttgccaggaaataccctactcccagca

SEQ ID NO: 147791 - DNA, 601 bp, Human
gcagtagaactatgactccttccttatttctttccaaactaggcttctagtccctgaatgccacaaggatcaaccaggtgtctgatttgagtgactaaagccaagttgtgaatagctgaaagatttggccttgaacacttgcatttcgaaagaaagccttgctaactcaaatgcattccttaaggcagaggctggaggaggcttctctgacacttacctctacttcaacatgtactggtacccccactaaccaggaaataaatataaacaactaaatttgcaagttgatatgatccaaggstcttccagaccccaacattgctatctgttctgtgatgccaaggaattgggtcaaaccaatggacactgctggtctcttggtagcaggtggtggttaaaagagaatctgcttctctgggaattcaaggtaaccctcatagggtcatcattactgacaaaaagctggcatctcagatccagaccagtgtgaggcaagtcaagaaggccctaatttagctgtgcaaacaaagcattcctgggtttgatacgacttcattccctgactggcagtctgagcttacacatgcagacataaatgcca

SEQ ID NO: 147792 - DNA, 601 bp, Human
cttctccttgctttcttaaaaaaaaaaaaataatgaaattggacacagctgaccaaaaagtgagttcttcctttcaaatatagtttcaacagtgaggtagaaggattttgctgtgaaaagacaaatggccctgaattagggtataatttttaaaagattaacctcattcagaaataaagcaatgaattagcaagcaggatcttgatgttgggtggggtatcaacctttaaatacagccttgtttcttcaggctgggtttcaatgtgcaggatgtttgttcaggcatcaacagtgccctcaygctagtgacagaatcaggtttgagaggctgagaacaaataaagcttgaagtgtcccacataccagctctgtggggaggtcaaatagcaacagtgagccttttggagaaggcaccattgaaagatgtgtcaatgacatcgtgatggccccaaagacagaagaattgattgagctcatgtggggccagaagtctctactcactgtatctttctctcagaataaaagtgctcatgtaactcctacaattctgtatataatttcacttgaattgagtaaaagtggttagaaatcaaaatctcag

SEQ ID NO: 147793 - DNA, 601 bp, Human
aaaaaaaaaaaaaaagaaaaagaaaaaaaaaagagtagattccctggtcatccaaactgcctgtcctccctactgaattattatttttttaattctataaggatgacttgtgtcattttgatttatctttcagtttaagatttggactcatctcagctcattccagcctgctcctggcaggcaggcttccacagactactaactgtcctggacaaagtacctttaatgtgattcatgatgttaagcaaaggaaaacccttaaaatcaaggttgaggacacagggggaaaggaaaacaagamcccatgaattagaaaaactgtttcattctcagaacagagattaggactccaaataccatatatctccctcctctccccgaaaaaaccttaaaaaattagactttgtcctcttgtaactacagattgatatcatctcaacctagtttcctagaacattttattgaacatctgcttccagccttgtctaatcctcaacaaaactgattatcctatgtgcaaagccccattggagatattatgaagaatgcaaagaactacaggtagtctatgctttgtactctcaaagtactaattagtata

SEQ ID NO: 147794 - DNA, 601 bp, Human
taagtgcagacactttgaagccaaacttcctatgctggaatccaggctccccactttactagtggtgtgacctactagcaacatactgggtcagcatttaaccctccctgtgtctcagtttcttcatctgtaaaatggggattataataaggttgttatttggattaaattaattaacatatgcctgggaggggggctcacacctgtaatcccaatgctttgggaggctgaagcaggaggattgcttgaagccaggagtttgagaccagcctaggcaacgtagagatcctatctctatttwaaaaaaaaatgaacaaaacaatattagccaagagtggtggtacatgcctgtagtcccagctactcaggaggctgaagcaggaggatcccttgagctcaagcgttcaagggtgcagtgagctatgatgacaccactgcactctagcctgggtgacagagtaagagcctgcctcttacaaaaaacaatgacaattttttattaacatatgtaaaatgcttagaacgtgcctggcacacggtagtcactatataaatgttgtgtttttatctcttctactttagcagagtagattcataactg

SEQ ID NO: 147795 - DNA, 601 bp, Human
ctatagacttcagacagctgaacgcattcacagtgctacagacctttgcaaggctcaaagtttaatgctttgacattggtagggaagggggtatctgaaaacataagctgaaaattaagaaaaccagggtaagttagaattacataatatcactgaaggtcaaatctaatccaccgtcccacagtggagtcataaaatcatcctcaggaaataaggacaaaataaatctagctataaagatttcaatggaatatacaactattaaaataggtatgttcgattattgagcatttttttttttcaaattgtccttaatattgttatgtagttttcacaatcaaaccaattcctccaccccaaagctgggagctggggatggtggcatagaaaaaatacaacccagaaaagataatacagagttgctgggtggcttgcaagggaatatcagcaacagaaatgcagcctcagcctcctgggaggcaattctctcctatcaattgccttagccatggaggttctgcagacgtgattcaaaattagatgctaaccaaagtcctaatcctgaggctccctgtgttaagctccagctggaaagaaattt

SEQ ID NO: 147796 - DNA, 601 bp, Human
ttttccagtgggtcttcagtaatgcagctatttcctctgtccttattcctctctgactgaaatgttcccctgtttttcctgcctcaatccaaaatgagaattttctgagatctactctcaggcttagatctgatttttctttttaagtaatttatatctacccaagtggaactagggcttaatatctcctccccaactccacgcttccctctctctaccaaattctacattttaaaaggaagatattagccaggcggggtgactcatgcctataatcccagcactttgggaggttgaggcrggcaaatcccttgaggccaggaattcaagaccagcctggacaacaaggcaaaaccccatctccacaaaaaatacaaaaaaataaaattagctgggtgtggtggcatgtgcctgtagtcccagctactcagaaggctgaggcaggaggatcacctgagcccaaggggtcaaggctgcagtgagccatgatcatgctactgcactccagcctgggcgacagggtgagaccccatctgttaaaaaattaattaattaaaacaaaaaaaggtattaaatcaaatgaagctctaattggtgaaat

SEQ ID NO: 147797 - DNA, 601 bp, Human
accagcctaggcaacaaagcaaggtcccatctctacataaaataaaaagggtggagggtgacccttagggtcatgtattttaaccctcaccccaatttacagatggggaaactgaggttcagagggttgtaacagcttccccaaggtcccactgatagaggcagtggcctggccatggtggagggaaggaagaaatgaggggtgagaaagcagaggggtgaagtggggtaggatggaccccgtctcttcccatctgccagggtcactgtgttcccacctcggcttctgggtgcggtgcttyggcgtgggagcggcgggcaggccccggccatgcttcctgttggcatggacttcggcggccccaccccctcagtgcccgccgcctgccagaggaagctgcatgcctgaccctccatgtggctcctggtcacttcagagctgcccaccaccccctccagatccaagtcggaacatcagaccctcaggaatctacccaatcttcatatcagtgtccgcatctggccctaccagcccagttccacaacccttctgccagagaggtctccagcccctcctttcctgttgagcaagtctgttctcc

SEQ ID NO: 147798 - DNA, 601 bp, Human
ctagggttttgcacctgcctctctgccagcccctccccctggggagcaggtgtctgggtcctttgcagaaatgagctcattagattgagatggaggtggtgaggggcggtggatgttattaagagagtcctcaaaaggggactgaggagctgtggctcaggcctgtaatcccagcactttgaggcaggaggattgcctgagtccaggagttcaagaccagcctaggcaacaaagcaaggtcccatctctacataaaataaaaagggtggagggtgacccttagggtcatgtattttaaccytcaccccaatttacagatggggaaactgaggttcagagggttgtaacagcttccccaaggtcccactgatagaggcagtggcctggccatggtggagggaaggaagaaatgaggggtgagaaagcagaggggtgaagtggggtaggatggaccccgtctcttcccatctgccagggtcactgtgttcccacctcggcttctgggtgcggtgcttcggcgtgggagcggcgggcaggccccggccatgcttcctgttggcatggacttcggcggccccaccccctcagtgcccgccgcctg

SEQ ID NO: 147799 - DNA, 601 bp, Human
agttcccttggactccctagggttttgcacctgcctctctgccagcccctccccctggggagcaggtgtctgggtcctttgcagaaatgagctcattagattgagatggaggtggtgaggggcggtggatgttattaagagagtcctcaaaaggggactgaggagctgtggctcaggcctgtaatcccagcactttgaggcaggaggattgcctgagtccaggagttcaagaccagcctaggcaacaaagcaaggtcccatctctacataaaataaaaagggtggagggtgacccttaggktcatgtattttaaccctcaccccaatttacagatggggaaactgaggttcagagggttgtaacagcttccccaaggtcccactgatagaggcagtggcctggccatggtggagggaaggaagaaatgaggggtgagaaagcagaggggtgaagtggggtaggatggaccccgtctcttcccatctgccagggtcactgtgttcccacctcggcttctgggtgcggtgcttcggcgtgggagcggcgggcaggccccggccatgcttcctgttggcatggacttcggcggccccaccccct

SEQ ID NO: 147800 - DNA, 601 bp, Human
aattttttgtgtttttagtagagatggggtttcaccgtgttagccaggatggtctcgatgtcctgaccttgtgatccgcccacctcggcctcccaaagtgctgggattacaggcgtgagccaccgcgcccggccctctattgtcttttctaacgctgtgtgtgtatctctcactggtggatttctcagtagcttgatagccctatttgtctttctctttagctgtacttctctatctttctgcatttttgtctccatctctctttttctctccatgtatctctgtgtctctgtctctctckgtacctctccccatccctcctcctccaccccacctggtgcttttggatatctctatccagttcccttggactccctagggttttgcacctgcctctctgccagcccctccccctggggagcaggtgtctgggtcctttgcagaaatgagctcattagattgagatggaggtggtgaggggcggtggatgttattaagagagtcctcaaaaggggactgaggagctgtggctcaggcctgtaatcccagcactttgaggcaggaggattgcctgagtccaggagttcaagaccagcctagg

SEQ ID NO: 147801 - DNA, 601 bp, Human
gacctgtctgcacttgggcctgtactctgttctctgaatttccctgtctctagggatggttgttgctgtctttctatgtgttttgagggtctttgtttctattgtctcttttttttttgagacggagtcttgctctgtcacccaggctggagtgcagtggcacgatcttggctcattgcaagctccgcctcctgggttcacaccattctcctgcctcagcctcctgagtagctgggactacaggcacacgccgccatgcctggctaattttttgtgtttttagtagagatggggtttcacygtgttagccaggatggtctcgatgtcctgaccttgtgatccgcccacctcggcctcccaaagtgctgggattacaggcgtgagccaccgcgcccggccctctattgtcttttctaacgctgtgtgtgtatctctcactggtggatttctcagtagcttgatagccctatttgtctttctctttagctgtacttctctatctttctgcatttttgtctccatctctctttttctctccatgtatctctgtgtctctgtctctctcggtacctctccccatccctcctcctccaccccacct

SEQ ID NO: 147802 - DNA, 601 bp, Human
aaccccctatcagaacaatagtgctgttgtcaccagccctcccccaccttctatggctccctggttccctgcctctttcttcagtctgtcttaactgcccacaccactagacaacaagctccctcctcacactgcaatttgcttctctggtggtcctctctacttttccatttcctcttcccccaaatcccggacctgtctgcacttgggcctgtactctgttctctgaatttccctgtctctagggatggttgttgctgtctttctatgtgttttgagggtctttgtttctattgtctcttttttttttgagacggagtcttgctctgtcacccaggctggagtgcagtggcacgatcttggctcattgcaagctccgcctcctgggttcacaccattctcctgcctcagcctcctgagtagctgggactacaggcacacgccgccatgcctggctaattttttgtgtttttagtagagatggggtttcaccgtgttagccaggatggtctcgatgtcctgaccttgtgatccgcccacctcggcctcccaaagtgctgggattacaggcgtgagccaccgcgcccggccctctattgtc

SEQ ID NO: 147803 - DNA, 601 bp, Human
cgccactgcactccagcctgggcaacagagcgagtctccgtctcgaaacaagcaagcaagcaaacaaacaaacaaaaaaacaccatcatctggtccccaggaatgctctctttctccccaacaggacaaccctgtccagatgctggtgtctaccctcttcctcagctcttctcccaagacccatacccatgaagggggaccttgaaactcacattccttcttattcctgtcccatttcacatcaaaaatagttcttcaggtgtgtgtgtgtgtgtgtgtgtgtgtgtgtgtgtgtgtgtgktgtctagaaaaagacatctagcctctagagagtgccccctccccttcccttcctacccacctggtgttgccctagaaaccaacttcaatcaaccccaaccccagatctggaagaatgtagaaactaccattcaatcctcaaagactgagtcacacccttctctgctctcatccggagggctgagtccctgagacccagcctcagctctgagacagccccctcggttctgcccccctgcagctccccactgccacccctctcttctggctctaagcccagggcagatctggccggaagcac

SEQ ID NO: 147804 - DNA, 601 bp, Human
agctgagagatcgcgccactgcactccagcctgggcaacagagcgagtctccgtctcgaaacaagcaagcaagcaaacaaacaaacaaaaaaacaccatcatctggtccccaggaatgctctctttctccccaacaggacaaccctgtccagatgctggtgtctaccctcttcctcagctcttctcccaagacccatacccatgaagggggaccttgaaactcacattccttcttattcctgtcccatttcacatcaaaaatagttcttcaggtgtgtgtgtgtgtgtgtgtgtgtgtgtgtgtgtgtgtgtggtgtctagaaaaagacatctagcctctagagagtgccccctccccttcccttcctacccacctggtgttgccctagaaaccaacttcaatcaaccccaaccccagatctggaagaatgtagaaactaccattcaatcctcaaagactgagtcacacccttctctgctctcatccggagggctgagtccctgagacccagcctcagctctgagacagccccctcggttctgcccccctgcagctccccactgccacccctctcttctggctctaagcccagggcagatc

SEQ ID NO: 147805 - DNA, 601 bp, Human
gagctgagagatcgcgccactgcactccagcctgggcaacagagcgagtctccgtctcgaaacaagcaagcaagcaaacaaacaaacaaaaaaacaccatcatctggtccccaggaatgctctctttctccccaacaggacaaccctgtccagatgctggtgtctaccctcttcctcagctcttctcccaagacccatacccatgaagggggaccttgaaactcacattccttcttattcctgtcccatttcacatcaaaaatagttcttcaggtgtgtgtgtgtgtgtgtgtgtgtgtgkgtgtgtgtgtgtggtgtctagaaaaagacatctagcctctagagagtgccccctccccttcccttcctacccacctggtgttgccctagaaaccaacttcaatcaaccccaaccccagatctggaagaatgtagaaactaccattcaatcctcaaagactgagtcacacccttctctgctctcatccggagggctgagtccctgagacccagcctcagctctgagacagccccctcggttctgcccccctgcagctccccactgccacccctctcttctggctctaagcccagggcagat

SEQ ID NO: 147806 - DNA, 601 bp, Human
tgaacccaggaggtggaagttgcagtgagctgagagatcgcgccactgcactccagcctgggcaacagagcgagtctccgtctcgaaacaagcaagcaagcaaacaaacaaacaaaaaaacaccatcatctggtccccaggaatgctctctttctccccaacaggacaaccctgtccagatgctggtgtctaccctcttcctcagctcttctcccaagacccatacccatgaagggggaccttgaaactcacattccttcttattcctgtcccatttcacatcaaaaatagttcttcaggggtgtgtgtgtgtgtgtgtgtgtgtgtgtgtgtgtgtgtggtgtctagaaaaagacatctagcctctagagagtgccccctccccttcccttcctacccacctggtgttgccctagaaaccaacttcaatcaaccccaaccccagatctggaagaatgtagaaactaccattcaatcctcaaagactgagtcacacccttctctgctctcatccggagggctgagtccctgagacccagcctcagctctgagacagccccctcggttctgcccccctgcagctccccactgccacccctct

SEQ ID NO: 147807 - DNA, 601 bp, Human
gggcctgccctacctggacctctttggcatgaaaggccacgatgaggcagaggagtaagaaggtggaaatgctgatcgtgcatttaaccaggaacaggtagagcgcccactgtcaggggggacggaaaaagcggtgtgagatcccaggtctccctccacctggccctccacctttccttcaaaaccaccattttttttttttgattcccaattttcctagcctccttcccctgcaaatcagtccctcttgatgtgtcggttctggagaagtctcaaaaccatcatctgggcccagtgcggkggctcacacctgtaatcccaacactctgggaggctgaggcaggtggatcaccgaaggtcgggagtttgagaccccctggccaacatggtgaaacccagtctctactaaaaaaacaaaaaattagctgggtgtgtaatcccagctacttgggaggctgaggaaccagaatcttgaacccaggaggtggaagttgcagtgagctgagagatcgcgccactgcactccagcctgggcaacagagcgagtctccgtctcgaaacaagcaagcaagcaaacaaacaaacaaaaaaacaccatcat

SEQ ID NO: 147808 - DNA, 601 bp, Human
tagccgatggtcaggaatgtgatggggatcagccaaagtgtgtctgaaaggtgcccagtggcattaacagcctgcctatggggaagggtaggttagttctaaaaccccaccatagaggtttccatgatattcactccccttccctctataccctcccgtccccttccctctggttccctcccttcccctcccagtatacacccatagtcctaagaatcacctggacaaaaagccattaagttctgagctttggaaagcctgcatggcctcctctctgctgtgtgacctgggcaagttgctwagccactctgggatttgagactgggtctggccaatcccaatgccggtatggtctcagctaggctacccgggctactgtagcattcagagcgtgtggttgagggtggagagtctagagggggccaaaacccagtcagaccctgactggtggctacatccacccagaggaaggggtatatttttctaatttccacaaagatgctgtgtggtccagaagtggccctatcaggaccaaaaaggactctaaaaaggcttggtgggactcggccttcctttcctctcacttcacagaggagacatt

SEQ ID NO: 147809 - DNA, 601 bp, Human
aacccatttaatcatggcttcctggggccagaggatgaccagtttgggatagggatcatgtccccaaggcagctgtactcaccatgactccagtgcacaggcagacgatcttgccccacatggtgcccggcaccacgtcaccatagccgatggtcaggaatgtgatggggatcagccaaagtgtgtctgaaaggtgcccagtggcattaacagcctgcctatggggaagggtaggttagttctaaaaccccaccatagaggtttccatgatattcactccccttccctctataccctcccrtccccttccctctggttccctcccttcccctcccagtatacacccatagtcctaagaatcacctggacaaaaagccattaagttctgagctttggaaagcctgcatggcctcctctctgctgtgtgacctgggcaagttgctaagccactctgggatttgagactgggtctggccaatcccaatgccggtatggtctcagctaggctacccgggctactgtagcattcagagcgtgtggttgagggtggagagtctagagggggccaaaacccagtcagaccctgactggtggctacatc

SEQ ID NO: 147810 - DNA, 601 bp, Human
tgagctccccagccaggaagtggcagccgcaggattcggacccaggtagcctggccccacaggtatgcacttgataactggactctacacccttgatggaggctgggagacgatttcccagttctggaagaaaatggggctgcgaagtcaggagcctgggtccctgaggaggataagggctggggccctaggttctagagagagcaaggacttaggggctggattcctaggtctgattttttattttattttttaagagacagggtctcactctgccacccaggctggagtgcagcagtaygatcatagctcactgtaccctcaaactcttgggctcaagtgatcctcccaccttggcctcccaaaatattgggattacaggtgagtatcttgttcttgaagagagaatggggctctgggggccccagacactcaagtttctcaggagctgtccctgagagcctgtgttgaacccatttaatcatggcttcctggggccagaggatgaccagtttgggatagggatcatgtccccaaggcagctgtactcaccatgactccagtgcacaggcagacgatcttgccccacatggtgcccggc

SEQ ID NO: 147811 - DNA, 601 bp, Human
ccgtctccagcctcccactcatcctcccctaacccccttggtcccctctaatctcccaggcttccactggcctgaacgtctcagcctggctcccaaggccttccaaggtctatgcctcccacctggacaactcagccctggctccatgctgcctgccctccctgagcaccttcctccgaacactcattctcctcccttccttctcccaatgctcctggcccttcaaggccttggcaattcctagctgcttgtggcatctgctcacctgtccccaagttagaaggaatcttcctaggaagcrtccccaaccctatagtttcagctcttgatcactcagaacaacttccagtcacaaacgctggctccaggggactgcctgggttccaagcccagctctgagcaagttatttaatctctcagtatttcagtgtctcatctgtgaaatggcctcacagggttactaggtggatttcatgaattacccctggcaagtgtgtagggcagagactggcacagagtatgtgctccggaaaagtaagcttttatggcccaaccatgccatggagcctttcttccaggagcaggctgtgagctcaagtgc

SEQ ID NO: 147812 - DNA, 601 bp, Human
atggtttaaaatcctcccaaaagccacagggagtgggaatcctgttcctgtcttacagctgaggaaacaggcatggaacagttaaatgacatgcccaaagcagctcctgaaataagacctagaacatagcaggtgctcattaaatatttctagcatggatgatgcctgacttccaaatccacatagtcttttactgcattctctggctaggattcactagttgatccctgagggtttgtggattttctatggaaattcttgaattctgtgtttttggcttgataaccttcagaaattaccrcctgccaattcctgcagatctgggccactgcctcgtcactgagacctgccatgcggttttggggcctgcatctgtgaccgtgcttaccatggcattgctgccaggggccactgtttgaactgtcgtgggctaacgagaaaaagcaaaggccaccagataagcagaagatgctgtgagccaggccaagggggtgttgtgacatcattgtccctaagcactggcgaaatcaaatggtctcagcagaagaagggggcgggtagctgagtcacgccttggccaggcaaacttgcatggacgtcc

SEQ ID NO: 147813 - DNA, 601 bp, Human
cggggctggggtcgacccccacctactccatagcgtaaggcaatggaaccaatattgaccacatccttatggtcctctgaggattaccctcgacaataactgttaccatgtattgaccacctaccacttcccagctacctgcccaggtgtttccctatatggtttaaaatcctcccaaaagccacagggagtgggaatcctgttcctgtcttacagctgaggaaacaggcatggaacagttaaatgacatgcccaaagcagctcctgaaataagacctagaacatagcaggtgctcattaratatttctagcatggatgatgcctgacttccaaatccacatagtcttttactgcattctctggctaggattcactagttgatccctgagggtttgtggattttctatggaaattcttgaattctgtgtttttggcttgataaccttcagaaattaccacctgccaattcctgcagatctgggccactgcctcgtcactgagacctgccatgcggttttggggcctgcatctgtgaccgtgcttaccatggcattgctgccaggggccactgtttgaactgtcgtgggctaacgagaaaaa

SEQ ID NO: 147814 - DNA, 601 bp, Human
gagcccagggattcgagaccagcctgggcaacatggcgaaaccctgtctctacaacaaatacaaaaattagccaggcgtggttgcctggcctgaagtcccaactactcgggaggctgaggtgggaggattgcctgtgcccaggaagtcaaggttacagcaagctatgatcgtaccactgcactccagcctgggcatgggaaacccagtctctttatttaaaaaagaaaaaaaaaagtctgaataaatcagtccaagatatgaatccaaactggaatgatcagataccatcatcttactgtrgcaactcaaccacatttcagcaattcacactacaattgctcctggatactcatctcattatcatttttttaacttccaaaagcatatttaagattattttgtgtttcccaatttacagcccaaaaggactcaagacacttatttgagagaatcccaaaatgtctgggtgagacacaaaatgatacgccaccagaagtctcaggggacactgggcacatgagaactaaggctggacaacagcaggttatgaagaaaacacaacgattcccctttgtcagcttcctgcacctgaccctgaag

SEQ ID NO: 147815 - DNA, 601 bp, Human
gacctcagctgattcgcccgcctcggcctcccaaaagtgttagcattacaggcgtgagccaccatgcccagctatccccacttttcattctaactctttgcaaggcaaactgagtggtattatcaaaatctaagtccacccttaaaatctacaatttactgtctaggattctgttatgcagaaacactgacatgcccatctgtccaacctgatgctccctacccattgcctgccaaggccaacgtgaatgcctgggttcaaatgctatttctgccactgtaattttttttaaaatcattamctcagcctttctcatctataaaaatggggataatgacaataattacagtactcagtgacttattatgcagagagagcatgcctgactcagaacaagtgatatccaaatgttagctctaatttttattagtacaatgaatgttgttagtcctatcatgggtaagttggtgaatttttaaaagttgtacaagtctgtacaacttttctggaagctaatttgacagtacttatcaatttttatatgtaccttctcttagaccaatgagtatttcttctaagaataaatccaactgaataattt

SEQ ID NO: 147816 - DNA, 601 bp, Human
ctgacctcagctgattcgcccgcctcggcctcccaaaagtgttagcattacaggcgtgagccaccatgcccagctatccccacttttcattctaactctttgcaaggcaaactgagtggtattatcaaaatctaagtccacccttaaaatctacaatttactgtctaggattctgttatgcagaaacactgacatgcccatctgtccaacctgatgctccctacccattgcctgccaaggccaacgtgaatgcctgggttcaaatgctatttctgccactgtaattttttttaaaatcatwacctcagcctttctcatctataaaaatggggataatgacaataattacagtactcagtgacttattatgcagagagagcatgcctgactcagaacaagtgatatccaaatgttagctctaatttttattagtacaatgaatgttgttagtcctatcatgggtaagttggtgaatttttaaaagttgtacaagtctgtacaacttttctggaagctaatttgacagtacttatcaatttttatatgtaccttctcttagaccaatgagtatttcttctaagaataaatccaactgaataat

SEQ ID NO: 147817 - DNA, 601 bp, Human
atcaggagtaggagaaagagacaaataaaatgctgagtgaccagggattttaaattataaaaacacattcccctctgttcccagcttggcatctaatagcaaggaaataattcttaatctggcaaaagccagtttggcatcctgtgaatctaagaactaccatggaagcgctacaatatcagatttttttcttgacatttctgatcaatttgttttcacttgtagcaatgatccaagcttcaattctgagatgaccaaataggaccaaactttctgtcaaatgttgaaaatggttgcaagwctctgttcagtcactgtggtttattaaggccctggaaaacagcacatgtaacatccagttgatgagaaccccttcctttcctggaagctggcaacaccctcacgccttccaaaacagctcttagcatcgtctcatccattcttaagaccatgcattggccgggcgcggtggctcatgcctgtaataatctcagcactttgggaggctgaggtgggcagatcacaaggtcaagagatcgagaccagcctggccaacatggtgaaacccagtctctactaaaaatacaaaaattagctgggc

SEQ ID NO: 147818 - DNA, 601 bp, Human
aaaactctgggaggctaaggtggtagggtggcttgagcccaggagtttaagaccagcctgggcaacatagggagaccctgtctctacaaaatacaaacatcaggctgggcacggtggctcacgcctgtaatcccagcactttgggaggtcaaggtgggcggatcacaaggtcaggagatcaagaccatcctggctaacacagtgaaaccccgtctctactaaaaatacaaaaaattagccaggcgtggtggcgggcgcctgtagtcccagctactcgggaggctgaggcaggagaatggcrtgaacctgggaggtggagcttgcagtgagccgaggtcacaccactgtactccagcctgggcaacagagcaagactccgtctcaaaaaaaaaaaaaaaaaaaaatacaaacattaggtaagtatggttggtgcatgcctgtggcccagctacctgaggtaggaggatcactagagcccaggaggtccaggctgcagtgagctgtaattgcgccactgctgaaaacacacattatacttacaaggcatttacattcagctatatatttcatcaagttttttcagtggccagggaaagatgta

SEQ ID NO: 147819 - DNA, 601 bp, Human
atgtgcagtctgatgatgatggaagtcttgagactgtcctcaatgttaagcaaattgtgagtactcaaaaatgcctgttggccaggcacagtggctcatgcctataatcccaaaactctgggaggctaaggtggtagggtggcttgagcccaggagtttaagaccagcctgggcaacatagggagaccctgtctctacaaaatacaaacatcaggctgggcacggtggctcacgcctgtaatcccagcactttgggaggtcaaggtgggcggatcacaaggtcaggagatcaagaccatcytggctaacacagtgaaaccccgtctctactaaaaatacaaaaaattagccaggcgtggtggcgggcgcctgtagtcccagctactcgggaggctgaggcaggagaatggcgtgaacctgggaggtggagcttgcagtgagccgaggtcacaccactgtactccagcctgggcaacagagcaagactccgtctcaaaaaaaaaaaaaaaaaaaaatacaaacattaggtaagtatggttggtgcatgcctgtggcccagctacctgaggtaggaggatcactagagcccaggaggtccagg

SEQ ID NO: 147820 - DNA, 601 bp, Human
ctagtatgtgcagtctgatgatgatggaagtcttgagactgtcctcaatgttaagcaaattgtgagtactcaaaaatgcctgttggccaggcacagtggctcatgcctataatcccaaaactctgggaggctaaggtggtagggtggcttgagcccaggagtttaagaccagcctgggcaacatagggagaccctgtctctacaaaatacaaacatcaggctgggcacggtggctcacgcctgtaatcccagcactttgggaggtcaaggtgggcggatcacaaggtcaggagatcaagaycatcctggctaacacagtgaaaccccgtctctactaaaaatacaaaaaattagccaggcgtggtggcgggcgcctgtagtcccagctactcgggaggctgaggcaggagaatggcgtgaacctgggaggtggagcttgcagtgagccgaggtcacaccactgtactccagcctgggcaacagagcaagactccgtctcaaaaaaaaaaaaaaaaaaaaatacaaacattaggtaagtatggttggtgcatgcctgtggcccagctacctgaggtaggaggatcactagagcccaggaggt

SEQ ID NO: 147821 - DNA, 601 bp, Human
aacaggcaacagctaatcctagtatgtgcagtctgatgatgatggaagtcttgagactgtcctcaatgttaagcaaattgtgagtactcaaaaatgcctgttggccaggcacagtggctcatgcctataatcccaaaactctgggaggctaaggtggtagggtggcttgagcccaggagtttaagaccagcctgggcaacatagggagaccctgtctctacaaaatacaaacatcaggctgggcacggtggctcacgcctgtaatcccagcactttgggaggtcaaggtgggcggatcacraggtcaggagatcaagaccatcctggctaacacagtgaaaccccgtctctactaaaaatacaaaaaattagccaggcgtggtggcgggcgcctgtagtcccagctactcgggaggctgaggcaggagaatggcgtgaacctgggaggtggagcttgcagtgagccgaggtcacaccactgtactccagcctgggcaacagagcaagactccgtctcaaaaaaaaaaaaaaaaaaaaatacaaacattaggtaagtatggttggtgcatgcctgtggcccagctacctgaggtaggaggat

SEQ ID NO: 147822 - DNA, 601 bp, Human
aaagtaggtatttttaattttacagatcgcaaaattacagctcagacaagttacttgccccaaatctagagctgataagtagcagaaacgcaattcaaacttcagtttgtctaacttcaaactcacaatctttctacaatatgcatgtcacctaccctaaaaggtgataatgctgattatccattttgtttcagaatgtgggcttctttctttaataagattttactcctgttttaatttaggtgaatactaaacaatttatgttctctagggtagtgacagccatctgtacaattccacracactctgtgaagcttaattttatgtatcaatttgtccgggctattggacgtccagatatctggttaaaattacgctggctctttccataccaccacagtggtgcacatgaatgtcttggctgatgctctcaagagcatcaacaaagctgaaaagcaaggtaaatgccaggttcttattaggccgagctccaaagtaactgtccgttttcttttttttatttttatttttcttttctttttttttttttgagacggagtcccaactccgtcacccaggccaaagtgcactggtgcatttc

SEQ ID NO: 147823 - DNA, 601 bp, Human
gtttcttcaccctcctctaactgaaatgcccgcttctttgcttttctaagagataaattaatgtcaccattactgatgactacagaattctcagcaactcctctctcttctaatttaactctgtcaaaagaacaagagagaaagctagagtgagcaatttataaacacatctccaggacatagttatatactgagatgactctacaaaatgtaactaccatcagtcaatgaaaaaatgtcacatcacttaaagacaaaagactctttctggcaaaatggcctatgtagcattactcacagkcaactttcaaatggctagttttatttattgaatagctactgcatcctaaacatttttaatacgtttttctctaatctaaacaccaacacaaagtaggtatttttaattttacagatcgcaaaattacagctcagacaagttacttgccccaaatctagagctgataagtagcagaaacgcaattcaaacttcagtttgtctaacttcaaactcacaatctttctacaatatgcatgtcacctaccctaaaaggtgataatgctgattatccattttgtttcagaatgtgggcttctttct

SEQ ID NO: 147824 - DNA, 601 bp, Human
acctcttcctgcaaaaaggcctactgtctttaagaaacccgcagcacactccggggtgctcgatgacatcaagcattggtcgtctgactctgcactagagtctgaactggaagatgttgttccagaggtcttgcccttgctgggggtaaggctaaagccaagttttatagccagtttgtctgcagttgtatttttggtagagggttcttcctttgataactcagttggtaatttctctgaggaatttctggcctccaaagtgactttgctgggaccatcactgatagattcatcacaagaytcagactccgaggaggaactgggactctcttttgagcaaacgcttacactacctttccttttggctttaacaaggctgtttctagcagaaccttttggagaactacatctctgattggcccagtctttcactgcctgtactttcggagacttgggattcttagccttttttttatattcacatttctcctttttctttggtgattttcttttggcctcttcgttatcatcacccactgtgccacaggttgctttattttttctcttgttttttttgctgacagtctgatctgtgacagct

SEQ ID NO: 147825 - DNA, 601 bp, Human
taatgttttcattttctactttctggcatttttatttagtaaaaaaacaaatctgtattatccatacaagtagtattaaatatgactttagttttaataatacactgacaacttacttttaaataaacatccttaccttgtagtcagagacatcaggagagtaactggatgttagctccaaaagctaaaaaagaagaaaaaacccacaaatacataagccctcttatcctctcccattcccacagctcctccatcatgccatgttggcgtgtccaccccgaccagtctgggagccctaccrggaacccgtaacaacactggggttccagtgggaagggcttttacaaacacatttaacctgattttctaagtaagtttatttggaaggggaatgaaccttttttgctgtgactgttcttttgaaatataccttaaatgcaatcttttctccaacttgaggggcagctgctaacagtggtaacagactatagtccttcttgggtgtctctactggattctgaaaaacagtgttagtcatgtgacatcatcactggtgagaaaatgtgaatccatgacatgaactccacacacattctaaggg

SEQ ID NO: 147826 - DNA, 601 bp, Human
atccagattaaatcaaattcccttgtattttatctatgttactatattaacactaccaattattaccttaaaaaatggtcttacattccatatagtacatcaaaaaaaagaaagaatgcactttaacaagattttcaacaaaatgttggtgggtgaaaaagaaacatgtaattctgtgatccctctgactgagtcaagcttttactgaactatgaaaaacctcacatgccaatataaagactcatacagatattaagtaagtaaattccacggataatatttatgaattacctgtggttamctgataatgcagaagaaatcatactagatcataacaaccagaagtaattcacaaatatgtaaaatagattcccatgatgaaaataatcaaatcttcttgctgagaactatttattattttctttcaaagtttagaatcatgaaggaatgaatacccaaataagttggtctaaactaattagaaaaaagtaactaaaaaaattaaactggctgggcatagtggctcacacctgtaatcccaacactttgggaagccaagatggggggattgcttgagccaaggagtttgagaccaacctgg

SEQ ID NO: 147827 - DNA, 601 bp, Human
aagattttaagtcttccaaggcatcaatccagattaaatcaaattcccttgtattttatctatgttactatattaacactaccaattattaccttaaaaaatggtcttacattccatatagtacatcaaaaaaaagaaagaatgcactttaacaagattttcaacaaaatgttggtgggtgaaaaagaaacatgtaattctgtgatccctctgactgagtcaagcttttactgaactatgaaaaacctcacatgccaatataaagactcatacagatattaagtaagtaaattccacggayaatatttatgaattacctgtggttacctgataatgcagaagaaatcatactagatcataacaaccagaagtaattcacaaatatgtaaaatagattcccatgatgaaaataatcaaatcttcttgctgagaactatttattattttctttcaaagtttagaatcatgaaggaatgaatacccaaataagttggtctaaactaattagaaaaaagtaactaaaaaaattaaactggctgggcatagtggctcacacctgtaatcccaacactttgggaagccaagatggggggattgcttg

SEQ ID NO: 147828 - DNA, 601 bp, Human
tttccatttcctcatatatcacacaattaaatgttttctatggtagggtgacaaaacaccctggtttgttcaagacaggtctgtacatctttccagcataactattaatagcatccctttgactcacaagtatcctgattcaggtgataaattacatgatcacctcatccataggagatagtaagtgcctaagaagataaaaaacaaaacaccaacgacctagaactaacccaccagatcccttcattaactgattcttccagcctgcttttgaggaaagattttttttttttttttttttgagatggagtctcgctctgttacccaggctggagtgcagtggtgtgatctcagctaactgcaagctctgcctcccgggttcacgccattctcctgcctcagcctcctgagtagctgggactacaggcacccgccaccatgccccgctaatttttttttttgtatttttactagagacggggtttcactgtgttagccaggatggtctcaatctcctgatctcgtgatccacccaccttggcctcccaaagtgctgggattacaggtgggagccaccaagcccagccttgaggaaaggttt

SEQ ID NO: 147829 - DNA, 601 bp, Human
tttgatacaccattaatcaaacacatgcggcagtaccctcatcatgaatggtgcccacacgactccagaccaaaggaaagtgacccaaaaactttggtagcagcaataatcccctaatcaaaggcaaaggactttttgaaatcctgaggatcccttcacagactagagacttgggtcttccacatgggaggcaccagagtctcaagtccgcccccaccagtggccaaggcaacccagcccctgaggctaagggcattgcccagctgagactggctctgccaacagtgatgagcagcagtarcagggctcaaaaagcagacctgttataggactcagcaagtcaggacaggggggtaggtgttggcagaggaaggcctgttgttaggattaaacagcagagtttaggccaggctcctggctcacgcctgtaatcccagcacttcaggaggctgaagtgggaggatcccttgaggttgggagttcaagaccagcctggacaacatagtgagatcccgtctctacaaaaaatgttttaaaatattagctgggtgtggtggtgcgtgcttgtagtcctagctactcaggaggctgaggcaggagg

SEQ ID NO: 147830 - DNA, 601 bp, Human
gaattctggtgtatctttgttacagcagtatagcctgccctctaacaaatacaggtactttcacgtgcattctttcatttgtctcacagtcatcttcagaaagaacttgtgattccattgtgcaaattgggaaacgaaggttcaaagatctgtcaacatgaccaaagcaacataaactagtatgtgacagagctggtattctaacctagatctcatctaatgaaaccataactgctgcaataaaactggtgctgcagctctgaaaaagggtaaaaatctgatctttccatttaaaagcaayttaaacgtatcgaaaatctgaaaaacagggggaacaaaaccattcctaatttaccactccaacacttccactatgatccttctataatattccctttcagtttctttccatgctctctgtaatgggttgaatgctgggcccccaaaagacatgtccatataccagaacctgtgactgtaatcttacttaggaaagaggtctttgcagatgcaattaaagatcttgagattcgatcatcatagattacctaggtgctccctaaatccaatgacaagggttcttattggagatggaagacac

SEQ ID NO: 147831 - DNA, 601 bp, Human
atgaatgggggtaataagagatgggcttacagtcaaaacagccatgaaaaaatgcacatctgaaacaacatcacccaatgttactgtagaaacagtgtggcatgcttgggaacaccgatacggcatggcaatgggatccaaggccctggaaggatacgactcactaggcaagaatgcccagcatggcatcccacccacacccactgtgtctggggaacagtgagtgcatagggcatgagccagggatggatgatatgagatgagactgctggcacaggcggggcccagtcacctaggaccytgcaggccatgttaagggacatgaggccagaaacagcagggggcccatgctttagacagatactttgatacagtctggatgtttgtcccctccaaatctcatgttggaatgtgattcccagtgttggaggtggggcagggtgggaggtgttcgtgtcgtgggggtggattccccatgcaccgcttggtgccctccccatggtaacaggtgagttcttgcacaaactggttgtttaacggaggctggcacttcctcctctgtctcttgttccctctctaaccctgtgacatgcctgctccc

SEQ ID NO: 147832 - DNA, 601 bp, Human
gtggctcatgcctggaatcccagcaatttgggaggccaaggtgcaggaaccacttgatctcaagcgttagaaactagcatgggcaacatggggaaaccccatctctacaaaattacaaaaaaaaaaaaaaagaaaaaactagccaggcctagtggcacacacctgtagtcccagctacttgggaggtgaggcagaagaattgcttgagcccaggaggatgaggctgcagtgagctgtgttcttgccactgcactccagcctcagcaacaaaatgagaccctgtctcaaaaaaaaaaaaaaatgcttgccaagtcttttaaaaatatctggagtgtctacctacaggaactgagtttggctaaaatagtcgttctcaaagtctggtgcccaagccagctgcagtgacatcaccagagaacccctaagaaatgcaaattattggtcaggcactgtagcttactcctgtaatcccagcaatttgggaggctgaggtaggaggattgcttgaggccaggagttcaagatcagcctggacaacatatcaatatcctgtctctacaaaaaaaaaaaaattgttttaattagcctggcttagtggcac

SEQ ID NO: 147833 - DNA, 601 bp, Human
ttggctttggcctccacatggaagtgggtaccactggcaggtgctgcctggagtgttgcacgtgggtgcagaagaaacaagaagacggaaagtgggagggccctaggcctggccttgacaacggaactccacccacttccaggttggacgagcttgcaaaggaggggtggatggaaacccaggggggtatagcagctcaagcggcaaggggagagagtgtcagaaggaggaggaatgccactgacaggtgaagctaaataaaagctgaaaggcgtccctggattttgtgacacggagtacmctgatgacctcagagctgcctgggtcaagggcaggacagaggtcagaatgcagtggcacgaggattagacttcaggctcccacctcggccccacattgcaaccctgggcagccaaacaccaacattctgaatgaaccagtctgggggacagcctgggcatcggggattttaaaaagctccccaggattccaacacgcagccacagttgagagccaccaatgtagaaaatctgcagagctgcttttccccaactgtcctcaaaaggatcatggaggaaatgagctaaacatacagctttcc

SEQ ID NO: 147834 - DNA, 601 bp, Human
ttgaacagcaactgctttcttaattaaatggtagagatcttcaggaagatcaggagcaagtcccttagacttaagaattcttaaaattttattgcctgtcacaaaacgtacttgtgcaacaccatgtgattctctcacgattacaccgatctgtgaaggagtaaggcccttcttggccagtttgtaaatctgctccttcacgtcgtcagatgtcaacttcaaccaagtggggaagctgcgtcgatagggtaaagccgactgggacaggcccttctcaggagcacgcatacgacccatgatkgcggcgatcaggcaacgaaaggcttgttttttttttttcttttgagacggagtcttgctctgtcgcccaggctggagtgcagtggcgctatcttggctcactgcaagctctgcctcccgggttcacgccattcttctgcctcagtcccctgagtaactgggactacaggcgcccgccaccacgcctggctaattttttgtatttttagtagagacagagtttcactgtgttagccaggatggtctcaatctcctgacctcgtaatctgcccgcctcggcctcccaaagtgctgggattat

SEQ ID NO: 147835 - DNA, 601 bp, Human; identical to SEQ ID NO: 26299

SEQ ID NO: 147836 - DNA, 601 bp, Human; identical to SEQ ID NO: 26300

SEQ ID NO: 147837 - DNA, 601 bp, Human; identical to SEQ ID NO: 26301

SEQ ID NO: 147838 - DNA, 601 bp, Human; identical to SEQ ID NO: 26302

SEQ ID NO: 147839 - DNA, 601 bp, Human; identical to SEQ ID NO: 26303

SEQ ID NO: 147840 - DNA, 601 bp, Human; identical to SEQ ID NO: 26304

SEQ ID NO: 147841 - DNA, 601 bp, Human; identical to SEQ ID NO: 26305

SEQ ID NO: 147842 - DNA, 601 bp, Human; identical to SEQ ID NO: 26306

SEQ ID NO: 147843 - DNA, 601 bp, Human; identical to SEQ ID NO: 26307

SEQ ID NO: 147844 - DNA, 601 bp, Human; identical to SEQ ID NO: 26308

SEQ ID NO: 147845 - DNA, 601 bp, Human; identical to SEQ ID NO: 26309

SEQ ID NO: 147846 - DNA, 601 bp, Human
tccacctgcctcagcctcccagagtgctgggattaccggcatgggccacacacggccacaacatgcatttttaatatatcacagtctaccttcaaatagtgttatgccattttgtatataacgtaagatttttacagctgcctatctatttaccttctcctatcttttgtgttattgtttccatacacttattcctaagtatattataaccctcacaatatactattattattgttgctttaaacaatctaatatctttcaaagaaatctaagaattatggggatgatcagtgatgttatrggaagtggcaaaataacaacatccaaaaatcctgtcctttataaaagttcggagaactctggcaaaaattgtcaagatcaactttttccataactttaaaaattaaccagatttacaacaatctgttgggagtggaggtggggggtgcttaaaacaacaacaaagaacataatctctgtgagagcaacgagctttgtggcattttcacctgccttaacacctccctctttctgcagctccactgtagccttgaaaacctacagcttgcagtcatggtgaaaattagcagcctagctggca

SEQ ID NO: 147847 - DNA, 601 bp, Human
tgatgttatgggaagtggcaaaataacaacatccaaaaatcctgtcctttataaaagttcggagaactctggcaaaaattgtcaagatcaactttttccataactttaaaaattaaccagatttacaacaatctgttgggagtggaggtggggggtgcttaaaacaacaacaaagaacataatctctgtgagagcaacgagctttgtggcattttcacctgccttaacacctccctctttctgcagctccactgtagccttgaaaacctacagcttgcagtcatggtgaaaattagcagcctagctggcactgagcaagtcagaacagagttggagctctttcaaagccccttccttagagaactgtcattatatgacctgtctgacagtgtcctggtaaaccccacttgaaagctttgtctttatttcacctcactgaaaactcacccagtgcaaagagtattttccctagaggcaattgtcgagaaaaatcagccacaactgttcaacaaagtagctacctcaggtgccaattggggtaaacaacaaaataaccaaaaaaaaggaaaagttggggagtaggatgtccatagggggcttt

SEQ ID NO: 147848 - DNA, 601 bp, Human
taagaataatgagagggaatgctcagttagccaaggaaggagagtgtttcaaaagtaagagattaggccacaaaagttagatagataaagaatgaaaagtgtccttcagatttggctgttacaaagtcgttggcaatcttggagcaattttgaagaagtgttttgcatggaagcagatgagattcagaaagaattataagtgagaaagtggcaataatagtgcaggtacacttttagaaatagtggctatgaatggaaagtgatatatatgtaagggatgtacctgaattataggtacgtrttctgtatgaatgaagtcttgggtttgaacctagcctcttcactctctttagtatgtagcttagccagttaatcctagtttcttatctataaaatgggaatatagtacctaccttataaggctgttctgtggattaagtgaggaaatatatgtatgtaaagtatatagtagagtcccccaaaaagagtaggaacacaataacttccagaattcccttcccaactacaaaagggagccatgatggatctgcttaactggttcttgtttgtttgtttgccagtaataaacctcttgtttttt

SEQ ID NO: 147849 - DNA, 601 bp, Human
ttggagcaattttgaagaagtgttttgcatggaagcagatgagattcagaaagaattataagtgagaaagtggcaataatagtgcaggtacacttttagaaatagtggctatgaatggaaagtgatatatatgtaagggatgtacctgaattataggtacgtgttctgtatgaatgaagtcttgggtttgaacctagcctcttcactctctttagtatgtagcttagccagttaatcctagtttcttatctataaaatgggaatatagtacctaccttataaggctgttctgtggattaartgaggaaatatatgtatgtaaagtatatagtagagtcccccaaaaagagtaggaacacaataacttccagaattcccttcccaactacaaaagggagccatgatggatctgcttaactggttcttgtttgtttgtttgccagtaataaacctcttgttttttttttcttttttcttttttttttccttgaaacggagtcttgctttgtcgcccaggctggagcgcagtagcgcgatcttggctcactgcaacctccgcctcccaggttcaagcgattcttctgcctcagcctcccaagta

SEQ ID NO: 147850 - DNA, 601 bp, Human
agactttgtctctacaaaatattaaaaaattaactgggagcaatagcatgcacctgtagtctcagctacccaagaggccgaggtagggggattgcttgagcccaggagtttgagaccggcctgggcaacatggtgaaaccccatctctacaaaaaatacaaaaattagtcaggcgtggtggcgcacgtctgtggtcccagctacctgtgtctgtccatacttttgcaggtatatccataggataaatttcaaacagtggaatcattgtgtcaaagggtagtatacatttaaaaatcagtgsagattgccaaattttcttcagaaaagattgttatcggcgtatatttccaacagcagagtatgagactgcctcttttccttcagtcttgttaatattggattttttcctcaaatgttaaaaattttgccagtcttgacaggtcatctgtttttcttccctgggtactgaacaggtaacctaaaacaccccaggaagatagaatttactcaatttttaaatattcaaagagagactcgcattcaaagagatacctcaggaaatctgcagtatcctttgataaccctttctaacatttgagtc

SEQ ID NO: 147851 - DNA, 601 bp, Human
caattttcatatcgatttttctcttttacaaaagaagaaaatagaggcatggagagtttaaatgatttgcatgaagtcatcaagctagagagtggcaaagctaagattcaaacacaggctatgtattcctagcgtccagggtcttaaccattatactgttcttcagtgtcctttcctcactggaaacgcccatcttcaagtgctctctcaaatgctatccaccttatgaagcttttcctgtttcactgattctttccatagattgaattaatctttcccttttctgaactcctatactttytcagtacttttcttttgacatttatgctcatagtatatattatcattatttataggctttaaaaaaatcttccctatttaggccgggtgcggtggctcatgcctgtaatcccagcactttgggaggccaagatgggtggatcatgaggtcaggagatcgagaccatcctggctaacatggtgaaaccccgtctctactaaaaattcaaaaaattagctgggtgtggtggcaggcgcctgtagtcccagctactcaggaggctgaggcaggagaatggcgtgagcctgggaggcggcggag

SEQ ID NO: 147852 - DNA, 601 bp, Human
tggaaacgcccatcttcaagtgctctctcaaatgctatccaccttatgaagcttttcctgtttcactgattctttccatagattgaattaatctttcccttttctgaactcctatactttctcagtacttttcttttgacatttatgctcatagtatatattatcattatttataggctttaaaaaaatcttccctatttaggccgggtgcggtggctcatgcctgtaatcccagcactttgggaggccaagatgggtggatcatgaggtcaggagatcgagaccatcctggctaacatgrtgaaaccccgtctctactaaaaattcaaaaaattagctgggtgtggtggcaggcgcctgtagtcccagctactcaggaggctgaggcaggagaatggcgtgagcctgggaggcggcggagcttgcagtgagccgagatcacgccactgcactccagcctgggtgacagagtgagactccgtctcaaaaaaaaaaaaaacaaagaaagaaaaaagaaaaaaatatcttccctatttaagagcctatgaagtcaggattcatatttcatttgtctctctaccttgaacagtgtgcaatacat

SEQ ID NO: 147853 - DNA, 601 bp, Human
gaagtggaattttaaccaagggaccgagcattttcaaatcaaaccatggcttatctcgtctactctgtaagaggttgccaaaataaatcctaggacgatgactggtaaggcctaaatccaatataaactcttaaaaagccagcaagtcagtaagagctaattagcttttcaccaaaatttcttttttacctttcatcatatcctccaggccacccatccttgtttccattgcccagagttttgcatttttaccactgcaatgtgaggagaggtaaattttatcattaaactctatctgtgycaggacaaatggagcccaggagatggtgtctactctagatacctgttgctagctagagataactaggagaaagccctgaatttctgtttctatttcttttctttttttatttttgaaaccaggatttcgctctgttgctctggctggagtgcagtggcatgatcatggctcattgtagcctcgatttcttgggctcaaatgattctactatctcagtctcccaagtagttgggactgcaggcacgcaccttcatacctggctaattttttacatttttggtagagacgggctttcgccat

SEQ ID NO: 147854 - DNA, 601 bp, Human
aaacatgcttactgcagtctctacttcctgggctcaagtgatcctcccgcctcagtctcccaagtagctgggaccacaggtgcacaccatcatgcccagctaattttattttattttttcttttgtagagatggggtctccctatgcttcccaggctggtctcaaactcctgggctcaagtggtcctctctccttggcctccccaaaagctgggattacaggcgtgagtcaccacacccagcccctttttctttcttcacaatttcacggatagaaaattcattgttactgtagatcttarcaacctcagcatgccatttttttcccttaaagttgggaacttccaccttttcatttaaaggaagcacttgtatgcacatctgaatcgccacttcactcctcttgcgctttggggccatcattaagtaaactaaggatgacttgaacacgagcagtacccatcacagtacccatcacagtcattctaataacaaagatagctactaactgactaacgggtgggtgggatgtaccacttggatatgctgggcaaagggatgattcacatcccaggtggggtggagctgaatggtgcgagatt

SEQ ID NO: 147855 - DNA, 601 bp, Human
ttattttattttttcttttgtagagatggggtctccctatgcttcccaggctggtctcaaactcctgggctcaagtggtcctctctccttggcctccccaaaagctgggattacaggcgtgagtcaccacacccagcccctttttctttcttcacaatttcacggatagaaaattcattgttactgtagatcttagcaacctcagcatgccatttttttcccttaaagttgggaacttccaccttttcatttaaaggaagcacttgtatgcacatctgaatcgccacttcactcctcttgygctttggggccatcattaagtaaactaaggatgacttgaacacgagcagtacccatcacagtacccatcacagtcattctaataacaaagatagctactaactgactaacgggtgggtgggatgtaccacttggatatgctgggcaaagggatgattcacatcccaggtggggtggagctgaatggtgcgagattttatcatgctactcagaacagcatgcaacttaaaacttatgaattgtttatttctggcattttctattcaatatttttagactgtaatcgactgagggtaactga

SEQ ID NO: 147856 - DNA, 601 bp, Human
tcatatcccctgtgacctgcacgtatacatccagatggcctgaagcaactgaagatccacaaaagaagtgaaaatagtcagttcctgccttaactgatgacatgccaccattgtgatctgttcctgccccactctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagsgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacac

SEQ ID NO: 147857 - DNA, 601 bp, Human
ctgtgacctgcacgtatacatccagatggcctgaagcaactgaagatccacaaaagaagtgaaaatagtcagttcctgccttaactgatgacatgccaccattgtgatctgttcctgccccactctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagcgtgagtgaygcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagc

SEQ ID NO: 147858 - DNA, 601 bp, Human
ctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccrggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgg

SEQ ID NO: 147859 - DNA, 601 bp, Human
ggtataccctccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgygcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttct

SEQ ID NO: 147860 - DNA, 601 bp, Human
tccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccratggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagactta

SEQ ID NO: 147861 - DNA, 601 bp, Human
gatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgctygctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgc

SEQ ID NO: 147862 - DNA, 601 bp, Human
atgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttrctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgcc

SEQ ID NO: 147863 - DNA, 601 bp, Human
tgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatcygcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgccttaagtgggtccctgacccccgagtagcctaactgggagacacctcccagtaggggctgacca

SEQ ID NO: 147864 - DNA, 601 bp, Human
ggtctggagtggacctccagcaaactccaacagacctgcagctgagggtcctgactgttagaaggaaaattaacaaacagaaaggacattcacaccaaaaccccatctgtacgtcaccatcatcaaagaccaaaggtagataaatccacaaagatgaggagaaactagagcagaaaagctgaaaattctaaaaatcagagtgcctcttccctccaaaggagcacagctcctcaccagcaatggaacaaatttggacgcagagtgactttgatgagttgagagaagaaggcttcagatgatyggtaataacaaacttctctgagctaaaggaggatgttcaaacccatcgcaaagaagctaaaaaccttgaaaaaaagattagacgaatggctaattagaataaacagcatagagaagaccttaaatgacctgatggagctgaaaaccatggcacaagaactatgtgacacatgccaaagcttcagtagccgatttgatcaagtggaagaaagggtatcagtgattgaagatcaaatgaatgaaatgaagtgagaagagaagttcagagaaaaaagaataaaaagaaatgaacaaagcctcc

SEQ ID NO: 147865 - DNA, 601 bp, Human
caggaattggaagttgtggctggggatgtgtatggaagaataggcactgtaagtagtagacctgcagaccagtctgccctgatagaacattctttttttttttttttttttttttttttttttgagacggagtcttgctctgtcgcccaggctggagtgcagtggcccgatctcagctcactgcaagctctgcctcccgggttcacgccattctcctgcctcagcctccctagtagctgggactagaggcgcctgccaccacgcccggctaattttttttttttttttgtatttttagtasagacggggtttcaccgtgttagccaggatggtcttgatctcctgacctcgtgatctgccctcctcggcctcccaaagtgctgggattacaggcgtgagccaccgcgcccggccctgatagaacattcttaacccagctctccttcaatagctggtccgatagaaaggcaaacaaatatacatctggagtcatgggttctaaccttacctctgaaattagcctgctttgtaaccattcacagattaacctttctgtttctcagtgtttacatcagtaagttcctttcagctctaaacatct

SEQ ID NO: 147866 - DNA, 601 bp, Human
tttgagtctggcttctttcacttagtattacacattttaaaattcatccacgttattgtgtgtatcagtaatttgtccccttttattgctcaataatattccattgtatggaagtgttagttgcttacccattctttggttgaggcatatttggattattcccattttctttttaatggaaaactaagttagcttgaaagtttaacccagtgggtactatttgaagatcctaagtcatataagaagttaaattagaagtaaaaattgtttctatataatgattacaactgtatgcatgccyataaataaagacaacaagaagcaatacagaaaaatggatagagaaaaattgttggagtagtagcattgcaggtgattaacttgttcgtattttcttttttcttttcttttttgagacagagtttggctcttgtcacccaggctgcagtgcaatggcacaatctcggctcactgcaacctccgcctcccaggtgcaagtgattctcttgcctcagcctcccaagtagctgggattacaggtgctcactaccacgcccggcttatttttctatttgtagtaaagacagggtttcaccatgtt

SEQ ID NO: 147867 - DNA, 601 bp, Human
atagactagagttaccggagacagatttttgtttttttgagacagagtctccctctgtcatctaggctggagcgcagtagcacattctcagctcactgcaacttccacctcctgggttcatgcaattcttgtgcctaagcctcctgagtagctgggattacaggtgcatgccaccatgcctggctaatttttgtatttttagtagagacggagttttgccatgttgtccaggctggtcttgaactcctgaactcaagtgatctgcctgcctcggcctcccaaagtgctgggattacagacrtgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagttgtgtcactggttaaaggtcaaaaatagttttatcttagtttaatt

SEQ ID NO: 147868 - DNA, 601 bp, Human
agtgatctgcctgcctcggcctcccaaagtgctgggattacagacatgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagtygtgtcactggttaaaggtcaaaaatagttttatcttagtttaatttaattcaattttatagagacagggttttgctatgttgcccaggctggtctcagactcctggagtcaagcagtctgcccacctcagcctccagtagtgctgggattacaggtgtgagccactgtgcccagcctgaaaatggttttatttattaattataaatattacttaggggtataggaaaaaaatgaacttaaatttttagtacagtatggggaacatatccaactcattgaagcctacagcttggccaaaga

SEQ ID NO: 147869 - DNA, 601 bp, Human
tttatttattaattataaatattacttaggggtataggaaaaaaatgaacttaaatttttagtacagtatggggaacatatccaactcattgaagcctacagcttggccaaagaggatcttatcatatctcccaccatacctctatgaggtttctttgtttgtcttccaactctcaactctgtgggctgtatttctatgtgtgatggacccatgtgcctgctctgaggtcatggggagtagctgattacaaatgaacttgatattccctgaaacttacgcgtactgtacgaccgtctccaktcagaacaaactgattactggttaaattttcgttttagggatgaaggtttgattacaatgcaggactttataatcttcccaaacactaagaataacagcaaccacttttttttttagacagagtctcactctgtcatccaggctggattgcagtggtgttatcttgggttactgcagcctcgacctccccaggctcagataatcttcccacctcagcctcctgagtagtttggaccacaggcacacaccgtcatgcccagctaatttttgtattttttttgtagaggtagggtttcacca

SEQ ID NO: 147870 - DNA, 601 bp, Human
ttccaactctcaactctgtgggctgtatttctatgtgtgatggacccatgtgcctgctctgaggtcatggggagtagctgattacaaatgaacttgatattccctgaaacttacgcgtactgtacgaccgtctccagtcagaacaaactgattactggttaaattttcgttttagggatgaaggtttgattacaatgcaggactttataatcttcccaaacactaagaataacagcaaccacttttttttttagacagagtctcactctgtcatccaggctggattgcagtggtgttatcwtgggttactgcagcctcgacctccccaggctcagataatcttcccacctcagcctcctgagtagtttggaccacaggcacacaccgtcatgcccagctaatttttgtattttttttgtagaggtagggtttcaccatgtcgcccaggttggtcttgaactcttgggctcaagtgatccacctgccttggcctcccaaagtgctgagatgacaggcatgagccaccatgcctggccgtcaaccactttttttttttttttttgagatggagtcttgctctgtcgcccaggctggagtgcag

SEQ ID NO: 147871 - DNA, 601 bp, Human
gctggagtgcagttgcgcaatcttggctcactgcagcctttgcctcccgggttcaagcaattctcctgcctcagcctcttgagtagctgggactacaggcacgcaccaccaggcctagctggctaatttttgtatttttagtagagatggggtttcccatgttggccaggctagtcttgaactcctgacctcaagtaatcctcccaccttggcctcccaaagtgctgggattacaggcatgagccaccgagctcgggctttttctttccttttctttttctttcttttttttttttttttkgggacagagtcttgccttgtcacccaggctggagtgcagcagtatgatctcatctcactacaatctctgcctcctgggttcaagcgattcttgtgcctcagactcccgagtagctgggactacagtcataggccaccaggcccagctaatttttgtatttttagaagagacggtgttttgccattttttccaggctggtcttgaactcctggcctcatgtgatccacctgccttggactcccaaagtgctgggattacaggcatgagccaccatgcccggcctcatcaaccattttttaa

SEQ ID NO: 147872 - DNA, 601 bp, Human
atcttggctcactgcagcctttgcctcccgggttcaagcaattctcctgcctcagcctcttgagtagctgggactacaggcacgcaccaccaggcctagctggctaatttttgtatttttagtagagatggggtttcccatgttggccaggctagtcttgaactcctgacctcaagtaatcctcccaccttggcctcccaaagtgctgggattacaggcatgagccaccgagctcgggctttttctttccttttctttttctttctttttttttttttttttgggacagagtcttgccttstcacccaggctggagtgcagcagtatgatctcatctcactacaatctctgcctcctgggttcaagcgattcttgtgcctcagactcccgagtagctgggactacagtcataggccaccaggcccagctaatttttgtatttttagaagagacggtgttttgccattttttccaggctggtcttgaactcctggcctcatgtgatccacctgccttggactcccaaagtgctgggattacaggcatgagccaccatgcccggcctcatcaaccattttttaaaaattatttcagataactt

SEQ ID NO: 147873 - DNA, 601 bp, Human
gttcatcttaaaatgaaacccagcctttttgaaaatcctgacatgctgcaagatggatgatccttgagaacattatgccaagtgatatgtcagtcacaaaaagacaaatactatatgattccacttagaatcatagtacctagaggtacctagagtattcaaaattatagagacagaaagtagaatggtggttgccaggggttggaagcaggggggagtgaggagttactctttaatgggtagagtttcagttttgcaagatgaaaagagttatggagatgaaaggtgatgatggttgcayaacattatgactgtatttaatactactaaactgaacacttaaatatggttaggatggtaaattttatgtgtattttaacataataaaaaattggaaaataaaatattttttaaaagttataggactctcatatgcccacatccagaaggaaatgctacatttctttctttctttttttttctttttttttttgagatggagtcttgctctgttgcccaggctggagtgcagtggcatgatctctgctcactgcaacctttgtctcctgggttcaagcgaattctcctgcctcagactccc

SEQ ID NO: 147874 - DNA, 601 bp, Human
tccaatttcatttcatgtcactctccccacacctactgtattatagagactctggtcttatttgactttcttttaacatactcctttctccctcaggatctttgcagtttcctctttgaatggctagctccttttcttcctttaataaggtcttagaggtcattccttgactgtccttcctaaagtaggttccttttttttaaatttaaaattattttttattgatgcataactgatgtacatagtctcagggtacaagtactaatttaatacattcatgtaatttgtgaaaatcaaatcrgtatacttgggatatccatcaccttaaatatttgtcttttctttattctaggaacatttgaattattctcttttgattattctctttttgctatttagaaatgtaaatgtatagtaaactatagtcaccctactcctgtttcaaagtacttggtacagtttgcagttattttgtgtttacttctttttctcctccactggaagaatataaactaagtgagtgcaaggactgggtctgatctgttcactatcatatccccagtgttttgaaatgtcttgcttggcatgtagcaagaagtca

SEQ ID NO: 147875 - DNA, 601 bp, Human
ttgtatatatatcaaaattctttgtaaaaagaaattgtgttttgatttcttaaagtagttaaaaaatttttttgttttaaaaatgatgttaatttaaaaaatactatacagaaatatatgtttatgaatagtataaattttatactatacttttgttttaaccttttaaacaaaagtttaaaatctccccaaattctgccactcagagtttactgaaatgttaacagtggttaacattctttcagacatctttctctgtgtatattaacttacagttttaacctagggtcaaaaaaacctrttgttttttgttttgttttgttctgagacagtgtcttgctctgtcacccaggctggagtgcagtggtatgatcttgggtcactgcaaccttcacctcccgggttcaagtgattcttgttcctctgcctcctgagtagctgggattacaggcacccaccaccacgccaggctaatttttgtatttttagtagagacagggtttcaccatgttggtcaggctggtcttgaactcctgacctcaagtgatccacccgccttggcctcccaaagtgctaggattacaggggtgagccaccgtgc

SEQ ID NO: 147876 - DNA, 601 bp, Human
ggaagacttaatattgtgaagatactacctctctcctaaacagatctatatattttatgtaaccccatccaactccaacaacattttgggagaagaactaagtgattataaagtacatataaaggaaaatgtgtccaaaaaaaaatccaaaatagccaagaatatttggaagagaagaattataattgagatttgctgtgtcagagtaaagtgtattataaagctataatattggcacagaaatagctagatcatagaataaaacaacaacaacaagatgctaacattcattgagtactcygtgtgttgtgggtatttacataattctcttacagctctgtgagggtagttactgttttattcccatttaacagataagataaccgagattcatacaaaaatgcaaaaaattagccgggcgtggtagcgggcgcctgtagtcccagctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaaagaaaactgagattcagaaagt

SEQ ID NO: 147877 - DNA, 601 bp, Human
tccaaaatagccaagaatatttggaagagaagaattataattgagatttgctgtgtcagagtaaagtgtattataaagctataatattggcacagaaatagctagatcatagaataaaacaacaacaacaagatgctaacattcattgagtactctgtgtgttgtgggtatttacataattctcttacagctctgtgagggtagttactgttttattcccatttaacagataagataaccgagattcatacaaaaatgcaaaaaattagccgggcgtggtagcgggcgcctgtagtcccarctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaaagaaaactgagattcagaaagtaacttggctaacttgttgataacaatcaacaggatattggttaaataaatatggtatacttttacaattaaagactatatgtgaccatttaaaattatgtagaatattattagtgacacagtaattaggataattatattaaaca

SEQ ID NO: 147878 - DNA, 601 bp, Human
gctaacattcattgagtactctgtgtgttgtgggtatttacataattctcttacagctctgtgagggtagttactgttttattcccatttaacagataagataaccgagattcatacaaaaatgcaaaaaattagccgggcgtggtagcgggcgcctgtagtcccagctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaargaaaactgagattcagaaagtaacttggctaacttgttgataacaatcaacaggatattggttaaataaatatggtatacttttacaattaaagactatatgtgaccatttaaaattatgtagaatattattagtgacacagtaattaggataattatattaaacaaaaaaagtagattataaaacaatatgatcccatttaagatatatatataaaagctttatatataacatatatatactatattttatttaatcaataccctgttaattgttattcaggctcgtgctaacttctgg

SEQ ID NO: 147879 - DNA, 601 bp, Human
ctccttttgttattcaccctgccagctggcttagctgctcctctgtgctcctgcagtcccctgtgtttcccttgatcgcagcgtattgtcatagtgatcatagcgtattgacattacttacttttctgactcctatctctatatccttggtgcctgtaacaatatttggctcaataaatgcttcaggaaggaaaggctgggaatgaagggaaaaaaaagaggacgggagggagaagggaaacccccttgcagagatataggtctgagttttttttctgtatttaggccagcttctttcccygatgtccaaaagcaagtggtggatggtatattactcctataattctttatactgatagagaaaatgagttgaacaacaacaaaaaaggccttgatttcagaaccacttgtctttaagttctgattgcaaggaaccaaaaatatacataaggctagctgtggtggctaacccctgtatcccagcactttgagaggctgaggcaggaggattgcttgagcccaggagtttgagaccagcctgggcaacatagggagatcctgtctctacatacacacacacacacacacacacacacacaca

SEQ ID NO: 147880 - DNA, 601 bp, Human
ttgttgcccaggctggagtgcagtggcatgatcatagctcaccataacctcaaactcctgggctcaagtgatcctcccatttcagcctcctgagtaggtgggaccacaggcatgcaccaccatgcctggctaatttttttatttttagtagagaccaggtctcactatgttgcccaggctggcctccaactcttgggctcaagtgatccccccacctctgcctcccaaagtgctgagattacaggaatgagccaccatggctggcttaaaaagccatttttaataaaagacttggcagatrtgggagttgttgcctgcttgcctttcagacttttctgggtaaaagatcataagggaccttggggaccgctccctggcccgtatactcatatcatgtatctatttaaacatgaatttgcttgaggagaaagccagagaaatggacttaatgtaaccccagtgttatttttctttccaggaaggggaacagtttgtgaagaaaatcggtggtatttttgccttcaaggtgaaagatggccctgggggtaaagaggccacctgggtggtggatgtgaagaatggcaaaggatcagtgcttcct

SEQ ID NO: 147881 - DNA, 601 bp, Human; identical to SEQ ID NO: 26310

SEQ ID NO: 147882 - DNA, 601 bp, Human; identical to SEQ ID NO: 26311

SEQ ID NO: 147883 - DNA, 601 bp, Human; identical to SEQ ID NO: 26312

SEQ ID NO: 147884 - DNA, 601 bp, Human; identical to SEQ ID NO: 26313

SEQ ID NO: 147885 - DNA, 601 bp, Human; identical to SEQ ID NO: 26314

SEQ ID NO: 147886 - DNA, 601 bp, Human; identical to SEQ ID NO: 26315

SEQ ID NO: 147887 - DNA, 601 bp, Human; identical to SEQ ID NO: 26316

SEQ ID NO: 147888 - DNA, 601 bp, Human; identical to SEQ ID NO: 26317

SEQ ID NO: 147889 - DNA, 601 bp, Human; identical to SEQ ID NO: 26318

SEQ ID NO: 147890 - DNA, 601 bp, Human; identical to SEQ ID NO: 26319

SEQ ID NO: 147891 - DNA, 601 bp, Human; identical to SEQ ID NO: 26320

SEQ ID NO: 147892 - DNA, 601 bp, Human; identical to SEQ ID NO: 26321

SEQ ID NO: 147893 - DNA, 601 bp, Human; identical to SEQ ID NO: 26322

SEQ ID NO: 147894 - DNA, 601 bp, Human; identical to SEQ ID NO: 35025

SEQ ID NO: 147895 - DNA, 601 bp, Human; identical to SEQ ID NO: 35026

SEQ ID NO: 147896 - DNA, 601 bp, Human; identical to SEQ ID NO: 35027

SEQ ID NO: 147897 - DNA, 601 bp, Human; identical to SEQ ID NO: 35028

SEQ ID NO: 147898 - DNA, 601 bp, Human; identical to SEQ ID NO: 35029

SEQ ID NO: 147899 - DNA, 601 bp, Human; identical to SEQ ID NO: 35030

SEQ ID NO: 147900 - DNA, 601 bp, Human; identical to SEQ ID NO: 35031

SEQ ID NO: 147901 - DNA, 601 bp, Human; identical to SEQ ID NO: 35032

SEQ ID NO: 147902 - DNA, 601 bp, Human; identical to SEQ ID NO: 35033

SEQ ID NO: 147903 - DNA, 601 bp, Human; identical to SEQ ID NO: 35034

SEQ ID NO: 147904 - DNA, 601 bp, Human; identical to SEQ ID NO: 35035

SEQ ID NO: 147905 - DNA, 601 bp, Human; identical to SEQ ID NO: 35036

SEQ ID NO: 147906 - DNA, 601 bp, Human; identical to SEQ ID NO: 35037

SEQ ID NO: 147907 - DNA, 601 bp, Human; identical to SEQ ID NO: 35038

SEQ ID NO: 147908 - DNA, 601 bp, Human; identical to SEQ ID NO: 35039

SEQ ID NO: 147909 - DNA, 601 bp, Human; identical to SEQ ID NO: 35040

SEQ ID NO: 147910 - DNA, 601 bp, Human; identical to SEQ ID NO: 35041

SEQ ID NO: 147911 - DNA, 601 bp, Human; identical to SEQ ID NO: 35042

SEQ ID NO: 147912 - DNA, 601 bp, Human; identical to SEQ ID NO: 35043

SEQ ID NO: 147913 - DNA, 601 bp, Human
caggttaacggtctgcaggttgattctacatgtcatggaagctgttgaaggtaaatgaggggcagggcccaatctgcttttctcaagatccttctggccactgggtggaatagatgggacggggacaagaagtgaggcgaggagaccagtgaggtggcggtggagtctggacgtgagaagagagtgcccgggcctgtagggtggggaggaagctccattcttcgactgagtaggcagaatccactggaactgtggatggggctgtggggttgagagaaagaggatagccaatgacaggccygatggaagacctgggtgatggagctgccatttgcggacaagaagaaaacaggaaaaggaggcagttttctgggtggaacttcaagttggtgacattaaacttgaagtgtggctgggcacggtggctcatgcctataattcccgcactttgggaggctgaggcaggtggattgctggagctcaggagtttgagaccagcctgggcaacatggtgagaccccgcctctacaaaaaatacaaaaaataattaggtgtggtggtgtgtgcctgtggtcccagctacttggggggctgaggtagg

SEQ ID NO: 147914 - DNA, 601 bp, Human
gatcatgcagggcctcctagaccaggttaacggtctgcaggttgattctacatgtcatggaagctgttgaaggtaaatgaggggcagggcccaatctgcttttctcaagatccttctggccactgggtggaatagatgggacggggacaagaagtgaggcgaggagaccagtgaggtggcggtggagtctggacgtgagaagagagtgcccgggcctgtagggtggggaggaagctccattcttcgactgagtaggcagaatccactggaactgtggatggggctgtggggttgagagaargaggatagccaatgacaggcccgatggaagacctgggtgatggagctgccatttgcggacaagaagaaaacaggaaaaggaggcagttttctgggtggaacttcaagttggtgacattaaacttgaagtgtggctgggcacggtggctcatgcctataattcccgcactttgggaggctgaggcaggtggattgctggagctcaggagtttgagaccagcctgggcaacatggtgagaccccgcctctacaaaaaatacaaaaaataattaggtgtggtggtgtgtgcctgtggtcccag

SEQ ID NO: 147915 - DNA, 601 bp, Human
gtggggtgggcgaggcagatcatgcagggcctcctagaccaggttaacggtctgcaggttgattctacatgtcatggaagctgttgaaggtaaatgaggggcagggcccaatctgcttttctcaagatccttctggccactgggtggaatagatgggacggggacaagaagtgaggcgaggagaccagtgaggtggcggtggagtctggacgtgagaagagagtgcccgggcctgtagggtggggaggaagctccattcttcgactgagtaggcagaatccactggaactgtggatggggytgtggggttgagagaaagaggatagccaatgacaggcccgatggaagacctgggtgatggagctgccatttgcggacaagaagaaaacaggaaaaggaggcagttttctgggtggaacttcaagttggtgacattaaacttgaagtgtggctgggcacggtggctcatgcctataattcccgcactttgggaggctgaggcaggtggattgctggagctcaggagtttgagaccagcctgggcaacatggtgagaccccgcctctacaaaaaatacaaaaaataattaggtgtggtggtg

SEQ ID NO: 147916 - DNA, 601 bp, Human
agcacgtgtggaggccctgagatggtaagggcttggtctgcttagggaacttgaggctggtgggactggagtatgtgacatgggatgaggtggggtgggcgaggcagatcatgcagggcctcctagaccaggttaacggtctgcaggttgattctacatgtcatggaagctgttgaaggtaaatgaggggcagggcccaatctgcttttctcaagatccttctggccactgggtggaatagatgggacggggacaagaagtgaggcgaggagaccagtgaggtggcggtggagtctggacrtgagaagagagtgcccgggcctgtagggtggggaggaagctccattcttcgactgagtaggcagaatccactggaactgtggatggggctgtggggttgagagaaagaggatagccaatgacaggcccgatggaagacctgggtgatggagctgccatttgcggacaagaagaaaacaggaaaaggaggcagttttctgggtggaacttcaagttggtgacattaaacttgaagtgtggctgggcacggtggctcatgcctataattcccgcactttgggaggctgaggcaggtggattg

SEQ ID NO: 147917 - DNA, 601 bp, Human
ggctaggtgctgacaacacagagttgaatctaggcagagtagcctcgttaactttgcaaagcttacagcccagtggataaagaaaccagttaacaagtgaatgcatatagaatgacaacatatgatatgtgctgtggccgggagggaacagggtacagtaagggagagccagggtggcatgaaggggttggtggggagggccttcctaagaagatgatgtgcaagttgagatggaaaaaaagaggaagaagaagagatgtaagatgttggggaagcatgttccagaggaaggaacagcacrtgtggaggccctgagatggtaagggcttggtctgcttagggaacttgaggctggtgggactggagtatgtgacatgggatgaggtggggtgggcgaggcagatcatgcagggcctcctagaccaggttaacggtctgcaggttgattctacatgtcatggaagctgttgaaggtaaatgaggggcagggcccaatctgcttttctcaagatccttctggccactgggtggaatagatgggacggggacaagaagtgaggcgaggagaccagtgaggtggcggtggagtctggacgtgaga

SEQ ID NO: 147918 - DNA, 601 bp, Human
attaatgagcacctactatatgcctggcacttggctaggtgctgacaacacagagttgaatctaggcagagtagcctcgttaactttgcaaagcttacagcccagtggataaagaaaccagttaacaagtgaatgcatatagaatgacaacatatgatatgtgctgtggccgggagggaacagggtacagtaagggagagccagggtggcatgaaggggttggtggggagggccttcctaagaagatgatgtgcaagttgagatggaaaaaaagaggaagaagaagagatgtaagatgttrgggaagcatgttccagaggaaggaacagcacgtgtggaggccctgagatggtaagggcttggtctgcttagggaacttgaggctggtgggactggagtatgtgacatgggatgaggtggggtgggcgaggcagatcatgcagggcctcctagaccaggttaacggtctgcaggttgattctacatgtcatggaagctgttgaaggtaaatgaggggcagggcccaatctgcttttctcaagatccttctggccactgggtggaatagatgggacggggacaagaagtgaggcgaggagac

SEQ ID NO: 147919 - DNA, 601 bp, Human
ggtgcctctgttctgagagaggggcaatgcccaggcagttaggacagtcagcaggaaagggcagacagaactgcctgccaagggtcctggcttcctccaccagtgcacttatttagctgttctgtgattgtctattttcctgtcagtctccccagcagtctgtgaacaccacaggacagtctctccatcatctctgtgtctgcagcacccagcacagggccaagtgtccagaaagcacaatgcatgattgcaggatccattaattaattcacttgaccagtattaatgagcacctactatrtgcctggcacttggctaggtgctgacaacacagagttgaatctaggcagagtagcctcgttaactttgcaaagcttacagcccagtggataaagaaaccagttaacaagtgaatgcatatagaatgacaacatatgatatgtgctgtggccgggagggaacagggtacagtaagggagagccagggtggcatgaaggggttggtggggagggccttcctaagaagatgatgtgcaagttgagatggaaaaaaagaggaagaagaagagatgtaagatgttggggaagcatgttccagagg

SEQ ID NO: 147920 - DNA, 601 bp, Human
ggccaggatggataataggccagtttgaggccaaaggagggagagttcaggaacgaggggttttaggactcagaaatgcgtcatatctcccccctgaaggtttaattttcccttcataggaaaatgttaaagcggttccatttcttagtgacacggttgctctgcaccagtccaaactctataataaacaaatgaaatgtatgaacacgtcctggcttttctcaacttaatatcacatgcatttccagccaagagaacactgagtctggtggagggagaccaggcatttgagagccagaargtggagagctggacgggccttcgttgctgggtaaagaagcccagggttgggggcctcacctcagatcacatgatcgcttgtggtggaggcaggtcgaggaccctggcctctgacttctgaacaggatttttttgttttgagtgacttgtccaaggccacacagctaatacatagcaaggccaggctgtgtgacaccagggtccatacaatggcctctaaggtgcctctgttctgagagaggggcaatgcccaggcagttaggacagtcagcaggaaagggcagacagaactgcctgccaa

SEQ ID NO: 147921 - DNA, 601 bp, Human
aagagggcgtgcatggcaggggctgggcaggagcaggagtgtggagatagacccttgtggcatgctgtgggactagtgggtgaccagcctggttccagggcttggcatggggaaagggtggctgtttgtcctggagaggaggtgggaacagatgtcatgggagccaggcttcgaggcccagacctgcagatggttggaactggaagctggtgagcccaaaggtaaccccctgcccccatccccccactcccccgctactgccctgtagccaggacacactgcagaaaacccttgccttccygggtcacagcttggagcccctggggatgggagcaccacagcctcctgctgggctcctaagctgtggagccagaaggtctgaccccaggacaatcaagaggtttaaaatcctcagaatactttcggagctctgaaagcaaacctctgcttggaccctttggggttctagctcagtcagctcagggtcaggcctgacatctgaatttttcaaagcagctctggtgattttgctctgccctgagtaacaacctcacaccagagtggctgttcctcaaaggcagggacacccagccctgggctg

SEQ ID NO: 147922 - DNA, 601 bp, Human
acttgggccaggggctgggttggagaaattctagaaaaaaaagagcccacatctggaagatgccagattatgggaagagtgactgaactcagctccaaccccgctggccccactgccctcccactgggcctcctttctccagagcaaggtgtgcctgtgacccctccatggcagcccaggggcctttcagccctcacgtccacccttgcagtcacccacacttctttacacctcaccacctccctttgcttgttgtttagatctccaacttctgaacgaatctgtcacgctgagtaccagrcagaggtcagtgtgaaagacaagggggtcaatgacctgatcccctcctgggatctcagaaaaaaacaaagatgcacacgaccctgcccacggagggggccatgccgctggcccgaccccttgacagtggctttcttgttcagtgagatgagtggctcttccgaatagggatactagttggtttgctcacatagatgtcactactggactaaaagatgcctgtcccccattgtgtggcatgccagctgcgaccgtgaggtcactgagctaacgacactcagctcatgcaggtcacacacag

SEQ ID NO: 147923 - DNA, 601 bp, Human
acctcgtgaaggaggtattcttcccactttatagataaggacactgaggctcagatgctaaaaggcttgtttacatttgcacatctagagggtgactccaaagccctgttcctgccctgtagcctttgcagatttcaaccacccccgcccatgcttcctgctcccccgccacattgtgacagatgaagccaccactggtcaagcgtgggctgcactcagctggactgaagcacacatgtctgaggagggacttgggccaggggctgggttggagaaattctagaaaaaaaagagcccacakctggaagatgccagattatgggaagagtgactgaactcagctccaaccccgctggccccactgccctcccactgggcctcctttctccagagcaaggtgtgcctgtgacccctccatggcagcccaggggcctttcagccctcacgtccacccttgcagtcacccacacttctttacacctcaccacctccctttgcttgttgtttagatctccaacttctgaacgaatctgtcacgctgagtaccaggcagaggtcagtgtgaaagacaagggggtcaatgacctgatcccctcctggg

SEQ ID NO: 147924 - DNA, 601 bp, Human
tgtggtcatgccactgcactccagcctgagggacagagtaagaccctgtctcaattaaaaacaaaaaagaataggaattcatgacagataaggaggctctgactgtcatggcgcaaggaatggctctgggtgccaggtgagtgcatcatggagaagtgggcaggacctggccagggcccctgcggaggccctgtggatgtgcaggtgtgcacgactcaggtgaagcagggcatgctgcatggtctgtaccagtgttgagggagcacccgggtgtgcctcagtcaagggtggctttccaggkcaggggacaggtgagctgcaggtgctaattagaaccatgaagatggaagaggccatccaaggggcttcctgctgagagcagtgacagaggtggccacgggctgggggagcattcatgacacatctgaggagcctggtgatgctttaataagttagaaaaacatgggacatctgccaggcatggtggctcacgcatgtaatcctagcactttgggaggccaaggtgggcggatcacctgaggtcaggagttcgagaccagcctggccaacatggtgaaaccccgtctctactaagaattca

SEQ ID NO: 147925 - DNA, 601 bp, Human
gagaggccaaggcaggaggatgcctcgagcccaggaattcaaggccagccttggcaacatagtgagagccccatgtctacccaaaatttaaaaaattagctgggcatggtggcgtgtgcctgtagtcccagctaattgggaggctaagtcgggaggatcgattgagccctggagttgaaagttacagtgagctgtggtcatgccactgcactccagcctgagggacagagtaagaccctgtctcaattaaaaacaaaaaagaataggaattcatgacagataaggaggctctgactgtcayggcgcaaggaatggctctgggtgccaggtgagtgcatcatggagaagtgggcaggacctggccagggcccctgcggaggccctgtggatgtgcaggtgtgcacgactcaggtgaagcagggcatgctgcatggtctgtaccagtgttgagggagcacccgggtgtgcctcagtcaagggtggctttccagggcaggggacaggtgagctgcaggtgctaattagaaccatgaagatggaagaggccatccaaggggcttcctgctgagagcagtgacagaggtggccacgggctggggga

SEQ ID NO: 147926 - DNA, 601 bp, Human
aatcccagcactttgagaggccaaggcaggaggatgcctcgagcccaggaattcaaggccagccttggcaacatagtgagagccccatgtctacccaaaatttaaaaaattagctgggcatggtggcgtgtgcctgtagtcccagctaattgggaggctaagtcgggaggatcgattgagccctggagttgaaagttacagtgagctgtggtcatgccactgcactccagcctgagggacagagtaagaccctgtctcaattaaaaacaaaaaagaataggaattcatgacagataaggargctctgactgtcatggcgcaaggaatggctctgggtgccaggtgagtgcatcatggagaagtgggcaggacctggccagggcccctgcggaggccctgtggatgtgcaggtgtgcacgactcaggtgaagcagggcatgctgcatggtctgtaccagtgttgagggagcacccgggtgtgcctcagtcaagggtggctttccagggcaggggacaggtgagctgcaggtgctaattagaaccatgaagatggaagaggccatccaaggggcttcctgctgagagcagtgacagaggtggc

SEQ ID NO: 147927 - DNA, 601 bp, Human
ctgctggcccagggactgaggcaaccatgaagtgtgtttatgtcactaagtttgtgataatttgttacacggcaatgataacgaatacacacagacacacacacagagaaccaggagataactgaaggcactacttgaagcaaggaatgctggtgtgaatgggaagctgatgaaggctgcttggttgtaggagtgaagggcatagaaaagcaagaggcagtaagaataggaattgggcagggtgcggtgactcacacctgtaatcccagcactttgagaggccaaggcaggaggatgcctygagcccaggaattcaaggccagccttggcaacatagtgagagccccatgtctacccaaaatttaaaaaattagctgggcatggtggcgtgtgcctgtagtcccagctaattgggaggctaagtcgggaggatcgattgagccctggagttgaaagttacagtgagctgtggtcatgccactgcactccagcctgagggacagagtaagaccctgtctcaattaaaaacaaaaaagaataggaattcatgacagataaggaggctctgactgtcatggcgcaaggaatggctctgggtgcc

SEQ ID NO: 147928 - DNA, 601 bp, Human
acacctggattgcagcctaagactctgagcagaggactcagccaagcccgcccagactgctggcccagggactgaggcaaccatgaagtgtgtttatgtcactaagtttgtgataatttgttacacggcaatgataacgaatacacacagacacacacacagagaaccaggagataactgaaggcactacttgaagcaaggaatgctggtgtgaatgggaagctgatgaaggctgcttggttgtaggagtgaagggcatagaaaagcaagaggcagtaagaataggaattgggcagggtgyggtgactcacacctgtaatcccagcactttgagaggccaaggcaggaggatgcctcgagcccaggaattcaaggccagccttggcaacatagtgagagccccatgtctacccaaaatttaaaaaattagctgggcatggtggcgtgtgcctgtagtcccagctaattgggaggctaagtcgggaggatcgattgagccctggagttgaaagttacagtgagctgtggtcatgccactgcactccagcctgagggacagagtaagaccctgtctcaattaaaaacaaaaaagaataggaat

SEQ ID NO: 147929 - DNA, 601 bp, Human
gagggagcatggaggcggattctccctggttgggcctccggatgagaacagagcccagcggacacctggattgcagcctaagactctgagcagaggactcagccaagcccgcccagactgctggcccagggactgaggcaaccatgaagtgtgtttatgtcactaagtttgtgataatttgttacacggcaatgataacgaatacacacagacacacacacagagaaccaggagataactgaaggcactacttgaagcaaggaatgctggtgtgaatgggaagctgatgaaggctgcttgrttgtaggagtgaagggcatagaaaagcaagaggcagtaagaataggaattgggcagggtgcggtgactcacacctgtaatcccagcactttgagaggccaaggcaggaggatgcctcgagcccaggaattcaaggccagccttggcaacatagtgagagccccatgtctacccaaaatttaaaaaattagctgggcatggtggcgtgtgcctgtagtcccagctaattgggaggctaagtcgggaggatcgattgagccctggagttgaaagttacagtgagctgtggtcatgccactgc

SEQ ID NO: 147930 - DNA, 601 bp, Human
ctgggtggggagctgcaggcagcctctagaacctgagtggctccactgcacagctgtcaatgctgggccctcaggcagcagccatggggaatcacttctgtccatgcctgagggagcatggaggcggattctccctggttgggcctccggatgagaacagagcccagcggacacctggattgcagcctaagactctgagcagaggactcagccaagcccgcccagactgctggcccagggactgaggcaaccatgaagtgtgtttatgtcactaagtttgtgataatttgttacacggcartgataacgaatacacacagacacacacacagagaaccaggagataactgaaggcactacttgaagcaaggaatgctggtgtgaatgggaagctgatgaaggctgcttggttgtaggagtgaagggcatagaaaagcaagaggcagtaagaataggaattgggcagggtgcggtgactcacacctgtaatcccagcactttgagaggccaaggcaggaggatgcctcgagcccaggaattcaaggccagccttggcaacatagtgagagccccatgtctacccaaaatttaaaaaattagc

SEQ ID NO: 147931 - DNA, 601 bp, Human
gttaaatgcacatatgatgggactccactataaggcgggggtggtgggagggctgaaataaactgaaaaccgcaaacctggagttacgccgggttatacagttaaataactaaatgtacccaccagcaagcagatttcaccagtgggttccctgcatggtaagcccacagagaggctctggccagagcctgcatatgactgtccttgctggcaagtgtcttgatctctgggaatgaataaatcagtatgtggcatatttgattgccccttgctagcatcgggggacaggcccaaccagctytggggcccagacagttgggcttctgatcccatcagccaaggacctcacctcacatctggtgaattcaccagtaagaataagaacaaaccttgtagagaagaaatcacagtggcagaattagcaatgtggagtgagaggatggtttcttctctgttatccaaaatgtttgtaatttgcttatctaattttttttttatgagataaggtcttgctttgttgcccaggctggagtgcaatggcatgaacatggctcactgcaggctcaaccttctgggctcaagcgatcctcccacctcagcc

SEQ ID NO: 147932 - DNA, 601 bp, Human
agaggccgtgatctaaaacacccacccctctgcaggccctagaaactctctggcttcagggaggtgctcactgttcaggaggtgcctgggcacagaggctggtggaggcaattcaggccctcctctctcgtggccctcacctggggaagagcccttggaaggaggagtctcctgtctcatttaaatgattttctccctttttcagagcacatgtaattgaattcacttaagttaaatgcacatatgatgggactccactataaggcgggggtggtgggagggctgaaataaactgaaaacsgcaaacctggagttacgccgggttatacagttaaataactaaatgtacccaccagcaagcagatttcaccagtgggttccctgcatggtaagcccacagagaggctctggccagagcctgcatatgactgtccttgctggcaagtgtcttgatctctgggaatgaataaatcagtatgtggcatatttgattgccccttgctagcatcgggggacaggcccaaccagctctggggcccagacagttgggcttctgatcccatcagccaaggacctcacctcacatctggtgaattcacca

SEQ ID NO: 147933 - DNA, 601 bp, Human
taagctgactgtggccacggggtggaggcctccagagggacacactgggcttcctgctagtacaggggagtaggaccatattcagtgtattcagtttcaagtcagtaaagcaaaaacaaagtgtaattaattttgcctttgaaaatctcttaagttgcccatagagtccaggaggtatagttttgtgtaagttcattcaagacagtttcccttccagccttggagtgggttgctgtttctttaagcaaacaccagatgagagcatcagcatacactcagaggccgtgatctaaaacacccrcccctctgcaggccctagaaactctctggcttcagggaggtgctcactgttcaggaggtgcctgggcacagaggctggtggaggcaattcaggccctcctctctcgtggccctcacctggggaagagcccttggaaggaggagtctcctgtctcatttaaatgattttctccctttttcagagcacatgtaattgaattcacttaagttaaatgcacatatgatgggactccactataaggcgggggtggtgggagggctgaaataaactgaaaaccgcaaacctggagttacgccgggt

SEQ ID NO: 147934 - DNA, 601 bp, Human
ggaaattcttatgacatcacattgggggaaaaccaaagcaagcaggctacagatttatttttgtggaagatactttttgggttatactgtaagttgaaagcaaaaaggattggggtagtgacaagtggcctgctggggggagaatgggaaagtaaggctcccaggccctgaaggcttgacttttctaaataaagatataattggcatggcgttagtgaactgtggcagcacacggaagacggctgaggagggcaaaaccatgggaggggggccccaatgcaggtcccgtccagatgattcrttcctatactaatgtaatgtgaggcagaattttctaatttttgtccaaggcgtctctgttcctgggtggacagagcaagttcccctgcaggcaattttattttgcaaagaatcttttgagcagcaaatgtcggatgagaaggcagcactgtcaggggaagggaggagctgttgtggcttgatgaatgcctcctccttgagaacttgagatctgcagagttatggaaaactgtgcccatttgcaccagaggatcagggccttctgagaggaaaaagactaagacctgagccccagttccct

SEQ ID NO: 147935 - DNA, 601 bp, Human
gagaagggtttggcaaaaagcaagtggagaattggaggctctagctggatccagatgctggtctgacttacccctaattccttgtgtcaagcttgtctggggatgtgtgaaaacaaggctcagttgacctcccaaggtgaggtgcaaagtctagcctcagtggaatggggccataatgggccacacacacaaacacacatgggcacacaaacacacacacagagcacctgccgggacctgctttgtaaattagcagacagcattgtgcctattttatggctgaggctaagagggtgaactygaggtgagaccacagtcccgaggcagggcagctccctcaagagtctagcagcctcccaagtgccttgtgacaggcaaaagactttgcaaactctgtgcctcccgagtgggtgagtaaaacaggatcaccaaggtgaaggtgcagcgtggaaattcttatgacatcacattgggggaaaaccaaagcaagcaggctacagatttatttttgtggaagatactttttgggttatactgtaagttgaaagcaaaaaggattggggtagtgacaagtggcctgctggggggagaatgggaaagt

SEQ ID NO: 147936 - DNA, 601 bp, Human
acggcctgtcctggggagtctgggcagccccctgcacactggctcccaaaccagactttgacggctgcttggcccaggcccatttccaataagttagaatgtgggtgtttgggaattttctgccaaactagagttcctcaggaaggggagaagggattgttgagtttctctggccaaacatgatttcctgattctaagaaaaatcagtttaaagtccttacaagaaataggaaggaaaacaatacatacacaatacaacacacacacacacacacacacacacacaacacagcttcacaggcaaacccacacccacgcttggctgtctttgctatgttgtggagctcacagaacactctaccatgcgcagccctagtgaatcacaaacacatggattcagtttcccctgaaggacgcctggtttaagaaactgaagaatgaggggagagaagggtttggcaaaaagcaagtggagaattggaggctctagctggatccagatgctggtctgacttacccctaattccttgtgtcaagcttgtctggggatgtgtgaaaacaaggctcagttgacctcccaaggtgaggtgcaaagtctagc

SEQ ID NO: 147937 - DNA, 601 bp, Human
aatcatctgactgggcaggagggccaaaggcaggtcccagggctcacaccagaaggttcagtggagctcgccaaactgtggctaccccctgactcggagggcagcatccgaagcacaggctgtaccggtttggccctctggccacccgctcctctgcctcctcctgctcacggcctgtcctggggagtctgggcagccccctgcacactggctcccaaaccagactttgacggctgcttggcccaggcccatttccaataagttagaatgtgggtgtttgggaattttctgccaaactagrgttcctcaggaaggggagaagggattgttgagtttctctggccaaacatgatttcctgattctaagaaaaatcagtttaaagtccttacaagaaataggaaggaaaacaatacatacacaatacaacacacacacacacacacacacacacacaacacagcttcacagacaaacccacacccacgcttggctgtctttgctatgttgtggagctcacagaacactctaccatgcgcagccctagtgaatcacaaacacatggattcagtttcccctgaaggacgcctggtttaagaaact

SEQ ID NO: 147938 - DNA, 601 bp, Human
gggtgccaagagggcgctccactgggacctgtgagaatgacaagcttgaactggatcaaaagcaaaagctggaggagccacagctgcagccctcagagctcactgtcagactgccggccattctcaaccattctccaccaagaaggctgcattccctaaggcagtcagggccaggtccagtttccaactccacgtgaactgaatcccccaccccttccttgcccatgtggcaaagatcatgaggagtcaggggaactcaggtctcctgcctcccctccctgcaccagcagggcccctggartctgccccgcacagggctcaggcggggccatcctgtgggcctctctccagtgcagcggttctccacagagaagggcggcagcacagttttcaaaacctcacccaccttcccaggctctgagatatgtgcccaccctgcccggtgttgaacatttgcactgggtgctgtggggctcagaagggaatgaggtgggtctgtgttcttcctggtgctctggccagcgggtggggagaccagcagcagagcaacaccaacccgggggtgggggtagctgtgactgagcgccagagcagggccagc

SEQ ID NO: 147939 - DNA, 601 bp, Human
gctgacagccagtgccatgcccattagcgccagctccaagtcatgcttcccagacggctctgccaaagccccacactcaagccgactcctcctgaggcctaaggcagcatgcccagactcccactcagctaaagtctgggccatctcgtctcagcacaccctcccaagggcagaaattcctccaccacctctgcttgcatatctcagaggacagagcactcactaccttctgagtcagcccctccactatgagctcgtgatgcttattaggaagtccttcctggtgtcacaatgaaatccrcctccggggaagagcattgggccacactgggcccagccagccctctggagccacatggaccaaacctcttggcctccaccttgatttccatggagggaaggtgggagagagtgtggggctcagagtgtgggcggtgggtgctgctaccctggcatgccctgctgccctctgaaggtccctccttcccaggcctgggtgccaagagggcgctccactgggacctgtgagaatgacaagcttgaactggatcaaaagcaaaagctggaggagccacagctgcagccctcagagctcactgtc

SEQ ID NO: 147940 - DNA, 601 bp, Human
ggagggggaggctgagccgtggctgcacacgtggggaggggactttgggctttgtttgctgccagctggtgagtcacctgggacgcggggctgccaaagggctggtgggccccccgcctgtggcttcagaagcccgggggctggtggaggctgctgcagacctgctttgactcattgagaaagggacggggcggggtgtgtgtgtcctgtagagggcagctgggtaggcagcaggtgatagaggcacgtgcctggttgcggggagcagctggggggctggggggcaggtgctgtgtggtcyggaggggagcagacctgggaatgctggggatgatgggaaaagccctagggctctcagctcagcaccaggaataactttctggcagagctgtcctgctctggcaggaactaccttgagaagtggtgacctcccagtcactggaggtgtgcaagcaacttgctaaagtcacacaataagtgggttcaagccctagtctgctggcatgacagcatccagtcacaacctcctggcagtgggaggacctgagggacagtgaggagccccaagccctgcagccaagtccttgggctctggcctcgg

SEQ ID NO: 147941 - DNA, 601 bp, Human
atgtgttgggccgcacttggcttccacagcttggagtgcacaaacaccggggtgggagggggaggctgagccgtggctgcacacgtggggaggggactttgggctttgtttgctgccagctggtgagtcacctgggacgcggggctgccaaagggctggtgggccccccgcctgtggcttcagaagcccgggggctggtggaggctgctgcagacctgctttgactcattgagaaagggacggggcggggtgtgtgtgtcctgtagagggcagctgggtaggcagcaggtgatagaggcaygtgcctggttgcggggagcagctggggggctggggggcaggtgctgtgtggtctggaggggagcagacctgggaatgctggggatgatgggaaaagccctagggctctcagctcagcaccaggaataactttctggcagagctgtcctgctctggcaggaactaccttgagaagtggtgacctcccagtcactggaggtgtgcaagcaacttgctaaagtcacacaataagtgggttcaagccctagtctgctggcatgacagcatccagtcacaacctcctggcagtgggaggacctga

SEQ ID NO: 147942 - DNA, 601 bp, Human
ccatctcacactgggaggtgcagggcagctctgccatttgccaagcgctggttacaaaggtgagggattagaaaccacgcccccacgaagtcgaagttgtagtcgcacctccctacagagagagccaagagagcctgcaggctgcccagctgccggatgcccctcccccagtttggggtgactccccattgccctccgcaaccatcccagctccttccctgccctgcgtcccctggggctgggccgctctcctcctcgtccactctgctcctggaagtacctttgcactggatgttcctcycgcctggaactctccatccaccatcccttccccaaccctggcccaatgtccccaaccctgggtcagcttagacatcactgcctctgggaagccttccctgactgcagccatctcacccacttccccagggcaccctgtgcttcccagtttgttacggagcaccctgctagtgggctcaacccgaatccccagggcctgacccagcgcctggcacaggacgggctggcacggagtgccgggagcccagtccccgccttcttctcctttcctgtcctgtggatgctgctcagctctgaagtc

SEQ ID NO: 147943 - DNA, 601 bp, Human
aggcaggagaatcgcttgaacctgggaggcagaggttgcagtgagctgaggccacgccattgcactccatcctgagcaacaagagtgaaactccgtttcaaaaaaaaatttatattgcttcaggttttaaattttaaattaaattaaataaaagttcagttcctcagttgcactgcctgcattttgggtctcagaggcctcctctgactcgtggctgttgtattggacagcccaatacaatagttctgagttacagatggggaaaatggagcacagggagatggaggcaactggccaggcyctccagttggtgaaccataatgtcaagattggaacagggatttctgattcagaaccttgtggggttcccactcccacagtgcctgtctgtggcacaaacctggtttaactctggtggtgggggaaaagatctggtttgggctatgattttattttttattaattctttgaaacagggtttcactctgttgcccaggctggggctcagtggcacgatcatggctcactgcagccttgacctcctaggctcaaatgattctctcacatcagcctcccaagtagctgggactacaggcactcg

SEQ ID NO: 147944 - DNA, 601 bp, Human
aggtgtggtggcgcatgcctgtaatcctagcttcttgggaggctgaggcaggagaatcgcttgaacctgggaggcagaggttgcagtgagctgaggccacgccattgcactccatcctgagcaacaagagtgaaactccgtttcaaaaaaaaatttatattgcttcaggttttaaattttaaattaaattaaataaaagttcagttcctcagttgcactgcctgcattttgggtctcagaggcctcctctgactcgtggctgttgtattggacagcccaatacaatagttctgagttacakatggggaaaatggagcacagggagatggaggcaactggccaggccctccagttggtgaaccataatgtcaagattggaacagggatttctgattcagaaccttgtggggttcccactcccacagtgcctgtctgtggcacaaacctggtttaactctggtggtgggggaaaagatctggtttgggctatgattttattttttattaattctttgaaacagggtttcactctgttgcccaggctggggctcagtggcacgatcatggctcactgcagccttgacctcctaggctcaaatga

SEQ ID NO: 147945 - DNA, 601 bp, Human
ggaggctggaaagtgtgagacaccgtgctgttcgatgtggcccgagctcaggtaatatctgagggttagtgacagattggtgatagaagggatagagaagataggctgagctcaggagtagggtggccttgtggcacttcagcacaactcaggcagcagaatttgctggatgtctagaagggagaacgaaaaattccttccatttgagaagatcaaagtacacatggtgtactgggagggtcactgaagtagtacttgtaagatcaaaaacctgacctaagaactcaccaatgcagattasatagaaagggacggtatagcagccatccggagtgatcgtgtccctggaagggtgttcctaaatcaatgctaagtggaaaagcaagttaccagattgtttgcatctctgcagtgagccctggaacctcctgggatggtggactccctccagatttgcagtctaggcacatagatgtgtctgagggattgtgtggagtggggtgcaggtgaggactggatttcaggaaaggataaaggcccctcagaaggccccccaccggggacgaagaggcctaacacgggggtggcgccaactcaggga

SEQ ID NO: 147946 - DNA, 601 bp, Human
aaggagtgagtgaatgaatgaatgagtgtttacaatctctgctcatcctcatctgccaggatgccatatgttagtgatgggcttagggtgggtcttagacataaatcctgaagggctcataatgggattgtgcagccagaggaaatggggggctgccctgcaatcatcatccaagagagattatcccacgcagggccggtgcgtcaacccagggccaaacagtcctcccaccatgacagaaccccccgcagtggggtccagccgcctcaggccacagggaagccatgtacccgagagcagrccctgcctgaggtcacacaggacagcagtgcccggctgggccagaactcagggccagacccaggcctgtcctccttcattcacgtgcgttcaaacctttcgcacatgcccactccgtgccatgccctgtgcccacaggaagaaatcagaacctgtccctgacctcaaggagttcctaatctgccagggaatggggagggagaaggaaaggacactgggccacaagtgcactcaaatggcccctggactatgtgggagcatcagaaccgcaagggaagcggggacaaggaaatgctgtctt

SEQ ID NO: 147947 - DNA, 601 bp, Human
tgcccacgatgacagccatgaaggtggtccacaggtagtacgccacggtgaggacgcccaggcggctagaggtcttggcatccagggaggcaagtccggacatcaagctgggagggcgagggggtcaggggctgtggtggggaggccagggcctggctggcactcagcgctcactcagcccctcctggccatgtccagctgcctcacagtgctccagggaaccccattcttccaacaatccagtcctgtgctccttccagcctctctttctgctctgccctctcccccacgccccggggcrcaggccacacacatctgtgccttgagacctctgcactgctaggcagagagcccaggccagggtggctgtgggatggtggggacactgttgggggagtgagagattaattaaggaaatgcgtgtgctttactttgttgcctcaagtttcccatgcttggtgtcctctcagaagcttccttcactctcctgacccctgcccagccaggcaggaccaagcttggtctacctctgagatctacctgcctctcccccagagtgaggagcccattctaggacccccacagcccctggctgctccat

SEQ ID NO: 147948 - DNA, 601 bp, Human; identical to SEQ ID NO: 35044

SEQ ID NO: 147949 - DNA, 601 bp, Human; identical to SEQ ID NO: 35045

SEQ ID NO: 147950 - DNA, 601 bp, Human; identical to SEQ ID NO: 35046

SEQ ID NO: 147951 - DNA, 601 bp, Human; identical to SEQ ID NO: 35047

SEQ ID NO: 147952 - DNA, 601 bp, Human; identical to SEQ ID NO: 35048

SEQ ID NO: 147953 - DNA, 601 bp, Human; identical to SEQ ID NO: 35049

SEQ ID NO: 147954 - DNA, 601 bp, Human; identical to SEQ ID NO: 35050

SEQ ID NO: 147955 - DNA, 601 bp, Human; identical to SEQ ID NO: 35051

SEQ ID NO: 147956 - DNA, 601 bp, Human; identical to SEQ ID NO: 35052

SEQ ID NO: 147957 - DNA, 601 bp, Human; identical to SEQ ID NO: 35053

SEQ ID NO: 147958 - DNA, 601 bp, Human; identical to SEQ ID NO: 35054

SEQ ID NO: 147959 - DNA, 601 bp, Human; identical to SEQ ID NO: 35055

SEQ ID NO: 147960 - DNA, 601 bp, Human; identical to SEQ ID NO: 35056

SEQ ID NO: 147961 - DNA, 601 bp, Human; identical to SEQ ID NO: 35057

SEQ ID NO: 147962 - DNA, 601 bp, Human; identical to SEQ ID NO: 35058

SEQ ID NO: 147963 - DNA, 601 bp, Human; identical to SEQ ID NO: 35059

SEQ ID NO: 147964 - DNA, 601 bp, Human; identical to SEQ ID NO: 35060

SEQ ID NO: 147965 - DNA, 601 bp, Human; identical to SEQ ID NO: 35061

SEQ ID NO: 147966 - DNA, 601 bp, Human; identical to SEQ ID NO: 35062

SEQ ID NO: 147967 - DNA, 601 bp, Human; identical to SEQ ID NO: 35063

SEQ ID NO: 147968 - DNA, 601 bp, Human; identical to SEQ ID NO: 35064

SEQ ID NO: 147969 - DNA, 601 bp, Human; identical to SEQ ID NO: 35065

SEQ ID NO: 147970 - DNA, 601 bp, Human; identical to SEQ ID NO: 35066

SEQ ID NO: 147971 - DNA, 601 bp, Human; identical to SEQ ID NO: 35067

SEQ ID NO: 147972 - DNA, 601 bp, Human; identical to SEQ ID NO: 35068

SEQ ID NO: 147973 - DNA, 601 bp, Human; identical to SEQ ID NO: 35069

SEQ ID NO: 147974 - DNA, 601 bp, Human; identical to SEQ ID NO: 35070

SEQ ID NO: 147975 - DNA, 601 bp, Human; identical to SEQ ID NO: 35071

SEQ ID NO: 147976 - DNA, 601 bp, Human; identical to SEQ ID NO: 35072

SEQ ID NO: 147977 - DNA, 601 bp, Human; identical to SEQ ID NO: 35073

SEQ ID NO: 147978 - DNA, 601 bp, Human; identical to SEQ ID NO: 35074

SEQ ID NO: 147979 - DNA, 601 bp, Human; identical to SEQ ID NO: 35075

SEQ ID NO: 147980 - DNA, 601 bp, Human; identical to SEQ ID NO: 35076

SEQ ID NO: 147981 - DNA, 601 bp, Human; identical to SEQ ID NO: 35077

SEQ ID NO: 147982 - DNA, 601 bp, Human; identical to SEQ ID NO: 35078

SEQ ID NO: 147983 - DNA, 601 bp, Human; identical to SEQ ID NO: 35079

SEQ ID NO: 147984 - DNA, 601 bp, Human; identical to SEQ ID NO: 35080

SEQ ID NO: 147985 - DNA, 601 bp, Human; identical to SEQ ID NO: 35081

SEQ ID NO: 147986 - DNA, 601 bp, Human; identical to SEQ ID NO: 35082

SEQ ID NO: 147987 - DNA, 601 bp, Human; identical to SEQ ID NO: 35083

SEQ ID NO: 147988 - DNA, 601 bp, Human; identical to SEQ ID NO: 35084

SEQ ID NO: 147989 - DNA, 601 bp, Human; identical to SEQ ID NO: 35085

SEQ ID NO: 147990 - DNA, 601 bp, Human; identical to SEQ ID NO: 35086

SEQ ID NO: 147991 - DNA, 601 bp, Human
tctaaaactttgctactgcaggaagctctaaggtggaacttcggtaaccaaagcatttgttgctttttcttccatactctattaacttatttttatgtctttattttttttttaattgagagaacaaactcaccataactgagaatttccctctttttacgtgcctatgtttgtatgttcaaatgtcctcttactccctgtcctttgcatcccagagtaaacttgcaaactgctgccccctgtcccctgtaatgaaaatacctcggcagctcctcttggcatcttatggtcttgctctttrgttctaggaataaggcagtaaagtgtcctctttttcctgcttaaagaaaattcacacctgtaactgtagttagaactgaacacaggagccatattcttgcttgtcatcattcagttggcccaaacaaatttgttttatttttataagctgtgaagaaattagttgcctcttttaattctgagatagttctgggtacttctaaggaacaacttctctgaataatggtacagggtgtaatgagaattcctttggttccttttgaatacatctagtatttttagaaattttgtcagaaagttt

SEQ ID NO: 147992 - DNA, 601 bp, Human
tacttctaaggaacaacttctctgaataatggtacagggtgtaatgagaattcctttggttccttttgaatacatctagtatttttagaaattttgtcagaaagtttattataaatttgttaacggatcagttttcgagcaattttgatacctttttctttaaaattaatagtgaacacttaacggttaaaataggccattgtctttatttctattaacccatttaatcttttcaacaactctatgaggtaggtcctgttatactctctttttgacagatgaggaaactgaggcacacagkttaagtatcttgtccagggtttcacagctggtaatgaagaaaggtctggctgcacagcccatgtctttaaccaccatgaagaattcattatccaaatgggcggatcagaaattagaattctgtataaccctactccggaaagaaatggacatgagcattcttaggtaaaagcgagaagggcagagaaatgaaaatgtgctgcaaaaatgactgctgcttcagtggtaaaaaaaaaaaaaaacttgacttttcagtcaggcttctgtctgtgttataataaaaataggtcaggataatggg

SEQ ID NO: 147993 - DNA, 601 bp, Human
gctctcacttataagtgaatacgatgtttggttttccattcctgagtgacttcacttagagtaatggcctccagctccatccaagttgctgcagttgccattatttcgttgtttcatggctgagtagtagtccatggtgtatatatgccacattttctttatccactcattggttgatgggcatttaggttggttccatatttttgcagttgtgaattgcgaattgctgctataaacgtgtgtacatgtgtctttttcatatgattagttgttttcctttgggtagatactcagtagtggkattgctggatcaaatggtagttctacttttagtttttaggtttttttagttttttttgagacagaatctttctctgttgcccaggctggagtgcagtggcgtgatctcagctcgctgcaacctctgcctcccgagttcgagcaattctcctgcctcagcctcccgggtagctgggattataggtgcctgccaccaggtccagctcatttttgtatttttagtagagacaaggtttcaccaagttggtcaggctggtcttgaactcctgacctcgtgatccgcccatcttggcctcccaaa

SEQ ID NO: 147994 - DNA, 601 bp, Human
gcctccagctccatccaagttgctgcagttgccattatttcgttgtttcatggctgagtagtagtccatggtgtatatatgccacattttctttatccactcattggttgatgggcatttaggttggttccatatttttgcagttgtgaattgcgaattgctgctataaacgtgtgtacatgtgtctttttcatatgattagttgttttcctttgggtagatactcagtagtgggattgctggatcaaatggtagttctacttttagtttttaggtttttttagttttttttgagacagartctttctctgttgcccaggctggagtgcagtggcgtgatctcagctcgctgcaacctctgcctcccgagttcgagcaattctcctgcctcagcctcccgggtagctgggattataggtgcctgccaccaggtccagctcatttttgtatttttagtagagacaaggtttcaccaagttggtcaggctggtcttgaactcctgacctcgtgatccgcccatcttggcctcccaaagtgttgggattacaggcgtgagccactgcgcctggccagttttttaaggaatctccatattgtttt

SEQ ID NO: 147995 - DNA, 601 bp, Human
tttcatatgattagttgttttcctttgggtagatactcagtagtgggattgctggatcaaatggtagttctacttttagtttttaggtttttttagttttttttgagacagaatctttctctgttgcccaggctggagtgcagtggcgtgatctcagctcgctgcaacctctgcctcccgagttcgagcaattctcctgcctcagcctcccgggtagctgggattataggtgcctgccaccaggtccagctcatttttgtatttttagtagagacaaggtttcaccaagttggtcaggctkgtcttgaactcctgacctcgtgatccgcccatcttggcctcccaaagtgttgggattacaggcgtgagccactgcgcctggccagttttttaaggaatctccatattgttttccacagtagttgtactagtttacattcccaccagcagtgtataagagttcccttctcaccacatccatgccattgtctatttttttaattattatttttaaattatggccattcttgcaggagtaaggtggtatctcattgtggttttaatttgcatttccctgataattagtgatgttgagcatttt

SEQ ID NO: 147996 - DNA, 601 bp, Human
cagaataaattggatattaaggctgatataatgctcttgtttactataacctttcatttaaaatatttatattaaaaatagcctcattgttctcattgtccttatgagtacatgctgcataaatttaacaattaactttttttaaaaaatgaattatttactttatatatttattgtaaattcatttgaaaaactggatttcctactaaaaaactagttgaatgtcgtcactcctaggcaatttgctctgcctctcggcttgaatgtccaccttgagcctgtgtgtttcagtcttgaccttgtatgtcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctg

SEQ ID NO: 147997 - DNA, 601 bp, Human
gaataaattggatattaaggctgatataatgctcttgtttactataacctttcatttaaaatatttatattaaaaatagcctcattgttctcattgtccttatgagtacatgctgcataaatttaacaattaactttttttaaaaaatgaattatttactttatatatttattgtaaattcatttgaaaaactggatttcctactaaaaaactagttgaatgtcgtcactcctaggcaatttgctctgcctctcggcttgaatgtccaccttgagcctgtgtgtttcagtcttgaccttgtatgtcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctgct

SEQ ID NO: 147998 - DNA, 601 bp, Human
aaattggatattaaggctgatataatgctcttgtttactataacctttcatttaaaatatttatattaaaaatagcctcattgttctcattgtccttatgagtacatgctgcataaatttaacaattaactttttttaaaaaatgaattatttactttatatatttattgtaaattcatttgaaaaactggatttcctactaaaaaactagttgaatgtcgtcactcctaggcaatttgctctgcctctcggcttgaatgtccaccttgagcctgtgtgtttcagtcttgaccttgtatgwcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctgctgaaa

SEQ ID NO: 147999 - DNA, 601 bp, Human
gtgtgtttcagtcttgaccttgtatgtcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgmaaatcttgttctgagctctgctgaaatacggggatataaaggtcttgcctgctcactggatacatttgttgtaataacttcctgttatttaataattcctcattcctcatgactatgattttactcatagcattctattgtctcagccttgtcatttgaccaggtagtatgtatgctgtttgaagactctttaacgttgcctatcagtaggctactggtagtagtttctttaaagagaaaatggaaaacgtgagagaaggagattagctgaagactccgtaggtcttcataagctggcac

SEQ ID NO: 148000 - DNA, 601 bp, Human
actgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctgctgaaatayggggatataaaggtcttgcctgctcactggatacatttgttgtaataacttcctgttatttaataattcctcattcctcatgactatgattttactcatagcattctattgtctcagccttgtcatttgaccaggtagtatgtatgctgtttgaagactctttaacgttgcctatcagtaggctactggtagtagtttctttaaagagaaaatggaaaacgtgagagaaggagattagctgaagactccgtaggtcttcataagctggcactcccttggcacgataatcaaggcccagac

SEQ ID NO: 148001 - DNA, 601 bp, Human
tcaactggggacttgtcacttaggaggactttgtagttccctttaattttctgtcattgttagaggccactctgtttccttcatgtatgctctcatggtgtcctgcaaatcttgttctgagctctgctgaaatacggggatataaaggtcttgcctgctcactggatacatttgttgtaataacttcctgttatttaataattcctcattcctcatgactatgattttactcatagcattctattgtctcagccttgtcatttgaccaggtagtatgtatgctgtttgaagactctttaaygttgcctatcagtaggctactggtagtagtttctttaaagagaaaatggaaaacgtgagagaaggagattagctgaagactccgtaggtcttcataagctggcactcccttggcacgataatcaaggcccagacactcactgtgcttggcttctcaggcacagatactcagctttgtctgtacacctggttagtcagtgtattctcttgcttgtagaaagccaaagtataattaagagattgattagtaagcatgatattagcaagggaaatgagttgaatgatcccggtgactcatgtt

SEQ ID NO: 148002 - DNA, 601 bp, Human
aatgagaggcagtgtgatccagacttactcttaggtttttattttctaggcatcacacaggctgcttttttcccttgtgtcacaaactttcctaaattgtttgggttatagtatgtttgttttaatcttcagtctttataacaaaccttgcttttcctgctttaatttgggagtatattttatccttctcactttaagatttctttttttaaacctcagtggtacggtacatttttactaatggtgagtctcagaggatcaccttattgtctccatcccccacccagtattctccccatamtctctgtcccaccacccctcgccaagaatcctttagcatagtttctcagaacaatgtggcaaagatgtcagtggttggtgctttcataaaattctttttgaatattgtgttcaaaaaggatcatgatggtatctggcttttctggatttaagtcataaaattaaattttaaaaaatcagaaccacatcagaattctatccagttattaaaaactgtttttaaatagtgtttagtgacatgtgaagatgctcatgatacaactccttttggggtggtacctgagtagctcttcttaagaag

SEQ ID NO: 148003 - DNA, 601 bp, Human
atgtgagctaatctctatttgtgcttaaactattaatttgagttaaacttcttaaaaccctaatactcagtgtgatcgcattttaaaaagtatgtgcatagaaaaaagatataaaaaatacatactaatttttcctaaaactttttatgatgaacgtgttacacattttattttaaaataaaaagctaatcagagagcctaaattcttaactagctcatttataattttaagtttctttacgttgaattgttactaaaattgaaattgatgagagtccatgtgatataaagagaatattgytgccaaattttaaatgattttatttatttttggtatctgagctggcttatctgagctggctgtagcaagctgcttttaaaaaactatttacttcagcttgggtaatagagtatgtagattagaaacaactccaacagtaacaaaacaaacacaggacttacattagggtggtcttttacattaatagaaatatttaaaatctagaactgtgttctcaacatgtatattgtgtttaaatgctttccccattttaagcggtgtacttgaaatgtctatattttaaaagatacattattccac

SEQ ID NO: 148004 - DNA, 601 bp, Human
tttatggtcgtgacctacagtaagaaatatattttatgacagtgtgtgtgtgccttataaccaaaagaaaacaattttgaaacagtatttgaccttgcaatatatgatactcaaataattcttattctgttctattaaaaattgttcatcataacctactaaattgattttattacccacaaataggttgtgaccctcagttttaaaagcatagctctacccaaaataaaatggatgctgttatactttgtaccttgtcccttgagactgagtcaggagaacaagtacactatttgtctastaaatgatcaaatggaattttgaagaagctcggcaatacttacttcttgaagacagcattgttacccgaaggcaagagtaagaatgtatctatgcttgtctctcaaggttgttctcttggctgcttatccttaaactacaagaattgtaaagatcagtttaaaatctaggattaattttagagtaaaattgggattggcattatgtgaataatttaggtaatttgttgatctttctctgaaacagtaacctgtgtttaaaatttttcacatagagcagtccttaagaaaagaaaggaact

SEQ ID NO: 148005 - DNA, 601 bp, Human
acaagattaaagtcattccaaaatttttttaaacaaaatattcatataaacataaggattctattttcaagaaagagtggctattccatttttataaattagatggaatatccactctttcttgaaaatgagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaaactgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctaga

SEQ ID NO: 148006 - DNA, 601 bp, Human
aaatgagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaarctgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctagagaaggctaagcatttcttctgacttgacaactcatcaataacaacatgacagataaacctaattattttctagcacttctttttttaaaaggtgaaagaacaaatctttgtgattgtttcgggga

SEQ ID NO: 148007 - DNA, 601 bp, Human
ttaaattgtgtttaataatcagtgttttagtactcaggaatggtgtaggtatctaatgaatacccattgattaagtcaatttagtatcagaagttttaaattacctagagaccttggaaattatcttcaagctgatgtgattattgaaataaagtttgtcagataatgattaaatttgtttaaatacaaatttaccttttttagaatcttaagcattaagtagtagtaatgttagcttatttgattaataaacatgtataagtttaggaagaacattacaagtagaataaaaatctgtgcrtatatttaacacactgataagtcagagaagacatagctgtttttttatttttgttttttgagacagagtcttgctctgtcgcccaggttagagtgcagtggtgcaatcttggctcactgcaacctctgcctccgaggttcaagcaattctcctgcctcagcctcccgagtagctgggattacaggtgcccgccaccgtgcctggctaatttttgtatttttaatagaaacggggttttgccatcttggccaggctggtttcgaattcctgacctcatgatccccccaccttggcctccca

SEQ ID NO: 148008 - DNA, 601 bp, Human
gaataaaaatctgtgcgtatatttaacacactgataagtcagagaagacatagctgtttttttatttttgttttttgagacagagtcttgctctgtcgcccaggttagagtgcagtggtgcaatcttggctcactgcaacctctgcctccgaggttcaagcaattctcctgcctcagcctcccgagtagctgggattacaggtgcccgccaccgtgcctggctaatttttgtatttttaatagaaacggggttttgccatcttggccaggctggtttcgaattcctgacctcatgatcccmccaccttggcctcccaaagtgctgggattacaggtttgagccactgtgcccgaccaacatggctgttttattaaaccaacaatataaactagtatcagttactaaaggtttacctaaattgtgtgaatttgaattctgaaactgtttctgagttagtttccatgatccatgtcttcttttttctcacattgaattaaaggtgcaatttccttgacttctgagcattttaggactattcaatttatagaaggacagctggcctttcgtatctgtgggttctgcatctgtggattcaaccaa

SEQ ID NO: 148009 - DNA, 601 bp, Human
aaacgtgggaattactgaggaagatagagggagggctaattttacaatatgcaaggacatggtggtcctttgaggttagccatttcttggaacacagaacgtggatttcctatccattgctctcttaaggagcacagggctcagataaagttaaacagttgtgtcaagtgatgggtgtgtaagtgcccaactcattctgtcctttataacatagaatattttcatttgtattaaatagtttgaagtaattaattttaaatacccagacatgatcctgtatagcctctgaaaatctgtaaargtttttctcctttttaaaaaaattgctttggttcatatttggtgcttctgctctttaataggctttgtttctagtaaggtcatgcttatttaacttatagatattgagcttttagagagtaatgtttcatcaaacataaaaggctgtcaattgtaatatgcaacataaattttatatgtcactaaggaaaaactgcaatgaagcaatgacacagtgctttttttatatcagttgtagggtacggtgaaatatcagagatgttaaaattagggaaaaacgtgtgttttaaaatcagtgaag

SEQ ID NO: 148010 - DNA, 601 bp, Human
tcaagtgatgggtgtgtaagtgcccaactcattctgtcctttataacatagaatattttcatttgtattaaatagtttgaagtaattaattttaaatacccagacatgatcctgtatagcctctgaaaatctgtaaaggtttttctcctttttaaaaaaattgctttggttcatatttggtgcttctgctctttaataggctttgtttctagtaaggtcatgcttatttaacttatagatattgagcttttagagagtaatgtttcatcaaacataaaaggctgtcaattgtaatatgcarcataaattttatatgtcactaaggaaaaactgcaatgaagcaatgacacagtgctttttttatatcagttgtagggtacggtgaaatatcagagatgttaaaattagggaaaaacgtgtgttttaaaatcagtgaagtatggccttgactcttgcttctaattaaactttttatgtgataaatatggtaaggcatagctattgtcttctataaaattctggtaaacccataaagagtagaaagaaggtagaaaggcagaaagtgggatagagtggaaagtgggatgcagtgatgatattt

SEQ ID NO: 148011 - DNA, 601 bp, Human
ttaataggctttgtttctagtaaggtcatgcttatttaacttatagatattgagcttttagagagtaatgtttcatcaaacataaaaggctgtcaattgtaatatgcaacataaattttatatgtcactaaggaaaaactgcaatgaagcaatgacacagtgctttttttatatcagttgtagggtacggtgaaatatcagagatgttaaaattagggaaaaacgtgtgttttaaaatcagtgaagtatggccttgactcttgcttctaattaaactttttatgtgataaatatggtaagrcatagctattgtcttctataaaattctggtaaacccataaagagtagaaagaaggtagaaaggcagaaagtgggatagagtggaaagtgggatgcagtgatgatatttattatataatatttgatataacttcagtctaccagtaggaacctttgttgggtagcaattgcatactcattttcactgggtgttttctgatatttctcttctaggaagctgtgatcttaatttaaccagtcttttgtcggactcttaggatgtttctgtttcttttactgttatgaatgaggttaaaagcat

SEQ ID NO: 148012 - DNA, 601 bp, Human
atataattactataccaaagtgtgtgtgtgtgtaaatatatgtaaaattataatccattttattctttacagaattttacataccgagttttacgtataatgggagctgtataagcgttgacataatgtggtaatagatgaaacaggagctggcagttgaccaattatgtaggaccttgtagtttcccctctactttgtgtttaaatttttgtatgatatttattgttgtataatttaacaaagacatacttgtgtatattacatgtgtagcttgataaattgttcaaaagcaaatacagygttataaagtttacctaagtgaagaaataaaatgtgagcagcatcctagaaaatctcttcctacttcttgcacacactaccctttctttcctcattatcctgacatttactgatattttacatctactactttcactcagcatggtgcttgtgaggttcatctatgttgttttggttgatggtggttctttcattcttgctactgtaaaatacttgttactgcaaaatgtgtaacattttgctcaatgggtataatgtttatacccattgtataaatgtatcatggcatattcatttttt

SEQ ID NO: 148013 - DNA, 601 bp, Human
caccacgcccagctaatttgtgtatttttagtagagacggggtttcacacctgttggccaggatggtctccatctcttgacctcgtcatccacccgcctcggcctcccaaagtgctgggattacaggtgtgagtcaccgtggccgcctgaaccatttttaagggtacagttcagtagcgttgttaagtacatttatttacactattgatgcaaccaatttccagagctctttttatcttgcaaaactgaaactctatacccattaaataacaactccccatctaccccggtaaacactgtkttacagtttcatgaatttaactactctagatatctcatgtaagtggaatcagagcatttgtctttttctgattggcttatttcacttggtgtaattttcttaaggttcatccatgttacggggtgtcagagctttcttcctttttaagactgaataatattccattgtgtgtacatatcacacttcatttatccattcatccattgatgaacattttggttgcttttatcttttggaatatgtgcatttaaaaaaaaatctttgaaaggctcttgagaatatttgtgccaatttccacca

SEQ ID NO: 148014 - DNA, 601 bp, Human
ggtaaacactgtgttacagtttcatgaatttaactactctagatatctcatgtaagtggaatcagagcatttgtctttttctgattggcttatttcacttggtgtaattttcttaaggttcatccatgttacggggtgtcagagctttcttcctttttaagactgaataatattccattgtgtgtacatatcacacttcatttatccattcatccattgatgaacattttggttgcttttatcttttggaatatgtgcatttaaaaaaaaatctttgaaaggctcttgagaatatttgtgycaatttccaccaggaatatatgagtttattcttgacattacaataataatttttaagtctttgctagtttgataaattaaaaagctcctgagaacacatggacacagggaggggaacaacacttactggggcctgtcgggggaaggaggtggcggggaagagcactagggaatagagctaatgcatgctgggcttaatacctaggtgatggattgataggtgcagcagaccaccatggcacatgtttacctgtgtaacaaacctgcacgtcctgcacatgtaccctgggacttaaaaaaa

SEQ ID NO: 148015 - DNA, 601 bp, Human
ggcttatttcacttggtgtaattttcttaaggttcatccatgttacggggtgtcagagctttcttcctttttaagactgaataatattccattgtgtgtacatatcacacttcatttatccattcatccattgatgaacattttggttgcttttatcttttggaatatgtgcatttaaaaaaaaatctttgaaaggctcttgagaatatttgtgccaatttccaccaggaatatatgagtttattcttgacattacaataataatttttaagtctttgctagtttgataaattaaaaagcycctgagaacacatggacacagggaggggaacaacacttactggggcctgtcgggggaaggaggtggcggggaagagcactagggaatagagctaatgcatgctgggcttaatacctaggtgatggattgataggtgcagcagaccaccatggcacatgtttacctgtgtaacaaacctgcacgtcctgcacatgtaccctgggacttaaaaaaaataaaaaagaaaaagctcttagttttaaattcttgcattttaaatcgtgaggttgaatgctgttttatgtcactcagctatttaca

SEQ ID NO: 148016 - DNA, 601 bp, Human
ttggttgcttttatcttttggaatatgtgcatttaaaaaaaaatctttgaaaggctcttgagaatatttgtgccaatttccaccaggaatatatgagtttattcttgacattacaataataatttttaagtctttgctagtttgataaattaaaaagctcctgagaacacatggacacagggaggggaacaacacttactggggcctgtcgggggaaggaggtggcggggaagagcactagggaatagagctaatgcatgctgggcttaatacctaggtgatggattgataggtgcagcaraccaccatggcacatgtttacctgtgtaacaaacctgcacgtcctgcacatgtaccctgggacttaaaaaaaataaaaaagaaaaagctcttagttttaaattcttgcattttaaatcgtgaggttgaatgctgttttatgtcactcagctatttacatttctccctattgtgttttaaaaattattcatgtatcctcttgactgtactacttgagagtagtaactattatcataggtattccatttatccccgaagtgcctggtactatatgtaccacatgagatgcccaggatgtttg

SEQ ID NO: 148017 - DNA, 601 bp, Human
taggtgatggattgataggtgcagcagaccaccatggcacatgtttacctgtgtaacaaacctgcacgtcctgcacatgtaccctgggacttaaaaaaaataaaaaagaaaaagctcttagttttaaattcttgcattttaaatcgtgaggttgaatgctgttttatgtcactcagctatttacatttctccctattgtgttttaaaaattattcatgtatcctcttgactgtactacttgagagtagtaactattatcataggtattccatttatccccgaagtgcctggtactatatgyaccacatgagatgcccaggatgtttggtaaataaatcagtaactttctttgttgatgtgttagaacctcataaaattgtatgcttatcatattttttggtttgttacaacttttttaaaagtatttcttaaatagttacataataaataatctcaagtaatatttgttagaaattatccaattatccctattttaggctaataaaagtgtttatttttaataaacatttcttggttcaaaactataggtatatgttttgtttctttcaaatgttttttaaaagttcacttaaaaatcatg

SEQ ID NO: 148018 - DNA, 601 bp, Human
ccgaagtgcctggtactatatgtaccacatgagatgcccaggatgtttggtaaataaatcagtaactttctttgttgatgtgttagaacctcataaaattgtatgcttatcatattttttggtttgttacaacttttttaaaagtatttcttaaatagttacataataaataatctcaagtaatatttgttagaaattatccaattatccctattttaggctaataaaagtgtttatttttaataaacatttcttggttcaaaactataggtatatgttttgtttctttcaaatgttttttaaaagttcacttaaaaatcatgttattccattaaattttgttttcctacttagtccaagtttattgcacaattgcctactctttatttttgtttaatcggagcagataagcttgactgtgactaaacctaggttgagaatcattactaatcactttgctatatttactatgactaacccctgttaaatactcaaacactaatagtttatttaagaagtttaaagaagaatttatcctgctacatgcagatgtctgatagaacctacttgtaggttgcaattttatgcaatttttgtattc

SEQ ID NO: 148019 - DNA, 601 bp, Human
tcaaatgacattcattgtcctaataggcccatgagagggaagtctaatgaagaatttgaaagtaaaatgcttttaaggaaagtttctctggtagagtaaacccaaataactcctttaatgcagaggttcctaaacaggcattgaagttatcaacctccatgcaggtaaattgataaaatgagtatggtgactttttttctataaagttaaattaatttttcaggattctgttttttgggaaacagcggagacagtagattttaggtattttcagtgtctgagtgaaatggtggcagtctcrtattggttgcctttcaacccccctcccttcttcacacacttaattttaggtatgtcttgaacaaaaataaataatttagaaactgtttctttatacttaattatctgaaaaagtaggatgtcagaagtaagtgagggaaaatacttctggaaatgccagaaaccgtcatgaaagttcaacgccagaactgagcttttattttgcaaaagaagcccttagaggtttacttggctctttgaatatctgagtcttgtttaacagagaaccaaaggaggagtatgtgtgtattgaggaacagtt

SEQ ID NO: 148020 - DNA, 601 bp, Human
attatctgaaaaagtaggatgtcagaagtaagtgagggaaaatacttctggaaatgccagaaaccgtcatgaaagttcaacgccagaactgagcttttattttgcaaaagaagcccttagaggtttacttggctctttgaatatctgagtcttgtttaacagagaaccaaaggaggagtatgtgtgtattgaggaacagttactaaaaagggagagcagttagccagactgggtgaatgaaatagtaaagcttaactgtactgactagttaagtcagtagtagctcactgctgcagtccaycctacccatctggtttattcctttcctgacagactcattcatatgttaagtgctggctgtgtatcaggcagtgctagtgctggggcatggggccccagcagtgaatgaaattggtatggtctctgcctagtgactgagtcctttaagaaccttgattaggctcagagagctttttgagttggcaatctccccaccctcagatttagctgaaattagggtggccacgcatttcgagtccacatttgtgaagaggccttaacttgcctccctacaccaatttgccactcagcaatagctaag

SEQ ID NO: 148021 - DNA, 601 bp, Human
tagaggtttacttggctctttgaatatctgagtcttgtttaacagagaaccaaaggaggagtatgtgtgtattgaggaacagttactaaaaagggagagcagttagccagactgggtgaatgaaatagtaaagcttaactgtactgactagttaagtcagtagtagctcactgctgcagtccatcctacccatctggtttattcctttcctgacagactcattcatatgttaagtgctggctgtgtatcaggcagtgctagtgctggggcatggggccccagcagtgaatgaaattggtayggtctctgcctagtgactgagtcctttaagaaccttgattaggctcagagagctttttgagttggcaatctccccaccctcagatttagctgaaattagggtggccacgcatttcgagtccacatttgtgaagaggccttaacttgcctccctacaccaatttgccactcagcaatagctaagtgtgaggctgctttaagcttgaaatccaggcccaatagtcctgctgaaccccttgcctctgagaatttagagtcttaattcactgaacatcttcctagttgttgaacattctgtgtt

SEQ ID NO: 148022 - DNA, 601 bp, Human
caaaggaggagtatgtgtgtattgaggaacagttactaaaaagggagagcagttagccagactgggtgaatgaaatagtaaagcttaactgtactgactagttaagtcagtagtagctcactgctgcagtccatcctacccatctggtttattcctttcctgacagactcattcatatgttaagtgctggctgtgtatcaggcagtgctagtgctggggcatggggccccagcagtgaatgaaattggtatggtctctgcctagtgactgagtcctttaagaaccttgattaggctcagasagctttttgagttggcaatctccccaccctcagatttagctgaaattagggtggccacgcatttcgagtccacatttgtgaagaggccttaacttgcctccctacaccaatttgccactcagcaatagctaagtgtgaggctgctttaagcttgaaatccaggcccaatagtcctgctgaaccccttgcctctgagaatttagagtcttaattcactgaacatcttcctagttgttgaacattctgtgttctttctcagctccattcctttgtatgggtcggttcctatgcgtcagttgc

SEQ ID NO: 148023 - DNA, 601 bp, Human
gctgctttaagcttgaaatccaggcccaatagtcctgctgaaccccttgcctctgagaatttagagtcttaattcactgaacatcttcctagttgttgaacattctgtgttctttctcagctccattcctttgtatgggtcggttcctatgcgtcagttgccctttcctctcttttcttttggaatcatttcaagtggtgtttctcttgggaatattcccgtactccccagccagataatctttttattatataaatcataatataaagcatgccctgccttcagagaatttataagctarttggaaaagatgtaaggtaatagaaattataattcatggtctggtgcagaactgtaataaatttacatctataatctacctatatgctatcatataagtggcataacttgttgctttatataattattacaacgaacttataaaatacatatgcattttcagataagggaggtgagcctttaagagacgtattagtgcagaataccgggaatctggtctcaaatccatatttgttactctattttatatgttgtttccttagacatacatgagaaaagacgttgtgaaagatttaaatag

SEQ ID NO: 148024 - DNA, 601 bp, Human
cataccatagagctggaagttactaccagtttcttcttctagacaacactgcagtgaacctctcggtacataccacaagcttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttrggtggcgggacagttttcatgtttcattgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttct

SEQ ID NO: 148025 - DNA, 601 bp, Human
agtttcttcttctagacaacactgcagtgaacctctcggtacataccacaagcttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttgggtggcgggacagttttcatgtttcaytgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggca

SEQ ID NO: 148026 - DNA, 601 bp, Human
caagcttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttgggtggcgggacagttttcatgtttcattgctatataaatttgttttgtgaattgtcttttcattttgtttgctcrttttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggcaagcccaaaagtgaggtttagcccatgagggttcttggctttgcccagg

SEQ ID NO: 148027 - DNA, 601 bp, Human
ttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttgggtggcgggacagttttcatgtttcattgctatataaatttgttttgtgaattgtcttttcattttgtttgctcattttsttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggcaagcccaaaagtgaggtttagcccatgagggttcttggctttgcccaggaaaga

SEQ ID NO: 148028 - DNA, 601 bp, Human
attgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggyaagcccaaaagtgaggtttagcccatgagggttcttggctttgcccaggaaagaattcaggggcacactagaggtagaagaaaacagctttattgaagaggcaacgttacatctctagtggtgttaagctccgtggctgctgctgcagggcagggctgccccgtaggccaagagtagcagctcagggcagttctgcagtcatatttatacctgttttcaattacatgtaaattaaggggcagtttatgcagaaatttctagggaaggggtagtaactgctgggtcattgccgtggaaagg

SEQ ID NO: 148029 - DNA, 601 bp, Human
ttgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggcragcccaaaagtgaggtttagcccatgagggttcttggctttgcccaggaaagaattcaggggcacactagaggtagaagaaaacagctttattgaagaggcaacgttacatctctagtggtgttaagctccgtggctgctgctgcagggcagggctgccccgtaggccaagagtagcagctcagggcagttctgcagtcatatttatacctgttttcaattacatgtaaattaaggggcagtttatgcagaaatttctagggaaggggtagtaactgctgggtcattgccgtggaaaggg

SEQ ID NO: 148030 - DNA, 601 bp, Human
caagcccaaaagtgaggtttagcccatgagggttcttggctttgcccaggaaagaattcaggggcacactagaggtagaagaaaacagctttattgaagaggcaacgttacatctctagtggtgttaagctccgtggctgctgctgcagggcagggctgccccgtaggccaagagtagcagctcagggcagttctgcagtcatatttatacctgttttcaattacatgtaaattaaggggcagtttatgcagaaatttctagggaaggggtagtaactgctgggtcattgccgtggaaagrggcagtaactcctgggtgttgtcatgtcagtggtaaactgattggcacactggtgggcgtgtcttatggaaagcagattctgccccatcactgttttagctagtcctcagtttggtctggtgtctgaaccctgcctctggagtccagtcccgccttcattgtaaactctaaaagagcttataatgtaggttttatgtattttgtatatcacatagtaggcactgaataattgactggtggtggaatgaattgtcattaacatgacttttgtaataaccttgctggttcttggcacctctt

SEQ ID NO: 148031 - DNA, 601 bp, Human
acaagtgagatagtccctttttttatatgaggatgctgaaatcctgtactaaccttaaagcacatatatttgaattctggactaccaaaaaacattgtgtctctaggatatcagaaagtgttctcattggaattggaattcacatggagaggaagagaactataacagtagggctcttgcctttacttatattttagatagctttgttgagatacaattcatatgtcatccacccatttaaagtgtccaaatcaatggttttagtatattcacagatatatgcaaccattaccacagtcaattttcaaacattttaatcaccttgaaaagaaaccctgcaccatgtagccattaccaaccccctgcccggtccccaaccctcccactgctgagtaactgctaatttactttctgtctctgtatattttcctattctgaacattttatataaattggatcatataatatgtgggtttttttgtgactggcttctttcacttagcgtaagattttcaagttttgtcatagtataaattatagtgcattcatttatatggtgtcaacagtattctctttaatgtgtatctttgtccatttgtat

SEQ ID NO: 148032 - DNA, 601 bp, Human
atttactttctgtctctgtatattttcctattctgaacattttatataaattggatcatataatatgtgggtttttttgtgactggcttctttcacttagcgtaagattttcaagttttgtcatagtataaattatagtgcattcatttatatggtgtcaacagtattctctttaatgtgtatctttgtccatttgtattgctgtaaacttttgccagggacatggatggagctggaggccattatcctcagcaaactaacacaggaacggaaaaccaaacaccacattttcaatgagagytgaacaatgagaacacatggacacatgggggggaaacagcacacactggggcctgttgatggtggggggagggagagcatcagaaagaacagctcattgatgctggacttactacctaggtgatgggtcgatctgtgcagcaaaccaccatggcacacgtttacctatgtaataaacctgcacatcctgcacacgtatcctggaacttaaaatgaaagttgaagtggccaccatcaccaccaccaccaacagaagaatactcgaggctgggtaatttataaagaaaagaggtttacttag

SEQ ID NO: 148033 - DNA, 601 bp, Human
catggacacatgggggggaaacagcacacactggggcctgttgatggtggggggagggagagcatcagaaagaacagctcattgatgctggacttactacctaggtgatgggtcgatctgtgcagcaaaccaccatggcacacgtttacctatgtaataaacctgcacatcctgcacacgtatcctggaacttaaaatgaaagttgaagtggccaccatcaccaccaccaccaacagaagaatactcgaggctgggtaatttataaagaaaagaggtttacttagatcacggttcgtcagsctgtacaagaagcatggtgtcaacatctgcttccggtgagggcctcaggaagcttccactcaaggtagaaggagaaggggagccagcgtgtgcagatcatgtggcacggaggaagcaagaggtggtgcggggcggggggaaggtgccaggctcgttttaacaaccagctcctagggtagcgcttgctagcactcatagagagaattcactcattactatgaggctggcaccaagtcattcatcaggggtctgcctccatgacaccagactcctcccattagtacccacctccaacattgg

SEQ ID NO: 148034 - DNA, 601 bp, Human
aatgaggtgatttttgcctttttatgtaaagtaaacataaacatatacatatttttgaacaaaatttcctttctcctttgcttcctaaagacactgctgtgtgatcctattatataatacttagctacatcatgtaatcagtcactttgaaggttgaaggtcaagtactggttttcccaaatgtgtgatgaagctgattgtgcgttatgttattataaccctaaaaatacacagaacagtttttttagattaaaaaatataaatatgctgggttttagtgattacaataaactcttcttaygctatttggaatagacttgagtatagagtgactgtttcagatattagacagcaggctgtacatgatagtaatccctgaggcaagggaaacaaataaggccaggcttttgattaccctggcttttgcctggaaacctattccagactgtgttgcggggaagaataccaggcaaagcagagtgaacttgctgagtggaggaagcagattggagtttgaggaggctgaggcagttggaagttgaggttggagttctggagaggaaggagtgatctagaaaaagagctccagaaaatttatata

SEQ ID NO: 148035 - DNA, 601 bp, Human
gctgtgagctgtgaaaagtttgcagagcccacacagggctgggaggcacttgagtaccagttggttgaagtggaaagtctttgttgcgttggacatttgggacattcagtaaagacttggaaggatcacagcttagtagtgaggttaggctgtttctagaggaaaagcttctatggaattgactttaaccaagcttgaaaacaaatcttaaaaggataaaaaggaatttgagataatttaatagcctacaaaaaaaccctcaaagtttaatcctctttaaaggaagacagtaaaatccagrtaacaacaacagaaaatgtataatatccaacatctaatcaaaatatgtcaataagcaagaaaatatgacctataaccaggagaaaaattagtcaatagtaacaatcctagaagtgtaacagatgatggaagtaccaggagttgctaaaatagtatgattataattaggctcaagtatttaaatgaaaacatgaatattagagaaaaaagatgtaaaaaagatccaaatggaacttctgaaaatgaaaaatacgttacgtgaaatgatagatatgctgggtgggatatcaacagattagac

SEQ ID NO: 148036 - DNA, 601 bp, Human
ttggttgaagtggaaagtctttgttgcgttggacatttgggacattcagtaaagacttggaaggatcacagcttagtagtgaggttaggctgtttctagaggaaaagcttctatggaattgactttaaccaagcttgaaaacaaatcttaaaaggataaaaaggaatttgagataatttaatagcctacaaaaaaaccctcaaagtttaatcctctttaaaggaagacagtaaaatccaggtaacaacaacagaaaatgtataatatccaacatctaatcaaaatatgtcaataagcaagraaatatgacctataaccaggagaaaaattagtcaatagtaacaatcctagaagtgtaacagatgatggaagtaccaggagttgctaaaatagtatgattataattaggctcaagtatttaaatgaaaacatgaatattagagaaaaaagatgtaaaaaagatccaaatggaacttctgaaaatgaaaaatacgttacgtgaaatgatagatatgctgggtgggatatcaacagattagacactgcagaaaaacatcagtgaatttagggatatagcagtagaaactatgcaaaatgcaat

SEQ ID NO: 148037 - DNA, 601 bp, Human
aaccctgtcactggaagatcactgcttaaatctcttgttcctctatagtttttacctttgttgcctgtcttaaaaatagttttgttcttgtagtggtttttttccttctacttttacatctctggtgttacattttggaaacattcttcctttctctcatttaccacagtttcttccatgtttgcttaacatctctttctttctatttttgagacggagtctctctcgcccaggctggagtgcagtggcgcgagctcagctcactgcaacctccgcctcccagttcaagcaattctcctgygtcagtctcccgagtagctggaattacaggcgtgtgctaccacacccagctaatttttgtatttttctagtagagacagggtttcaccatgttggcttggccggtcttgaactcctgacctcaagtgatccacccgcattggccttccttagtgttgggattacaggcgtgagctgtggaccacgcccagcctttctttcagaaggcttttttattgtgtttagtcgtaaccttgattatgaaccatttaaggagttttctaattattcttattaactgttactagataaaatgttaatt

SEQ ID NO: 148038 - DNA, 601 bp, Human
taattcataagtatacttgaaatacacttgtgtatgtaattctgtgctaactctccagttctctgtagattgaaagctccatgagggcaggaacagtaatgtgttttttcctctactcctagcacacctcttgtctggtggggtcattgttgaatgaaataaagacatgactgtgatttcccttgaggtgctaatagtgtaatttgacacacaatgtggtatgaaacagataatgtgtattttcacctgtaagtaaatcaatcaaattattagaataaagacccaagaaaacaaaaaaaaacaaaagtgaataaaagaaaatggtgtacatttaacacatttatatcttctttgtctcatcccttatagaatcctgttttcaatgaaaaagaaaaaagaagagttgttgttaattcaaaattaccgttccctagtttgaaaggctgttttctatttcaacacacgcacaccggcacacacccaggctcatgtgaaaggaacggagactcaagcctgatctgatgaggctgtgttagaagtgctgcacattgaccttcctggaacgcagagtgtaatccctgcatttggtacggaagataaa

SEQ ID NO: 148039 - DNA, 601 bp, Human
ggctcatgtgaaaggaacggagactcaagcctgatctgatgaggctgtgttagaagtgctgcacattgaccttcctggaacgcagagtgtaatccctgcatttggtacggaagataaatagctatctgaaggagacgatttcagttagaccttttatttgacatatacagataaataaaccaggcagaatccccactttttctctcatttaacttgtagccaagctaggtctccctggagctgaatttagatgcagtatcttatccagagtaatacctttatttatagctgaggaaatttrggatggttaaaaagcttcaccaaagatgtgagtcctagagcggaccagagaactggctctctgaactgccagtccatactttctcctggtctctctctcatgctatgctctctctccacctggagggactttgtcccacaggagaagtgatccttatcagtgtgagctacaagtgaatggtctgctgaagatgggagggccttgggccttagagttagatcaggactccagttatggcccagacacttgcaagatgagccatccttttccctactctggggcccaggaattatgctagta

SEQ ID NO: 148040 - DNA, 601 bp, Human
tatagctgaggaaatttaggatggttaaaaagcttcaccaaagatgtgagtcctagagcggaccagagaactggctctctgaactgccagtccatactttctcctggtctctctctcatgctatgctctctctccacctggagggactttgtcccacaggagaagtgatccttatcagtgtgagctacaagtgaatggtctgctgaagatgggagggccttgggccttagagttagatcaggactccagttatggcccagacacttgcaagatgagccatccttttccctactctggggcycaggaattatgctagtacctgtaggaatccttgggtacctcgcatgtaacagagcacctcccatcatcaataagaattgacctcctgtgcaaaggatccttccctaaaatggttctataaggttctggtaaagatgaaatgagactgtatgatatcgagcatagtacttaccaagcatggtaagtactccgtgcctaacggtagcaattatactgttacagtgaaaattcttcataacttaatgggtaacaaattacagagctgattgaaaacataaacaagtataaatgttttattccc

SEQ ID NO: 148041 - DNA, 601 bp, Human
aagatgagccatccttttccctactctggggcccaggaattatgctagtacctgtaggaatccttgggtacctcgcatgtaacagagcacctcccatcatcaataagaattgacctcctgtgcaaaggatccttccctaaaatggttctataaggttctggtaaagatgaaatgagactgtatgatatcgagcatagtacttaccaagcatggtaagtactccgtgcctaacggtagcaattatactgttacagtgaaaattcttcataacttaatgggtaacaaattacagagctgattsaaaacataaacaagtataaatgttttattcccatttaacataattttattgttttttgaccattgtcttaattttgagtcttcgttcatctgtctttttccagctttatatgaaaaggtagcactggagtttaactagtacagagtttttcaatcttccaccatctgtgtaacaccttataatttttgctgtatccttgtaccacctatcctattattttcctttttttaaaatttattctctttttaggcagtctattttagaaggaaactttatcatgatagtaaacatggaaaacct

SEQ ID NO: 148042 - DNA, 601 bp, Human
gtttaactagtacagagtttttcaatcttccaccatctgtgtaacaccttataatttttgctgtatccttgtaccacctatcctattattttcctttttttaaaatttattctctttttaggcagtctattttagaaggaaactttatcatgatagtaaacatggaaaacctaaataattttgccataaatagaaaataattgtaacaataaatgactgtaagcacattatacatgtgcctccagaagtcttttaaataccacattatgaaaaacattgcatgtggtcttccatcatgctracctaaagccgttaatcagtatgtttaggttatgcttcttcactcagcctcctggaggaggaatgctaacttctccatgaggatggaagagcagaatttgccgttaaaataggaagaaaagacatgatttatggcagttgatcagactctgtttatggcactggtgcatggatcagatgctgctatgatgattgttacaataaatatttccaagccctgtttcagactctctggtcagaatttcttgtggaagatactgaaatctgtatttttaacaggaaggtcaaaaattctgatgca

SEQ ID NO: 148043 - DNA, 601 bp, Human
tctgcctcctagagtgttgggattatagatgcgagccgccacacccagcccctagagtagttttagatttagagacagttgcaaagatagtacatagaattcccctataccctatgctcagtttccccttttattaaattttatataacttcatatatttgtcacgactaatgaaccaatattgacactttgttgttaactaaactcagaactttattcagatttcatttgttttccccacatgttctttttctgttcccagatcccatccagggaccacattagttgtgtctccttagcstcgttggctgttaacagtttctcacactttgtttttgatgactttgacagttttgagaagtaatgattaggtattctgtagaaagtcccgcaacttgggtttgtcaggtgtttttgtcttagtttgaggttacgggtttttaggaggaataccacagagattaagtgaccttgtcatcatatcatatcaggggcacgtgctgtcaacatggcttaccactgatatgttaagcttgatcgcctgtttgttgtcaggttaccccattgcaatgttacttttttttccacctttctgtcacca

SEQ ID NO: 148044 - DNA, 601 bp, Human
cagaactttattcagatttcatttgttttccccacatgttctttttctgttcccagatcccatccagggaccacattagttgtgtctccttagcctcgttggctgttaacagtttctcacactttgtttttgatgactttgacagttttgagaagtaatgattaggtattctgtagaaagtcccgcaacttgggtttgtcaggtgtttttgtcttagtttgaggttacgggtttttaggaggaataccacagagattaagtgaccttgtcatcatatcatatcaggggcacgtgctgtcarcatggcttaccactgatatgttaagcttgatcgcctgtttgttgtcaggttaccccattgcaatgttacttttttttccacctttctgtcaccaaagtgtagcccacgcttaaggggtggagagttcaactccacctccttgagaggaaagtatgtaaattatttggatttttattttctgtacaggagatacgtatgtatgtatgtatgtacctgcctgtctgtcagactgtctgcctatctgtccatccatccatccacccacccacccagccatccatccatccatccacccatcca

SEQ ID NO: 148045 - DNA, 601 bp, Human
atgttcttatttgcgagaagagtgggtagaagatcgtaattcattcttgagtgaattaacctttaattaaagttttaaacgtttttcttgtttctctgtaaactcttttatgttttgtctttggcataagcccctttgtttgtttttcctcccagctttgacagttttttatcttccaaattttcctgtcttagacctatggttctctttagttaagcctaaaacaactgtttgaatgaatcatgatgtttattttttgttgctttcccttgaatagtttttggttggcatttcatggtaraatgtacccacagtgacactgacatgtaataatttttttcttgtgtttcagggacatgctcccacctgtgctccctgctgcactgctgtgtggtcaggcccaatctaagaaggaaggctttgcttttttttttgagatggagtcttgctctgtggcccaggctggagtgcagtggcgcgatctcggctcactgcaagctctgcctcctgggttcatgccattctcctgcctcagcctcccgagtagctgggactacaggtgcccgccaccacgcgcagctaatttttttttttgtatgtt

SEQ ID NO: 148046 - DNA, 601 bp, Human
aattttcctgtcttagacctatggttctctttagttaagcctaaaacaactgtttgaatgaatcatgatgtttattttttgttgctttcccttgaatagtttttggttggcatttcatggtagaatgtacccacagtgacactgacatgtaataatttttttcttgtgtttcagggacatgctcccacctgtgctccctgctgcactgctgtgtggtcaggcccaatctaagaaggaaggctttgcttttttttttgagatggagtcttgctctgtggcccaggctggagtgcagtggcgygatctcggctcactgcaagctctgcctcctgggttcatgccattctcctgcctcagcctcccgagtagctgggactacaggtgcccgccaccacgcgcagctaatttttttttttgtatgtttagtaaagacggggtttcaccatgttagccaggatggtcttgatctcctgacctcgtgatctgccctccttggcctcccaaagtgctgggattacaggcatgagccaccgtgcccggtcagaaggaaggcttttcttacagttttgattttcttctcactatcctatacacatatgat

SEQ ID NO: 148047 - DNA, 601 bp, Human
aaataaaaaccatttattagctgtcatggtattgagtggtttttctgctacttacggtgttggctgcagagcagggacaaatggagatccaaaatagcctcactcatagggttagcaagttaagttggtgctggctgtcagctgggagctccccaagtttgggctagctagcttctccttcatgcacttctccacctaagttgggctccttacctggtggctagctttcccagcagtacacaggtggccttcttaaggtttaggcccgggactggtccagtgtcatttttgctacattgcwtgggttaaagcagtcacaaagtcattccacattcaagcgtagatatgcaggtttgtgaccatgaggaggccggtttcatcagggacccccaaagtaacagctgccacagtatattttttttgtctgcatgtttcattgttaatgtttttgtatgtatgtttaattaactgtccaagcacaagttccagtggcattggataagacttctaaattaaagtgtttacaagaaaacaataatttgattaaaacttgtattcttactagtaagtgtgggggcgtagggatttcattattggcaaa

SEQ ID NO: 148048 - DNA, 601 bp, Human
tttaattaactgtccaagcacaagttccagtggcattggataagacttctaaattaaagtgtttacaagaaaacaataatttgattaaaacttgtattcttactagtaagtgtgggggcgtagggatttcattattggcaaaaatcaacaatccttcattcttgtagcctttaaaaaatatattttaaaaatagtgaaatgttattgtattttaaaaggatttggataatgattaaatccaaagtatagaagataaacttacttgatttgtttattcaatcagcaagtagttttgaacacrtaatctgcaccagccactgttctagacaccggagaagcagtggtaaggatgacaggctcctgctcttcagtaattgttggggagatagcttcttattcatttccataggaaatctttttttttttaaatctacatttgttttaaaaagatgaattttcattaaaaaacaagtctaaatgtctatcttgaaaaataagcaagattagttaggtttgtaaagaccctatgctctgaaacagtgcaaaagttagatagtacatgttggataagctcgaggtttgaccgttcacctggaggtga

SEQ ID NO: 148049 - DNA, 601 bp, Human
atttatttcgaaggatgtcgctaaatgaagtgttttgggtttttttggcgggggtggtgttggggggcaggggtggcttttgcagaaccacagatgttttcagactcatctaatccgacttcatcattttacagatagctatttcaggcaccattgtggtttacctaatatgtcagagcagaactatttaaccctaagtaacttgaatttttgttttgttttcttttcacacatttttcctctaaaacctacaccaaactcccttgggttgagttcaagacatactttgcctagaccagaytgtagtgtaataatagtactttagcagggttttatggtaaaagagtgaaatgttttacgtgactgtcagaagtttagtaccagaaagacatttcacatttgcatgttattaaacacaagtaagacaaatgtttcagggcagctgatgtagaccttgtactactttgctcatcccaaatcattggtatacatgtaaacattctgaactggtcggctgaccacattagctcatctcacatgaacgattacaaaatgaggttttggatgcttacggttagttaattgaaatgatgcaagttct

SEQ ID NO: 148050 - DNA, 601 bp, Human
agtactttagcagggttttatggtaaaagagtgaaatgttttacgtgactgtcagaagtttagtaccagaaagacatttcacatttgcatgttattaaacacaagtaagacaaatgtttcagggcagctgatgtagaccttgtactactttgctcatcccaaatcattggtatacatgtaaacattctgaactggtcggctgaccacattagctcatctcacatgaacgattacaaaatgaggttttggatgcttacggttagttaattgaaatgatgcaagttcttttgaacttaccactagtatttttctggattttgtgtataagtgttttgtttgtttgtttgtttgttttaaagaaaaaagaataaaactttgcttgatttctttccctcctattaatatgttacttctaagctaaggccctcaaactaagttttctctggctgcttttaatattcttctcttcgtcattggttttcagcaatttggttatgatgtacataacaacagactgggagttttctttatagttctttagctcagagtttgttggatctgcgagcttatggttttctccagatttgaaaaattttcagcc

SEQ ID NO: 148051 - DNA, 601 bp, Human
atttttccatgtgtagagaaataatttgtctacagttggaggttagcacaacacaaatattcttctgggtccccaatgtaaagtcttcataaaagttagcctttttattatatgtactttcttagaccctctttatctgctaaagcacaggactcaattcccatggcatgtagatcccacaaaggtacttctttatttatttttaaaaaatcagctgtgcttgtctttttagatcgtgacgctcctcaggtcggggggcttgatatttggatcactgaggtttgatattatcagtccctcytcacaacaattctcctccactttcactctgcattgcattaattcatcatccacacagtactgctagatactagcaaaacagaccattttatatttttcgtagccctttatttccattactttaattttaaaaacacctttacaactgaatttcctgaaatggttagaatgtagacctttaaaattccagattattagtcttaatagtcttagaaagattcaataatggatgcttcacccaccaggacggctgagacatggccttagcttctgagttcacattcctcctcaccacaaagga

SEQ ID NO: 148052 - DNA, 601 bp, Human
taaataatgtagtttaaggaaataggtgcatttaaaacgtatttctaaatttgcacatggtttgaagttagctttcagggcatttaactcgcatgtcttgtgtgtacacatatgtttaggagcacatgtgtactctcataaagtatttagagtggtctttaaaatgcagttattaaaaaatcagtttttgacctattagggatcttttgtagatttcagtactgtaaatttttataattctgcaatatttttatttttcaaaaggtaatttattttctgcagttttgtcaatctaattcartaataatgggatcatacattgtagagtagcttttctgtttcccttatgactttgaaatagctttgattttatatcaagatatgaattgccaggaagaaatggattatatactggatataatttggagttatgtttataaaatataaagcatatttatataaatataaagcatattttataaatgttcagaaagaggtagactgtgatggtacatatttggaaagaatttcatgattgattccttctgtttcactttttaagaattgtatttgctctcaatttgtatcattaaattttatt

SEQ ID NO: 148053 - DNA, 601 bp, Human
atagctttgattttatatcaagatatgaattgccaggaagaaatggattatatactggatataatttggagttatgtttataaaatataaagcatatttatataaatataaagcatattttataaatgttcagaaagaggtagactgtgatggtacatatttggaaagaatttcatgattgattccttctgtttcactttttaagaattgtatttgctctcaatttgtatcattaaattttattttgttagctttgagaaattgaactttgtcaaaatagtgatattatttgagaagttgrccagggatagagaattggcaggcagtgtttttagagaacaaattaatgagaaattgcattttgaaggtgaaaagaaacaattttgtttttcctcttttacatcatccttctcccctgcaccttgcttgagttctgcactgtggtttttttcttcccaattttttattgtgttaaaatacacataagataaaatttaatgttttaatcattttcaagtggttcagtggtattaaatacatacataatgtctgcactgtaatttttatcagacaacttaggaaatggacctgccatactttc

SEQ ID NO: 148054 - DNA, 601 bp, Human
tcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgagtcttgtacttgaaaagaggtgtacatgagagggtatggcacttgattgattctttcaacaataaagttagcaatttcttttatttttaatttgattttaatgctcctgtaaagttcaattttttttttgaattattaccattagtattaataaaattgacacatagttttccagagatagaaacgtttgtcctgagtaatggttaaagccagcaatgcacgggcatttgaagaagtgaaagagggcaaatgtttcccagtgtactaatacaagatggcaactggttacatgggatagatggccttctattctttcagtctcttaggctgaagtttctagatttcctctgcccagaagtggtgtattggggatttgaggagagacagagccaggctgtcttcccctggattccctctgctctctgctg

SEQ ID NO: 148055 - DNA, 601 bp, Human
tctgtgttcattcttcctctttgttctgcttcctctttctgtagatttcttccatatattgagctttgatggctgttagtggcatcttcactttgcattcccatcagagcccttcctcaagagagcaggagggcaagagaagtgggttttgttgtgttgatttgcttgagtgagatgctatacaagggaagttcccaagcaggaaagagtctttcccacaaatgatttttccacataagatacttcttataaaatttgatttgctgtaattttttaacctgtggcctgtacttaccccttyggaaatttcccactgcaatttgtcatcttgaaaatcatttattgtacattttctcaaagaaatttctcaaatgactatagaagtttcttatctatggtaggaatcagtgaagtagcatctactgaatcaacattagttaataaatatttgcttcgtgttagtaaagtaagaagatgccggtagtacacttgctttttcttgttgattcatactattttagaacatgagttgagaacacaatttccccattttatagattgagaaactgaggcccagggcttcagagcaaatctttttaag

SEQ ID NO: 148056 - DNA, 601 bp, Human
ggtaggaatcagtgaagtagcatctactgaatcaacattagttaataaatatttgcttcgtgttagtaaagtaagaagatgccggtagtacacttgctttttcttgttgattcatactattttagaacatgagttgagaacacaatttccccattttatagattgagaaactgaggcccagggcttcagagcaaatctttttaagtccagaaggcttgagatagtgtcaggactatttgtaccactagttctcctggtactctatttggactttttcctagtacaagcaacagtgtttacrcttatccgaaggcaatatttgagttgactttatggtctttcactaatcagtgagacagccagtcactagatgtttgttgaggttctgttgtcctgctggtctgtgcgagagatagagggaaaggaaaggattggcccttttcttccacaatttttaaaattgtttattttatgaaattatagaattttagagccagaaggagcctcagagatcatttgctcaagttcttgccgtttttcagatgaagaagctaatgctcacagaccctttgatttatagctatctgatagcagacccagg

SEQ ID NO: 148057 - DNA, 601 bp, Human
gaatttatttgttctcagactattgcagcacagcatggtggacaaaagcagaatcttggttgcttgatcacccggactccagtcctggttccgctatcttctgcgtatgcagcctccatatctcgtttctctatctgtaaaatcatctgccttatagtgttgttaggattatgtattcagtattagttatcatcattattattgtaaactcaggatttcttttattttttctgagacggagtttcactcttgttgcccaggctggagtgcagtggcgcgatctcagctcactgcaacctcygcctcctgggttcaagcaattctcctgcctcaccctcccgagtagctaggactacaggcatgcgccaccatgcccgactaattttgtatttttggtagagacgatgtttcgctatgttggccaggctggtctcgaactgctgacctcaggtgatccacctgcctcagtctcccaaagtgctgggattataggcacgagcaaccatgaccggttgtaaagtcaggatttcttcccaacacttactactttttttcttgacttaaatcttaaagcaaaattaaataattacattgttgacat

SEQ ID NO: 148058 - DNA, 601 bp, Human
gtagagacgatgtttcgctatgttggccaggctggtctcgaactgctgacctcaggtgatccacctgcctcagtctcccaaagtgctgggattataggcacgagcaaccatgaccggttgtaaagtcaggatttcttcccaacacttactactttttttcttgacttaaatcttaaagcaaaattaaataattacattgttgacatatccttattaaatggtgtgcccatttttaggaccctgagtcttagattaaatgattgtctcaagtcgtgtagctactgttcctgcttctgtcctrcctggactacacatttccttgtatgtcttcctagtccttcgctttatctcactacataatgctgctagtacattttttttgttactgttgctgttgcctgtctttccttccttccatccttcctttcatcctcttcctttcttttctttcttctgcctttctcacgctttctctcctcacttccttttttcctttcctccctctgttctttccttatttctcctccattctttccattgaatcagcatttgagtgactccataggcatgtgctcttttggaagatgaataagacctagtt

SEQ ID NO: 148059 - DNA, 601 bp, Human
tcccaacacttactactttttttcttgacttaaatcttaaagcaaaattaaataattacattgttgacatatccttattaaatggtgtgcccatttttaggaccctgagtcttagattaaatgattgtctcaagtcgtgtagctactgttcctgcttctgtcctgcctggactacacatttccttgtatgtcttcctagtccttcgctttatctcactacataatgctgctagtacattttttttgttactgttgctgttgcctgtctttccttccttccatccttcctttcatcctcttyctttcttttctttcttctgcctttctcacgctttctctcctcacttccttttttcctttcctccctctgttctttccttatttctcctccattctttccattgaatcagcatttgagtgactccataggcatgtgctcttttggaagatgaataagacctagttccaggtcaagtagggagtacacaaatgaccaacagtacaggctcatctggatgcacacaggaggcagtattgagaagacctgggcttgggaagacttctggaacaagtgacatttgtgctgtgacctcaaagctga

SEQ ID NO: 148060 - DNA, 601 bp, Human
agttaactgctacatgcattcattgtaaagctttggggaattagaatctggtcagtcatactgtctttgcttcccctagccccgaacccgcaaaaatgcaaaaaaaaaaaaaaaaaaaaaacatcaagtacatccctgaaggaatgtaaggactcagaaaggtaactgaggggactatttagaggaagagataagaaccagcaatactggctttttagctatggtagccatgctcatgaactgattatacaggtatgattcttgcaatgttattacctctgtaggctcagagtagctactrttgtcatgtatttgttttttataattgtaaattcagatcttgagaaaattgatagccctaattgtggtgcatatgtgtgattagacaattgactcattgaaattatttgatggaattataatagtgctaatttcctgcaaatcattaccagtgacatgttagaatgggaagttatagacaggagaaattagagataaaacattggtactaagaagaatgcctgtaaataagctcttagttttgtaaagataagagagatgcacaccataaatacagcattatggaattttacaaagttag

SEQ ID NO: 148061 - DNA, 601 bp, Human
ctggtatgggggcaagggtagggccaggagcctgttgtcggctaaggctccagagaggaccacggccattgcagcagcagctttagatctggtgactttcaggagcacaggaaatcatcttcctgatgcctcggacatggcccccaggtgcacttgggcctcaagtggggctgccctgtgcagccactcccactacagcttgtgcagggctttaagcccagtgccttgtcttggaccttttagaccagtgtggctgttacatagagagttgacgagcagaaactggtatctccacttcagktgtgggctacttgtgataccagacggacagaaggtggacagactccaaccatggacaggcagatgctctcagggagggtaaaggccttgagttattgtttctttttttttttttcttttttttttttttagagatggggtctcgctatgttgcccagactggcccggaacctctggactcaagtgatcctcccgcctcagcttccagagtagctgaccctcctggtgcgtgtcaccaccacaagtttcaggccttcttttaaagggcttttatgtgattaagtcaggcccactcaagaaa

SEQ ID NO: 148062 - DNA, 601 bp, Human
catcttcctgatgcctcggacatggcccccaggtgcacttgggcctcaagtggggctgccctgtgcagccactcccactacagcttgtgcagggctttaagcccagtgccttgtcttggaccttttagaccagtgtggctgttacatagagagttgacgagcagaaactggtatctccacttcaggtgtgggctacttgtgataccagacggacagaaggtggacagactccaaccatggacaggcagatgctctcagggagggtaaaggccttgagttattgtttcttttttttttttttttttttttttttttagagatggggtctcgctatgttgcccagactggcccggaacctctggactcaagtgatcctcccgcctcagcttccagagtagctgaccctcctggtgcgtgtcaccaccacaagtttcaggccttcttttaaagggcttttatgtgattaagtcaggcccactcaagaaaatctcccttttgattaaacaaaaatgagctggctaaggacttgaattatatctacacagtcccttcttagcagcaggatgttagtgtatgtttgaacagtggagagaagaggctg

SEQ ID NO: 148063 - DNA, 601 bp, Human
ttgctggcttcagatatgctcttgccttctttacttcccttatttaagcttccattcttcgaggccccaaatcaagtacttgcttttactttaagcctttacagactagttagcctgtgtaatcttttgtggtactcgctgtcttagcctttccttggtcagttggtactgccttgcaaacacctttgacaagtccaaggatggtgtggtggcaccaacttgggctaggacccctgttctgacattaaccatgtgtctaaccatctgtgttctgtgataatcttcatcatcatgttgttaygaaaattacgacaatgtctgtgaagcccttacctggaaaatggaagctggataaagcaatttctcaaaatgtggagccattgtagccatgtcagagatacgtgcactttagcaggaacgcagtgatttcgaacatacactgaaatttgagaagcttgagctagatgatctctaagtcccttcaggttgctgacttgtctggtattctagttcatcattactctgaagatcatctcatacttaaagattatccatctgtttacatctcatttgagagctcaaataaggctggtttctaaaa

SEQ ID NO: 148064 - DNA, 601 bp, Human
tcagatatgctcttgccttctttacttcccttatttaagcttccattcttcgaggccccaaatcaagtacttgcttttactttaagcctttacagactagttagcctgtgtaatcttttgtggtactcgctgtcttagcctttccttggtcagttggtactgccttgcaaacacctttgacaagtccaaggatggtgtggtggcaccaacttgggctaggacccctgttctgacattaaccatgtgtctaaccatctgtgttctgtgataatcttcatcatcatgttgttatgaaaattaygacaatgtctgtgaagcccttacctggaaaatggaagctggataaagcaatttctcaaaatgtggagccattgtagccatgtcagagatacgtgcactttagcaggaacgcagtgatttcgaacatacactgaaatttgagaagcttgagctagatgatctctaagtcccttcaggttgctgacttgtctggtattctagttcatcattactctgaagatcatctcatacttaaagattatccatctgtttacatctcatttgagagctcaaataaggctggtttctaaaatttggacaa

SEQ ID NO: 148065 - DNA, 601 bp, Human
gctggataaagcaatttctcaaaatgtggagccattgtagccatgtcagagatacgtgcactttagcaggaacgcagtgatttcgaacatacactgaaatttgagaagcttgagctagatgatctctaagtcccttcaggttgctgacttgtctggtattctagttcatcattactctgaagatcatctcatacttaaagattatccatctgtttacatctcatttgagagctcaaataaggctggtttctaaaatttggacaatatgtatatgggagaacataaaaattgcaagagtttkattaaaaatacaattaatacatattctaaagagccatttttagttgtagatggtgggaattcatttgtttgtcttatatccgtcagatgaaccatattgcttgtcattggttcctttcagtttcattataaagttttcttttaaaaaaatttttatgttcttctgattttaccagaattattggtgattggccaaaggaaaaagtgttccagaggtttgctttaattgtgctacaaaaatcacaccatttcatttatagtcacttgggagatcaggtgtcccattcatcaagttattaag

SEQ ID NO: 148066 - DNA, 601 bp, Human
aaagagccatttttagttgtagatggtgggaattcatttgtttgtcttatatccgtcagatgaaccatattgcttgtcattggttcctttcagtttcattataaagttttcttttaaaaaaatttttatgttcttctgattttaccagaattattggtgattggccaaaggaaaaagtgttccagaggtttgctttaattgtgctacaaaaatcacaccatttcatttatagtcacttgggagatcaggtgtcccattcatcaagttattaagaactatttttgtagtcctgtaattagarcttgccaaataaaacattctatatagctaactcctgtactttttattcattttccttttcagaattctgctctgtttccatttgacttttgttaattgcaaaggaatttagtattaataggaaaccaaaaaacaagcacacctgtccatcagtaataggcttttggttgttattaaaaagttccttagtcatgtcagagtgggtaaagacaaaatgtaaaaatgctcagggaaatgactaagtctatagactacccccgcacccaacaccctagtgttgttctcagatctcccttaagtc

SEQ ID NO: 148067 - DNA, 601 bp, Human
ttgcatcaatgtgcctaattttatcaatgagaaaagtaatccagataatttacgtgatttcctcttaagtttacacatttagctaatgacaaatgcaggaattaaatatattttctcatccaggtgtccgtcagatctcccatgctgtttcttcctccttaaattgaaggtgattacttacggaaatttggttaaatgatttgataactatgctttgtagcatagagagaaataaacagctagtttaggtaattagttgtgaatataagagaatacagcaaatactggaaaaatggataawtttttttaaaatatagaaaatgtcatatatattttttgattcctttaatttttaggatatggtatgcttttttttcttccattagcagtctgaaaatataaatatgtgtgaataccagttttattgaaaatattgagagtagcttcatattttagagttatataatgttctgtttatttttttttttaatagaaaaaatgaatgcaccaaatcagcctccacataaagacactggaaaaacagtggagaatgtggaagaatacagctataagcaggagaaaaagatccgagcagctctta

SEQ ID NO: 148068 - DNA, 601 bp, Human
atacaatgtaaatgctgtgtaaatagttgttatactgtatcttttttgtttgtattattactattactgttttagagacaagatctcactacgttgcccaggctggactcaaactcgtgggctaaaacagtcctcctgccttagcctcctgagtagcttgtattactttttattgttgtattcttatttttaatgttttttcaaacattcttgatctgcggatgcatatcccagggtttcagagggccgactgtataacctcacctctaattcagtggttcttataggagagcagcacatragaagaggccacggtggggcgggggtgagttggacatgtcgggcttccgtaaactgcttcacccaccctccctccccaaattgtcttccttcctctccaggctcttcgtggtgattaactattgctactaatgaggattgtatcccttagatatgttatagcaagaaaagattgagaacacgtgccctacatcttatattagaactcatgttgaaaaaagacagtaatagtttccccagagttctgaattctcatctgagttgtagttctttggtttgaccaattgagatttcgctgaag

SEQ ID NO: 148069 - DNA, 601 bp, Human
gctgtgtaaatagttgttatactgtatcttttttgtttgtattattactattactgttttagagacaagatctcactacgttgcccaggctggactcaaactcgtgggctaaaacagtcctcctgccttagcctcctgagtagcttgtattactttttattgttgtattcttatttttaatgttttttcaaacattcttgatctgcggatgcatatcccagggtttcagagggccgactgtataacctcacctctaattcagtggttcttataggagagcagcacatgagaagaggccacrgtggggcgggggtgagttggacatgtcgggcttccgtaaactgcttcacccaccctccctccccaaattgtcttccttcctctccaggctcttcgtggtgattaactattgctactaatgaggattgtatcccttagatatgttatagcaagaaaagattgagaacacgtgccctacatcttatattagaactcatgttgaaaaaagacagtaatagtttccccagagttctgaattctcatctgagttgtagttctttggtttgaccaattgagatttcgctgaagaggtcatctttgt

SEQ ID NO: 148070 - DNA, 601 bp, Human
ccccaacattggggattactattcaacatagggtggggacacagatccacatcttatcaaatggtaaaatgctctacaaatcaaccataaacttttagaagttttattactttttcttccttgaagctaactgtaaatccatatgggtgcaactgtatttttatttttaagatatcttctgccttttaacctctgccaaataattgtacattttaagggcatacattttaggcagtaaaaccttttaggtttgaggacttttttgtttgtttgtttgtttttgagacaaagtctcattctrtttcctaggctggagtgtaatgggaagatctcggctcactgcaacctctgtctcccgggttcaggcaattctcctgtctcagcctcttgagtagctgggattacaagcgtgcaccaccatgcctggctaattttttgtgtttttaatagagacgggggtttcaccatgttggccaggctagtcttgaactcctgaccccaaatgatccacctgcctccgcctcccaaagtgctgggattacaggcgtgagccactgcgcctggctagtgtttttgttcttaattgttaaaatatctgaac

SEQ ID NO: 148071 - DNA, 601 bp, Human
taggctggagtgtaatgggaagatctcggctcactgcaacctctgtctcccgggttcaggcaattctcctgtctcagcctcttgagtagctgggattacaagcgtgcaccaccatgcctggctaattttttgtgtttttaatagagacgggggtttcaccatgttggccaggctagtcttgaactcctgaccccaaatgatccacctgcctccgcctcccaaagtgctgggattacaggcgtgagccactgcgcctggctagtgtttttgttcttaattgttaaaatatctgaactgacamggtaccacagattgtacataatgcatattttgcagtttttgtggtttcgtgataataggaatgaatataggtgaaggattttgtagaaaagaagaaatacacgtgatgtttgatttttcttatctatgtctttatatattttttgattacgttacttataaccagtgtttgcaaagcacatgtgatcttacatttaatttccctttgtaagcatgctttacaaaataatttttttttgagacagagtttcgctcttgttgcccaggctggagtgcaatggcgctatctcagctccctgag

SEQ ID NO: 148072 - DNA, 601 bp, Human
acaaggtaccacagattgtacataatgcatattttgcagtttttgtggtttcgtgataataggaatgaatataggtgaaggattttgtagaaaagaagaaatacacgtgatgtttgatttttcttatctatgtctttatatattttttgattacgttacttataaccagtgtttgcaaagcacatgtgatcttacatttaatttccctttgtaagcatgctttacaaaataatttttttttgagacagagtttcgctcttgttgcccaggctggagtgcaatggcgctatctcagctccckgagacctttgccttgggggttcaggctattctcctgcctcagcctccggagtagctgggattacaggcatgcgccactatgcctggctaatttttgtatttttagtagagatggtgtttcaccatgttggtcaggctggtctcaaactcctgacctcacatgatccacccgccttggcctcccaaagtgctgggatgataggtgtgagccaccgcgcccggcccaaactaatttttctctaaaactttattaatatttcaaaatattttaaaagaactgaactagcaatactaaaaaaaa

SEQ ID NO: 148073 - DNA, 601 bp, Human
ccaggctggagtgcaatggcgctatctcagctccctgagacctttgccttgggggttcaggctattctcctgcctcagcctccggagtagctgggattacaggcatgcgccactatgcctggctaatttttgtatttttagtagagatggtgtttcaccatgttggtcaggctggtctcaaactcctgacctcacatgatccacccgccttggcctcccaaagtgctgggatgataggtgtgagccaccgcgcccggcccaaactaatttttctctaaaactttattaatatttcaaaatmttttaaaagaactgaactagcaatactaaaaaaaaatctgtttgcagtttgttttcataatatgaatgccataaatgcctttaatgatttgttcaaaattatatgaagttgtagctctgtaccttctgtaaattgatttcctcaggacacatttctagttacataggcagtctctaattgaaacaaatggattagtttccagagtccacttgaataggcagttgtttgggatcttgaaaatacttatctatagaaacagtgttgtaaataagagagtctcagattatcaaatgaaactta

SEQ ID NO: 148074 - DNA, 601 bp, Human
agcttagaaattaagaccaagtaaacatatataaaagatttatccttaatatcaaaactactgcatacaattgtattttttagagcaaacttttcatcttggaataatatcagattgatagaaaatttgcaaagatagtacagaattcttatatgctcttcatccagcacgccttaatattgacttctcacttacccaatacatttgttaaaactaatatattaacattgatacaaagtgctgttaactaaactacagacttttatttggatttcccactttttctaataattcccttttytgttctaggaaccagtcgaggacaccacattgcatttagttgtcatgtccatgaatctggatttgtctgatatgttctcatgattagactggggtgatggggcttgggaatggatgccacagagttgaaatgccctagtcgcattacattgtcactgttgatgttaaccttgatcacttggttaaggtggtgtctgctaggtttctccaggagttactattttttcctttccatactccaattctttggaagtaagtcaccacacacaacccactctcaaggggagggaaattaatctct

SEQ ID NO: 148075 - DNA, 601 bp, Human
ttatccttaatatcaaaactactgcatacaattgtattttttagagcaaacttttcatcttggaataatatcagattgatagaaaatttgcaaagatagtacagaattcttatatgctcttcatccagcacgccttaatattgacttctcacttacccaatacatttgttaaaactaatatattaacattgatacaaagtgctgttaactaaactacagacttttatttggatttcccactttttctaataattcccttttctgttctaggaaccagtcgaggacaccacattgcatttarttgtcatgtccatgaatctggatttgtctgatatgttctcatgattagactggggtgatggggcttgggaatggatgccacagagttgaaatgccctagtcgcattacattgtcactgttgatgttaaccttgatcacttggttaaggtggtgtctgctaggtttctccaggagttactattttttcctttccatactccaattctttggaagtaagtcaccacacacaacccactctcaaggggagggaaattaatctctacctcctggaagggggagtatctaatgtattatttggaa

SEQ ID NO: 148076 - DNA, 601 bp, Human
gtgttcggtgctgttggggtgtcattgcttttaggccttctcagtgatagaattagaacgtacaggtatgtcttctaacctgtgtatacacacagatttataattccctatctaaaataatcatgagttcatactgatgtctttcgctctgattcagcacaaggttcattccgactttcctcccttgcttatctgtaacttacttctcttatagtgagaaacctggctaccattactacaattaattacatgtttgttcaaccctaccatacgtgtaaagtagtttcagaattgctaaccrgtacccctgtgaggaataaatttatcaactagggtgtagtgtttcagtcaagttccttttgtctttagccttttatagtcaaaacactattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatgttaa

SEQ ID NO: 148077 - DNA, 601 bp, Human
tacacacagatttataattccctatctaaaataatcatgagttcatactgatgtctttcgctctgattcagcacaaggttcattccgactttcctcccttgcttatctgtaacttacttctcttatagtgagaaacctggctaccattactacaattaattacatgtttgttcaaccctaccatacgtgtaaagtagtttcagaattgctaaccagtacccctgtgaggaataaatttatcaactagggtgtagtgtttcagtcaagttccttttgtctttagccttttatagtcaaaacrctattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatgttaaatacaaaatactgtaatatggttattttgtgctcctcctttttgatttccttatgaactttattttcagaagaataagatgaatat

SEQ ID NO: 148078 - DNA, 601 bp, Human
aaccagtacccctgtgaggaataaatttatcaactagggtgtagtgtttcagtcaagttccttttgtctttagccttttatagtcaaaacactattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatrttaaatacaaaatactgtaatatggttattttgtgctcctcctttttgatttccttatgaactttattttcagaagaataagatgaatatattgtaatgtaatgtacaaaatgtataattgtctgactttgttgcctcaaatactgggaatatttttgttttgattactgtcttaattgctttctttagaattagaaacgatcatgtagttattataaatttaatggccaatgaaatactctttgtgtttggattctaacaatagttgtgctaattttttcctgtacacacaggaaacac

SEQ ID NO: 148079 - DNA, 601 bp, Human
ttagaattagaaacgatcatgtagttattataaatttaatggccaatgaaatactctttgtgtttggattctaacaatagttgtgctaattttttcctgtacacacaggaaacactgaagaggttgccgtttatattcaaagcagacaaagcatgtagaaactaggaaatcaataacagcagctaccatttattgactctcacagtgttccagactcaacaaccctgtgaggtggtgcattttccaaatgcagaaaccagtttaggtacagtagataactttcacaaaaatcacagagctrtagattgttagagggattcaaattcaggattctgggataccagactttatcctacatggtttcgaaacctggctgcacctcagcattacctagagggcttttaaaaatacgtgtgcctagccattctgagagtaggacaagtcagaatctcccagtgggggacacgagcactgacattgtaaacaaacctcctgtgtgcctcacgtgaagctagaccagcaacagtgtagttctggtactcactggaaacactgattaggctccagtgctcttccgccccatgcctttaagatcatgctg

SEQ ID NO: 148080 - DNA, 601 bp, Human
tggattctaacaatagttgtgctaattttttcctgtacacacaggaaacactgaagaggttgccgtttatattcaaagcagacaaagcatgtagaaactaggaaatcaataacagcagctaccatttattgactctcacagtgttccagactcaacaaccctgtgaggtggtgcattttccaaatgcagaaaccagtttaggtacagtagataactttcacaaaaatcacagagctatagattgttagagggattcaaattcaggattctgggataccagactttatcctacatggtttcsaaacctggctgcacctcagcattacctagagggcttttaaaaatacgtgtgcctagccattctgagagtaggacaagtcagaatctcccagtgggggacacgagcactgacattgtaaacaaacctcctgtgtgcctcacgtgaagctagaccagcaacagtgtagttctggtactcactggaaacactgattaggctccagtgctcttccgccccatgcctttaagatcatgctgcttaatacagttgttagagttaacttattacttgtttcaatcattccctgtctgatttcataag

SEQ ID NO: 148081 - DNA, 601 bp, Human
aacaactacatgatattccattctatgaatgtaccataacttatttaattatttcactcttgatggaaatgtaatttttttgcttgtgtaaacaatgtagccacagacattcttgtacacacccctttatgaacttattctgttgtttttgtaagaatgcttaattgaaatggaattgttaggtcatggggtatatgcacattcacatctttgatatgtattgccaaattgctctccaaaaagactatactaatttatacttaaaacagtgcaggagaaatttgatttttcctcatttttrtaaccatgatcagcaaaaaatgttatttcattgattgattgatttttttttttaagtcagagcctcacactgttgcccaggctggagtacagtggcacagtctcggcttatggcagcctccacctcccaagttccagcgattctcatgcctcagcctcctgagtagctgggatcacaggcgtgtgcaaccacacctggctaattttttgtatttttagtagagatggggtttcattatgttggccaggctggtctcgaactcctggcctcaagtgatctgcctgccttggtctcccaaag

SEQ ID NO: 148082 - DNA, 601 bp, Human
tcactcttgatggaaatgtaatttttttgcttgtgtaaacaatgtagccacagacattcttgtacacacccctttatgaacttattctgttgtttttgtaagaatgcttaattgaaatggaattgttaggtcatggggtatatgcacattcacatctttgatatgtattgccaaattgctctccaaaaagactatactaatttatacttaaaacagtgcaggagaaatttgatttttcctcatttttataaccatgatcagcaaaaaatgttatttcattgattgattgatttttttttttaagtcagagcctcacactgttgcccaggctggagtacagtggcacagtctcggcttatggcagcctccacctcccaagttccagcgattctcatgcctcagcctcctgagtagctgggatcacaggcgtgtgcaaccacacctggctaattttttgtatttttagtagagatggggtttcattatgttggccaggctggtctcgaactcctggcctcaagtgatctgcctgccttggtctcccaaagtactgggattacaggcgtgagccactggcacccgacctaaatctttctcttca

SEQ ID NO: 148083 - DNA, 601 bp, Human
aatgccaagttatttcatatgccctttcttttcccccagatggtggtggtgtggtatatctgtattatcaatcatacagccgtgtatgacagtactttctcccccatagctgtcatttagtctcagttcttcagggttgtgtgtgtgtagatagataaaatatttataatagacatgtagatagaagtttcagattttgtttaaaggctcatttttaattattatatcccagtctcttgagtcattctggttgagtgacacctgttctttagtagatttctgagtaagggctcaggaggamagcatttcctgagttctgccatgtttctaacagtttgcaacatttatacttggaagtttgtttggctgtccataaaatctttggtttatattttctttccttggataaatttgttattcattcttttgacaggaagcattgatgttgaatggtctgatgacaatgtgattttttgtttccatttacaagacctttgtttgtttgctgaatacctaaaggatttttttctttaaactctactagttttacagtgttggtttttccaatttgatattttcagatacatggtgtacactttga

SEQ ID NO: 148084 - DNA, 601 bp, Human
tctttttgagttataaagttttcttttgttgacctcatttcagtgaaggcattatctgttctgtttatttgctcttatgtgccttctagtttgtttttgatttgggacgtaaaattgatttgatttttgattaaaaaattaaattctgagttctatcactgaggttttttttctaattctaatttttgtcattattttatattttttatgattttcttaatttcttttagtttatttcagaaatcggtctacaattctcatctgcttagtggacatatctttctggcaagcgctcactgtstggagggttattctcctttttctctctctgcttatggtaaccttgtgctagattctactacagttcttttctgttgcttatttttaaacatgatacttgtttccatgaacttaaaggagagagggagttaggaaagtgtttgggattggggctctgagtaccttcttctcaagtttcaaaccatcttctctgttattgtttgaggtctgtggactgttcttcttcccatgttctcgatctcctcttctctttcctcctgttgtcctttactggggagttggatttcactttttttcctcg

SEQ ID NO: 148085 - DNA, 601 bp, Human
atatagtttaacctaatgcagagctctatctttagattttactacattgggaatttctttttccaaatatattgttcaacatgtatttttgtgtttaatacatactttgatttcccataataaccagtaagaatttctaaaacagctgcataattttagaaatgaatacttgtgatactgtgaggtatagtatgaggtaagcatgtcattatttttctgttaattgcttataacatacattagataacccattattttccaacttcttaaactgctgcctttttttttttacattaaattmtagataattgggtatgtttctgtgttctgatctgtttattactgtgcaggcttattctattttaaatagagtaggcttattagtaaggtttggtatcttgtaggacagtgttgcccattgtttcttttcagaagtttctgtgctgtttttatttttgcacattactttcttccacatgggctttattatggatttgtcaaatccacacaacatgacatcagaattattattgtaattacattgcatggtcttaatatagaatctctaagatggagagcaccctttcaatgattagaagag

SEQ ID NO: 148086 - DNA, 601 bp, Human
ctcttcactggaataagatgataacagatatgtgttcctgcactgcactgtccctttctccgctcactggttttattgtaataatttggaatgcaagatccaggccttttctttatagtgtacttaaaattgtgtttttaatatttcattctagaactcgaattgtagtcagtaaccaaattatcatcatatagttgtatctgcctatacagattgaaaatcccttatccgatatgcttgggaccagaagtgttttagacttcagctttcttcggattttagaatatttgtgggctgggcrcggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaagagcaagactccgtctcaaaaaaaaaaaaaaaaaaaaaagaatat

SEQ ID NO: 148087 - DNA, 601 bp, Human
ccttatccgatatgcttgggaccagaagtgttttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccragatcgcgccactgcactccagcctgggcaaaagagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccata

SEQ ID NO: 148088 - DNA, 601 bp, Human
tccgatatgcttgggaccagaagtgttttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatygcgccactgcactccagcctgggcaaaagagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccat

SEQ ID NO: 148089 - DNA, 601 bp, Human
ttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaamagagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccatactttgaatagttttttagagaaggta

SEQ ID NO: 148090 - DNA, 601 bp, Human
agacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaasagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccatactttgaatagttttttagagaaggtaag

SEQ ID NO: 148091 - DNA, 601 bp, Human
ttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaagagcmagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccatactttgaatagttttttagagaaggtaagtgaa

SEQ ID NO: 148092 - DNA, 601 bp, Human
gtgttagattgttaatagctggggaagaagaaacactggcacttttataggagtatttacctattaatttattcatcaaacataagcatctattatgtggcaagtaccgagctaagttttagagacccatagttaactggagataaacaatctttttcatggaactgatggtctaatgggtaaatagataaaataatgcattacagtaaagcatgataaatacaacagaggaagcatttgcaaggcacaaatactgtgagaaaagggagagattaaatgagttatttgaggcaatcacagwaaacttcatagaggagggtggcatctgggcttcttcctaatgagaggaagagttcaccagggacagaacactgtctgcagatcagaacttctgataataaaagggattaatttgtgcaaaagcacagaggcaggtttgttatgggtaaaggagaaaaaggtggtggcaggagataaggatcaagatctatgcagagacctggccattaggctaaataaaagtgtctgacacttagggctgtcagtgaagcattgcattttaaattagaagggctaagacaagccttggaacaaaatcact

SEQ ID NO: 148093 - DNA, 601 bp, Human
cagttctagatgtgggggtttatgcaaacctgacttaagatatggcttcttctatttgctgtaaagcaactaatggtccagaaggagagaccaacatgttaacagtagtgattttactaatgttatatgtagtatgtttttagagcgtttttcccatgtgtacagcatgctgtttaatcttgttaagaggtagttgatggctctatttttaaaatgaagaaatcaaccctgagagactactcagtgcttccagaatcacatcgctaattgactcaaaaccagcttttctgatttttggacmttggttgttttctcattaagccacaccgtctctatcatgaaagtcaaggtaaactcagggtttagagtattttagtggcatgctgttgggggcgagaagaaagtcactggaaaggtatcatgaggtgaaccttgaaaactaaggattttgaagtggaaaataaagaggcgagcatttccaggtggggaggcagcatgggcagcgaggctggtgatggcacacgtgtgtgagggttggttgagagtgtcacgtggaggcaggagagaaggcagcactggagggtgagactaggtcatggag

SEQ ID NO: 148094 - DNA, 601 bp, Human; identical to SEQ ID NO: 33610

SEQ ID NO: 148095 - DNA, 601 bp, Human; identical to SEQ ID NO: 33611

SEQ ID NO: 148096 - DNA, 601 bp, Human; identical to SEQ ID NO: 33612

SEQ ID NO: 148097 - DNA, 601 bp, Human; identical to SEQ ID NO: 147991

SEQ ID NO: 148098 - DNA, 601 bp, Human; identical to SEQ ID NO: 147992

SEQ ID NO: 148099 - DNA, 601 bp, Human; identical to SEQ ID NO: 147993

SEQ ID NO: 148100 - DNA, 601 bp, Human; identical to SEQ ID NO: 147994

SEQ ID NO: 148101 - DNA, 601 bp, Human; identical to SEQ ID NO: 147995

SEQ ID NO: 148102 - DNA, 601 bp, Human; identical to SEQ ID NO: 147996

SEQ ID NO: 148103 - DNA, 601 bp, Human; identical to SEQ ID NO: 147997

SEQ ID NO: 148104 - DNA, 601 bp, Human; identical to SEQ ID NO: 147998

SEQ ID NO: 148105 - DNA, 601 bp, Human; identical to SEQ ID NO: 147999

SEQ ID NO: 148106 - DNA, 601 bp, Human; identical to SEQ ID NO: 148000

SEQ ID NO: 148107 - DNA, 601 bp, Human; identical to SEQ ID NO: 148001

SEQ ID NO: 148108 - DNA, 601 bp, Human; identical to SEQ ID NO: 148002

SEQ ID NO: 148109 - DNA, 601 bp, Human; identical to SEQ ID NO: 148003

SEQ ID NO: 148110 - DNA, 601 bp, Human; identical to SEQ ID NO: 148004

SEQ ID NO: 148111 - DNA, 601 bp, Human; identical to SEQ ID NO: 148005

SEQ ID NO: 148112 - DNA, 601 bp, Human; identical to SEQ ID NO: 148006

SEQ ID NO: 148113 - DNA, 601 bp, Human; identical to SEQ ID NO: 148007

SEQ ID NO: 148114 - DNA, 601 bp, Human; identical to SEQ ID NO: 148008

SEQ ID NO: 148115 - DNA, 601 bp, Human; identical to SEQ ID NO: 148009

SEQ ID NO: 148116 - DNA, 601 bp, Human; identical to SEQ ID NO: 148010

SEQ ID NO: 148117 - DNA, 601 bp, Human; identical to SEQ ID NO: 148011

SEQ ID NO: 148118 - DNA, 601 bp, Human; identical to SEQ ID NO: 148012

SEQ ID NO: 148119 - DNA, 601 bp, Human; identical to SEQ ID NO: 148013

SEQ ID NO: 148120 - DNA, 601 bp, Human; identical to SEQ ID NO: 148014

SEQ ID NO: 148121 - DNA, 601 bp, Human; identical to SEQ ID NO: 148015

SEQ ID NO: 148122 - DNA, 601 bp, Human; identical to SEQ ID NO: 148016

SEQ ID NO: 148123 - DNA, 601 bp, Human; identical to SEQ ID NO: 148017

SEQ ID NO: 148124 - DNA, 601 bp, Human; identical to SEQ ID NO: 148018

SEQ ID NO: 148125 - DNA, 601 bp, Human; identical to SEQ ID NO: 148019

SEQ ID NO: 148126 - DNA, 601 bp, Human; identical to SEQ ID NO: 148020

SEQ ID NO: 148127 - DNA, 601 bp, Human; identical to SEQ ID NO: 148021

SEQ ID NO: 148128 - DNA, 601 bp, Human; identical to SEQ ID NO: 148022

SEQ ID NO: 148129 - DNA, 601 bp, Human; identical to SEQ ID NO: 148023

SEQ ID NO: 148130 - DNA, 601 bp, Human; identical to SEQ ID NO: 148024

SEQ ID NO: 148131 - DNA, 601 bp, Human; identical to SEQ ID NO: 148025

SEQ ID NO: 148132 - DNA, 601 bp, Human; identical to SEQ ID NO: 148026

SEQ ID NO: 148133 - DNA, 601 bp, Human; identical to SEQ ID NO: 148027

SEQ ID NO: 148134 - DNA, 601 bp, Human; identical to SEQ ID NO: 148028

SEQ ID NO: 148135 - DNA, 601 bp, Human; identical to SEQ ID NO: 148029

SEQ ID NO: 148136 - DNA, 601 bp, Human; identical to SEQ ID NO: 148030

SEQ ID NO: 148137 - DNA, 601 bp, Human; identical to SEQ ID NO: 148031

SEQ ID NO: 148138 - DNA, 601 bp, Human; identical to SEQ ID NO: 148032

SEQ ID NO: 148139 - DNA, 601 bp, Human; identical to SEQ ID NO: 148033

SEQ ID NO: 148140 - DNA, 601 bp, Human; identical to SEQ ID NO: 148034

SEQ ID NO: 148141 - DNA, 601 bp, Human; identical to SEQ ID NO: 148035

SEQ ID NO: 148142 - DNA, 601 bp, Human; identical to SEQ ID NO: 148036

SEQ ID NO: 148143 - DNA, 601 bp, Human; identical to SEQ ID NO: 148037

SEQ ID NO: 148144 - DNA, 601 bp, Human; identical to SEQ ID NO: 148038

SEQ ID NO: 148145 - DNA, 601 bp, Human; identical to SEQ ID NO: 148039

SEQ ID NO: 148146 - DNA, 601 bp, Human; identical to SEQ ID NO: 148040

SEQ ID NO: 148147 - DNA, 601 bp, Human; identical to SEQ ID NO: 148041

SEQ ID NO: 148148 - DNA, 601 bp, Human; identical to SEQ ID NO: 148042

SEQ ID NO: 148149 - DNA, 601 bp, Human; identical to SEQ ID NO: 148043

SEQ ID NO: 148150 - DNA, 601 bp, Human; identical to SEQ ID NO: 148044

SEQ ID NO: 148151 - DNA, 601 bp, Human; identical to SEQ ID NO: 148045

SEQ ID NO: 148152 - DNA, 601 bp, Human; identical to SEQ ID NO: 148046

SEQ ID NO: 148153 - DNA, 601 bp, Human; identical to SEQ ID NO: 148047

SEQ ID NO: 148154 - DNA, 601 bp, Human; identical to SEQ ID NO: 148048

SEQ ID NO: 148155 - DNA, 601 bp, Human; identical to SEQ ID NO: 148049

SEQ ID NO: 148156 - DNA, 601 bp, Human; identical to SEQ ID NO: 148050

SEQ ID NO: 148157 - DNA, 601 bp, Human; identical to SEQ ID NO: 148051

SEQ ID NO: 148158 - DNA, 601 bp, Human; identical to SEQ ID NO: 148052

SEQ ID NO: 148159 - DNA, 601 bp, Human; identical to SEQ ID NO: 148053

SEQ ID NO: 148160 - DNA, 601 bp, Human; identical to SEQ ID NO: 148054

SEQ ID NO: 148161 - DNA, 601 bp, Human; identical to SEQ ID NO: 148055

SEQ ID NO: 148162 - DNA, 601 bp, Human; identical to SEQ ID NO: 148056

SEQ ID NO: 148163 - DNA, 601 bp, Human; identical to SEQ ID NO: 148057

SEQ ID NO: 148164 - DNA, 601 bp, Human; identical to SEQ ID NO: 148058

SEQ ID NO: 148165 - DNA, 601 bp, Human; identical to SEQ ID NO: 148059

SEQ ID NO: 148166 - DNA, 601 bp, Human; identical to SEQ ID NO: 148060

SEQ ID NO: 148167 - DNA, 601 bp, Human; identical to SEQ ID NO: 148061

SEQ ID NO: 148168 - DNA, 601 bp, Human; identical to SEQ ID NO: 148062

SEQ ID NO: 148169 - DNA, 601 bp, Human; identical to SEQ ID NO: 148063

SEQ ID NO: 148170 - DNA, 601 bp, Human; identical to SEQ ID NO: 148064

SEQ ID NO: 148171 - DNA, 601 bp, Human; identical to SEQ ID NO: 148065

SEQ ID NO: 148172 - DNA, 601 bp, Human; identical to SEQ ID NO: 148066

SEQ ID NO: 148173 - DNA, 601 bp, Human; identical to SEQ ID NO: 148067

SEQ ID NO: 148174 - DNA, 601 bp, Human; identical to SEQ ID NO: 148068

SEQ ID NO: 148175 - DNA, 601 bp, Human; identical to SEQ ID NO: 148069

SEQ ID NO: 148176 - DNA, 601 bp, Human; identical to SEQ ID NO: 148070

SEQ ID NO: 148177 - DNA, 601 bp, Human; identical to SEQ ID NO: 148071

SEQ ID NO: 148178 - DNA, 601 bp, Human; identical to SEQ ID NO: 148072

SEQ ID NO: 148179 - DNA, 601 bp, Human; identical to SEQ ID NO: 148073

SEQ ID NO: 148180 - DNA, 601 bp, Human; identical to SEQ ID NO: 148074

SEQ ID NO: 148181 - DNA, 601 bp, Human; identical to SEQ ID NO: 148075

SEQ ID NO: 148182 - DNA, 601 bp, Human; identical to SEQ ID NO: 148076

SEQ ID NO: 148183 - DNA, 601 bp, Human; identical to SEQ ID NO: 148077

SEQ ID NO: 148184 - DNA, 601 bp, Human; identical to SEQ ID NO: 148078

SEQ ID NO: 148185 - DNA, 601 bp, Human; identical to SEQ ID NO: 148079

SEQ ID NO: 148186 - DNA, 601 bp, Human; identical to SEQ ID NO: 148080

SEQ ID NO: 148187 - DNA, 601 bp, Human; identical to SEQ ID NO: 148081

SEQ ID NO: 148188 - DNA, 601 bp, Human; identical to SEQ ID NO: 148082

SEQ ID NO: 148189 - DNA, 601 bp, Human; identical to SEQ ID NO: 148083

SEQ ID NO: 148190 - DNA, 601 bp, Human; identical to SEQ ID NO: 148084

SEQ ID NO: 148191 - DNA, 601 bp, Human; identical to SEQ ID NO: 148085

SEQ ID NO: 148192 - DNA, 601 bp, Human; identical to SEQ ID NO: 148086

SEQ ID NO: 148193 - DNA, 601 bp, Human; identical to SEQ ID NO: 148087

SEQ ID NO: 148194 - DNA, 601 bp, Human; identical to SEQ ID NO: 148088

SEQ ID NO: 148195 - DNA, 601 bp, Human; identical to SEQ ID NO: 148089

SEQ ID NO: 148196 - DNA, 601 bp, Human; identical to SEQ ID NO: 148090

SEQ ID NO: 148197 - DNA, 601 bp, Human; identical to SEQ ID NO: 148091

SEQ ID NO: 148198 - DNA, 601 bp, Human; identical to SEQ ID NO: 148092

SEQ ID NO: 148199 - DNA, 601 bp, Human; identical to SEQ ID NO: 148093

SEQ ID NO: 148200 - DNA, 601 bp, Human; identical to SEQ ID NO: 33610

SEQ ID NO: 148201 - DNA, 601 bp, Human; identical to SEQ ID NO: 33611

SEQ ID NO: 148202 - DNA, 601 bp, Human; identical to SEQ ID NO: 33612

SEQ ID NO: 148203 - DNA, 601 bp, Human; identical to SEQ ID NO: 20154

SEQ ID NO: 148204 - DNA, 601 bp, Human; identical to SEQ ID NO: 20155

SEQ ID NO: 148205 - DNA, 601 bp, Human; identical to SEQ ID NO: 20156

SEQ ID NO: 148206 - DNA, 601 bp, Human; identical to SEQ ID NO: 20157

SEQ ID NO: 148207 - DNA, 601 bp, Human; identical to SEQ ID NO: 20158

SEQ ID NO: 148208 - DNA, 601 bp, Human; identical to SEQ ID NO: 20159

SEQ ID NO: 148209 - DNA, 601 bp, Human; identical to SEQ ID NO: 20160

SEQ ID NO: 148210 - DNA, 601 bp, Human; identical to SEQ ID NO: 20161

SEQ ID NO: 148211 - DNA, 601 bp, Human; identical to SEQ ID NO: 20162

SEQ ID NO: 148212 - DNA, 601 bp, Human
aggttctggaggtggagttggggatgtagaatgtgcaatacaggctgggccattcccacagccctggggaggggagccaggggctatgcatgaggagggggcacggggccagccaggcccccaaaccacctgccccatccattgtcctcaggtgatccttggcggaggccgcaagtacatgtttcccatggggaccccagaccctgagtacccagctgatgccagccagaatggaatcaggctggacgggaagaacctggtgcaggaatggctggcaaagcaccaggtgatgggggctggygggtgtgggaggcacggcagggggaggccaagtgtgtgggtctcagggctgtgggctgaagcctggctctgtccctgcagggtgcctggtatgtgtggaaccgcactgagctcatgcaggcgtccctggaccagtctgtgacccatctcatgggtaatgacccccttcctgccctggcattcctcagacaacctcagagggtgccatccgagcctgtgtgcccatttgccagcaccctcccgctcacagcctgccaatcaccaccaagctccttgtcccacaggcctctttgagcccgga

SEQ ID NO: 148213 - DNA, 601 bp, Human
tgggtaatgacccccttcctgccctggcattcctcagacaacctcagagggtgccatccgagcctgtgtgcccatttgccagcaccctcccgctcacagcctgccaatcaccaccaagctccttgtcccacaggcctctttgagcccggagacacgaaatatgagatccaccgagaccccacactggacccctccctgatggagatgacagaggctgccctgcgcctgctgagcaggaacccccgcggcttctacctctttgtggagggtgcgtggtggcccctggggagtggaggaaggyggggcgcggcagggcaggttcaagcatcacccccctctggccttcctgcaggcggccgcatcgaccatggtcatcatgagggtgtggcttaccaggcactcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcggtaggcctggggagagtggcaggtgctgctgcatcaattatgagggtgaagtttgag

SEQ ID NO: 148214 - DNA, 601 bp, Human
cagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgcgtgagtggctcgtggccgcccccggggccccttccccgaacagttcccccgcgcccgcccccgctrgggctggggcggcgcaaaccctgcggcaccggcttccctgctgggatccggctgcggccggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctg

SEQ ID NO: 148215 - DNA, 601 bp, Human
ggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgaggtaatgtggttgctgccctcgacgcggtggaaggctggcttaggaattaycttcctgagactcttcctactttctttctcctccccttcccgttcccgtcttccaacacactcgccaagacctaagtatacttgttgccctctcctgcccgctccggtttctagtttcagcatcaaacagtttggaggtacagagagaaaatgcagaagtatctttacttatccccctccaaggattgtatcttgaggtagaatatgttccttcctctcttctagtagtctagtaaatcgactgtctcttcatccgaaaacctggatttctagtcccagattcaccacttaccatctgtt

SEQ ID NO: 148216 - DNA, 601 bp, Human
ggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgaggtaatgtggttgctgccctcgacgcggtggaaggctggcttaggaattatcttcctgagactcttcctactttctttctcctccccttcccgttcccgtcttccaacacactcgccaagacctaagtatacttgttgccytctcctgcccgctccggtttctagtttcagcatcaaacagtttggaggtacagagagaaaatgcagaagtatctttacttatccccctccaaggattgtatcttgaggtagaatatgttccttcctctcttctagtagtctagtaaatcgactgtctcttcatccgaaaacctggatttctagtcccagattcaccacttaccatctgtttgactgtagaaaagttacccagcctctaagccattgttgctcaaaccacattagtggctaggaccctgctgccacgccggggtgtgataa

SEQ ID NO: 148217 - DNA, 601 bp, Human
tctagtaaatcgactgtctcttcatccgaaaacctggatttctagtcccagattcaccacttaccatctgtttgactgtagaaaagttacccagcctctaagccattgttgctcaaaccacattagtggctaggaccctgctgccacgccggggtgtgataagggtcagatcacactcagcgatgcttaaagatgcttgtgaacattgctaactattgcgatataaacgtaaagtggaattactattagtttaggttgtgacctggtgcttttgatgggaaattggggtgtttccaatacrgagagtactgtgcaaattcagggaatactggatttccaacactccaggcaggtaggtcctcaggaatgttttctggttgctgagaggtctctgctacttgagaaagtctttgcccgacctcttctctatcctgctgtttaactgagcctgtccctctacgaacctctcccccgctgccgccccatttcatctctattgtaaaccctgcaacaactagctccagatccaaatcctgcctcagtggagctttctggaacccttataccccttcctccactgatttgaacaaatcaaatgtca

SEQ ID NO: 148218 - DNA, 601 bp, Human
ttgttgctcaaaccacattagtggctaggaccctgctgccacgccggggtgtgataagggtcagatcacactcagcgatgcttaaagatgcttgtgaacattgctaactattgcgatataaacgtaaagtggaattactattagtttaggttgtgacctggtgcttttgatgggaaattggggtgtttccaatacagagagtactgtgcaaattcagggaatactggatttccaacactccaggcaggtaggtcctcaggaatgttttctggttgctgagaggtctctgctacttgagaargtctttgcccgacctcttctctatcctgctgtttaactgagcctgtccctctacgaacctctcccccgctgccgccccatttcatctctattgtaaaccctgcaacaactagctccagatccaaatcctgcctcagtggagctttctggaacccttataccccttcctccactgatttgaacaaatcaaatgtcatcctaagaagacatcttatgggtcatctagctcaagcctacccaaatcatttgggagtctgcagtaagaatggtaataatggacttccacagggatcttgctagg

SEQ ID NO: 148219 - DNA, 601 bp, Human
gagctgagtacagtagtatataatctaatgggctcatattaaagattagctctaatctccgttactgtatggactcaacttctctgaatgaaacctttgattgtaattgcttttgtggagaaggggtagacctatcaagtccttagatctcattgccattgatcctattgataacgtaaaaccgtaaaaactgcagtcctgacttaaacatagttttcagatctacacaactgtacttgattttgtccgtattctacatcatttgctttttattctatatcgttaactttgggcccattcstaactattgtctaaaccacttatttggcactcattgctttgattctatagacccattcattaaacggagattttttttatgccactgtctgatggtgagggtataaagatgaattgaaccaaggtcctgcccacaaggtattggtctagttcagagggtgaggaaatacgtgggcagaagcttagcaagctaactaaagtgcctctcagtctggacagtctcagacttgctaactgcctaagtttagggagcactgatttttcagtctgagttgtatcttgactcaaatccagcttgaag

SEQ ID NO: 148220 - DNA, 601 bp, Human
gcaaaaacaagatgctgggatgactgtacccctcttcaaccaagatctaaatgcaagggaccccagaggctatagtgggagttggaagctaagaagggaggaaaagggtttgcatcccaagggtgtgccctgaagaagagagttgtcctgggcctaagcagaagaacctttgagatgtttttgatcaggagacagaactggccatgagagtatagctggaacaagtacaaacatttatatgggcaagttcagaagaggagaccccaactcagcctaggttggaagaggttaggaaatgttkccaagagaaagtggccctcaatctgagtcctgtaggacaagttaactaggcaaagaaggacttcttgaggagagaccacatgatgagcataacagaaggataaaatgggggcaccaaaattagggtgatacaactggagtgaaaagagtttgttgggaccagggaggagatgatattgggacatgtgagcagagcaggggcctttgcaccatgctgaggcgtgggtatatctgtgtaccttttctcctcagctaggttcttggggacaagcactctggtagctcatacacaccatagatg

SEQ ID NO: 148221 - DNA, 601 bp, Human
acatgggaggaatggtgtgacagaccgaaggggtggtgtttgcaaatggcaccgatacggcaacatagattgctagaggaggaggatcctggctggcaggagtcagattctagaggatcttacattttgctgtactttatcttagagggtaggcatcaaaaagcgagggacagttgaaagtttaaagcatgcaagttaaatgtcagatttgcacttaaaaagataatgctagtgaaaggatggatagagagtgagagatttgtgtcaggaagaccactgaggaatttattatatgattgaygtgtcaggagaagagggcctaaactaaagtagtgacagtgagtgtagaagaggtggtaaggagaagtggcaaagcagatagtacgtttttaaccttcatttgaaatgccatagcattagagactcttctcattttttactccatttttggcagggaaaacaatcccttaaactgtataccttaaacattccctttaactggttctttgtgtggctttttagaaaactgaaagacagtgctttgtggagttcacaagttagctgatgggtgtttcgtttttgtttaatcctaatttgcctg

SEQ ID NO: 148222 - DNA, 601 bp, Human
aggtcgcgccactgcactccagcctggcaacagagtgagactccgtttcaaaaaaacaaacaaagaaatatcaaagcaatcactaattcatttattctacaatattgagtaaccctccaagggttactagcattttatgctagatgctaagaggacacaaaggtgaatgagactgtggaaggggcttacgtttaatagtaccaataataatactgacatctgttgtgcacgtactctgtgccaggcactgtgctcagcattgtatatccactgattcatttgatcctctcagcagtattgkgagatggttgttacaattttcctcattttgcaggtaagaagatgaggcacaaacaggttaagtaacttgacagtgatgaatctcatagaggaggcagtgcttggactgggcatatgctgagataagatacaaagatgaatacctattatatgagggagaaagttacaaaggccataagaacacaggtaaagtgtttcaggaatttagaatcagttaaccactgaggaaatgtactgtgtaagcagaatctttggcacattgcagatagttgaggttgtatatccttttttaattgtggag

SEQ ID NO: 148223 - DNA, 601 bp, Human
gagtgagactccgtttcaaaaaaacaaacaaagaaatatcaaagcaatcactaattcatttattctacaatattgagtaaccctccaagggttactagcattttatgctagatgctaagaggacacaaaggtgaatgagactgtggaaggggcttacgtttaatagtaccaataataatactgacatctgttgtgcacgtactctgtgccaggcactgtgctcagcattgtatatccactgattcatttgatcctctcagcagtattgtgagatggttgttacaattttcctcattttgcrggtaagaagatgaggcacaaacaggttaagtaacttgacagtgatgaatctcatagaggaggcagtgcttggactgggcatatgctgagataagatacaaagatgaatacctattatatgagggagaaagttacaaaggccataagaacacaggtaaagtgtttcaggaatttagaatcagttaaccactgaggaaatgtactgtgtaagcagaatctttggcacattgcagatagttgaggttgtatatccttttttaattgtggaggtggtaaggattgacactgcaaaatgttctct

SEQ ID NO: 148224 - DNA, 601 bp, Human
atcaaagcaatcactaattcatttattctacaatattgagtaaccctccaagggttactagcattttatgctagatgctaagaggacacaaaggtgaatgagactgtggaaggggcttacgtttaatagtaccaataataatactgacatctgttgtgcacgtactctgtgccaggcactgtgctcagcattgtatatccactgattcatttgatcctctcagcagtattgtgagatggttgttacaattttcctcattttgcaggtaagaagatgaggcacaaacaggttaagtaacttracagtgatgaatctcatagaggaggcagtgcttggactgggcatatgctgagataagatacaaagatgaatacctattatatgagggagaaagttacaaaggccataagaacacaggtaaagtgtttcaggaatttagaatcagttaaccactgaggaaatgtactgtgtaagcagaatctttggcacattgcagatagttgaggttgtatatccttttttaattgtggaggtggtaaggattgacactgcaaaatgttctctcagtctcagaccacgtgacaaatgcccaggactaaca

SEQ ID NO: 148225 - DNA, 601 bp, Human
ttacgtttaatagtaccaataataatactgacatctgttgtgcacgtactctgtgccaggcactgtgctcagcattgtatatccactgattcatttgatcctctcagcagtattgtgagatggttgttacaattttcctcattttgcaggtaagaagatgaggcacaaacaggttaagtaacttgacagtgatgaatctcatagaggaggcagtgcttggactgggcatatgctgagataagatacaaagatgaatacctattatatgagggagaaagttacaaaggccataagaacacargtaaagtgtttcaggaatttagaatcagttaaccactgaggaaatgtactgtgtaagcagaatctttggcacattgcagatagttgaggttgtatatccttttttaattgtggaggtggtaaggattgacactgcaaaatgttctctcagtctcagaccacgtgacaaatgcccaggactaacacaccttctttacttcccaggctgttgtccctggaccggcagagcatcccctgcagtacaactacactttttggtactccaggagaacccccggccgtcccacgagctcacagagct

SEQ ID NO: 148226 - DNA, 601 bp, Human
ctgtattaatgattatgcataaaatatctttttcctgtgttcagaaagaaaatgaaatctctaataattgcttttgtgggtactggcagtcagagagcccagactgtctcatctctctcccaggtgacttggtttgtgtaccccaagaatccatctgcaactaacaccactctagttgaacaaaggttattatgtacccagtgtgtgctgtacattcaatctctgggcagaatcaaatgtggggtttgtcattttcttgaaattggtgaagtattagtcctgtttaaaatgcagaaactasgggggagcggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagta

SEQ ID NO: 148227 - DNA, 601 bp, Human
atgattatgcataaaatatctttttcctgtgttcagaaagaaaatgaaatctctaataattgcttttgtgggtactggcagtcagagagcccagactgtctcatctctctcccaggtgacttggtttgtgtaccccaagaatccatctgcaactaacaccactctagttgaacaaaggttattatgtacccagtgtgtgctgtacattcaatctctgggcagaatcaaatgtggggtttgtcattttcttgaaattggtgaagtattagtcctgtttaaaatgcagaaactacgggggagsggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcac

SEQ ID NO: 148228 - DNA, 601 bp, Human
gaacaaaggttattatgtacccagtgtgtgctgtacattcaatctctgggcagaatcaaatgtggggtttgtcattttcttgaaattggtgaagtattagtcctgtttaaaatgcagaaactacgggggagcggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccaacagtcttgcatattacttttttttaaagtgctttggtttgaaaaaaataaaaaaataaaataaaatgcagaaactagaaaagaatactccagtaggaaatactacaacaaactgctaaggaggaaggacatataatacatactttatttgtataatt

SEQ ID NO: 148229 - DNA, 601 bp, Human
ggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacrgttttctccaacagtcttgcatattacttttttttaaagtgctttggtttgaaaaaaataaaaaaataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctg

SEQ ID NO: 148230 - DNA, 601 bp, Human
agcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccracagtcttgcatattacttttttttaaagtgctttggtttgaaaaaaataaaaaaataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctgtaatcccacc

SEQ ID NO: 148231 - DNA, 601 bp, Human
gtgcagcgcaccagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccaacagtcttgcatattacttttttttaaagtgctttggtttgaaaaaaataaaaaaataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctgtaatcccaccacttggggaggctgaggtgggaagattgtttgagcccaggag

SEQ ID NO: 148232 - DNA, 601 bp, Human
cagcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccaacagtcttgcatattacttttttttaaagtgctttggtttgaaaaaaataaataaataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctgtaatcccaccacttggggaggctgaggtgggaagattgtttgagcccaggagtttgagaccag

SEQ ID NO: 148233 - DNA, 601 bp, Human
agcatggcacatgtatacatatgtaactaacctgcacaatgtgcacatgtaccctaaaacttaaagtataaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccaacagtcttgcatattacttttttttaaagtgctttggtttgaaaaaaataaaataataaaataaaatgcagaaactagaaaagaatactccagtaggaaatactacaacaaactgctaaggaggaaggacatataatacatactttatttgtataatttccttccaacattatgatagccctatgaggtcagtgatattatccatgttttacaaatgaggaaagtaaaacttgggttaagtgtctgatctaaagtctcaagttatggtggggcacggtggctcatgcctgtaatcccaccacttggggaggctgaggtgggaagattgtttgagcccaggagtttgagaccagc

SEQ ID NO: 148234 - DNA, 601 bp, Human
ttgtgccactgcactctagcctgggcaacagagatagatcctgtctaaaaaaatttttaaattctcgagtcagtcataattcactggattaagtcgaggagccagtataattgaaactcaggtacagaagcttccagatagctgaacacatggaggtgcctggagggtggtgcgcctagaggggacatagaagctccctgaaccttcctccataccttcccccataccttgccctacacatctcttcatcgtatcctttgtttataataaaccagtaatgtaaggtaccaagacaataacyggggaaagaatcgtcttttcaacaaacattgctgagacaactggatttccaggtgcagaagaatgaatttgcattccttcctgacaccatacacaaaaagtaactaaaaatggatcatagacctaaatgtaagagctaaaattataaaattcttagaagaaaatattagtaaatcctaatgaccttaggttaggcaaagccttcttaagtaacacactaaacgcacaagcagcaaaagattaaatacttggctgggcgtggtggctcacgcctgtaatccttgtactttgggaggccaag

SEQ ID NO: 148235 - DNA, 601 bp, Human
tggttttattcaactatgttagggtggataaaggtttacattattgccgattgtattcatatgaccatttactattccgagtcactacatgcagctaagcttagcagttgctgagtataaagcactgccttgaagccctatagatggcgttagttctgacttctttttaccatgtaagatgcatcacgtgtgcttgtgctagagaggaactaaagggacagccatttcacgcagtgtaaggctgatttctccttaggtgctccccatatctagaagtatgacctgaatctttgtctactcratacccattgtcagctccacagttgtggtatcttgctgtatgttgatttagagcctgctcagcagtttagcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtag

SEQ ID NO: 148236 - DNA, 601 bp, Human
agggtggataaaggtttacattattgccgattgtattcatatgaccatttactattccgagtcactacatgcagctaagcttagcagttgctgagtataaagcactgccttgaagccctatagatggcgttagttctgacttctttttaccatgtaagatgcatcacgtgtgcttgtgctagagaggaactaaagggacagccatttcacgcagtgtaaggctgatttctccttaggtgctccccatatctagaagtatgacctgaatctttgtctactcgatacccattgtcagctccayagttgtggtatcttgctgtatgttgatttagagcctgctcagcagtttagcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctctttttttttt

SEQ ID NO: 148237 - DNA, 601 bp, Human
tactattccgagtcactacatgcagctaagcttagcagttgctgagtataaagcactgccttgaagccctatagatggcgttagttctgacttctttttaccatgtaagatgcatcacgtgtgcttgtgctagagaggaactaaagggacagccatttcacgcagtgtaaggctgatttctccttaggtgctccccatatctagaagtatgacctgaatctttgtctactcgatacccattgtcagctccacagttgtggtatcttgctgtatgttgatttagagcctgctcagcagtttrgcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttttaaggggagggggggtgacactaatgagaaaaacaggact

SEQ ID NO: 148238 - DNA, 601 bp, Human
tcagctccacagttgtggtatcttgctgtatgttgatttagagcctgctcagcagtttagcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttttaaggggagggggggtgacactaatgagaaaaacaggactactgtgatgaatacaaataagcatatacttgatggaaaaatataaatctagttttctcacgggattgtgaaggagcggcaaggagaaacgtaatttttctagctaagaagagggccttaaaccctagctatgagaagctaagtcctgtatgattttggattggcctggacttagcaacagcaccatgatgtagagtggtatgtgtggtacatgtggttgattctatcacttatgcttagtaa

SEQ ID NO: 148239 - DNA, 601 bp, Human
agtttagcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttttaaggggagggggggtgacactaatgagaaaaacrggactactgtgatgaatacaaataagcatatacttgatggaaaaatataaatctagttttctcacgggattgtgaaggagcggcaaggagaaacgtaatttttctagctaagaagagggccttaaaccctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgctta

SEQ ID NO: 148240 - DNA, 601 bp, Human
tcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttttaaggggagggggggtgacactaatgagaaaaacaggactactgtgatgaatacaaataagcatatacttgatggaaaaatataaatctagttttctcacgggattgtgaaggagcggcaaggagaaacrtaatttttctagctaagaagagggccttaaaccctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttactaactaaacaggtctaagaggtatttcattcagcaaatgctatatttgccagttaaacaatctttcatcggtaagtgatttggttctaaaaaat

SEQ ID NO: 148241 - DNA, 601 bp, Human
ccctgtctcttttttttttctttttttttaaggggagggggggtgacactaatgagaaaaacaggactactgtgatgaatacaaataagcatatacttgatggaaaaatataaatctagttttctcacgggattgtgaaggagcggcaaggagaaacgtaatttttctagctaagaagagggccttaaaccctagctatgagaagctaagtcctgtatgattttggattggcctggacttagcaacagcaccatgatgtagagtggtatgtgtggtacatgtggttgattctatcacttaygcttagtaactaaacaggtctaagaggtatttacatgtggttgattctatcacttatgcttactaactaaacaggtctaagaggtatttcattcagcaaatgctatatttgccagttaaacaatctttcatcggtaagtgatttggttctaaaaaatgcattcaggctgaggctgtgtgacacttacatacctcaaggctaaagagtttccattgtgcaaaaacctggtcctcttactgcatgtgatgactaccctgcagcttgagtgggagagtgcgtattaacatggtttcaccaact

SEQ ID NO: 148242 - DNA, 601 bp, Human
ggactactgtgatgaatacaaataagcatatacttgatggaaaaatataaatctagttttctcacgggattgtgaaggagcggcaaggagaaacgtaatttttctagctaagaagagggccttaaaccctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttastaactaaacaggtctaagaggtatttcattcagcaaatgctatatttgccagttaaacaatctttcatcggtaagtgatttggttctaaaaaatgcattcaggctgaggctgtgtgacacttacatacctcaaggctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttac

SEQ ID NO: 148243 - DNA, 601 bp, Human
atgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttactaactaaacaggtctaagaggtatttcattcagcaaatgctatatttgccagttaaacaatctttcatcggtaagtgatttggttctaaaaaatgcattcaggctgaggctgtgtgacacttacatacctcaargctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacaccacacatgaaaatgagtcctctgaaaaggacagcctgtagtatagtgtcttccatgcttatgttcttaacta

SEQ ID NO: 148244 - DNA, 601 bp, Human
tctttcatcggtaagtgatttggttctaaaaaatgcattcaggctgaggctgtgtgacacttacatacctcaaggctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacrccacacatgaaaatgagtcctctgaaaaggacagcctgtagtatagtgtcttccatgcttatgttcttaactaaatctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggtttt

SEQ ID NO: 148245 - DNA, 601 bp, Human
tgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacaccacacatgaaaatgagtcctctgaaaaggacagcctgtagtatagtgtcttccatgcttatgttcttaactaaatctcaaccttgggatgcattcaaagaaaagtaaaagacacatsttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggtttttttgttttgtctcttagccctgccaaggttaaaagtattttattttattttattttatttgagacggagtgtcgctctgtcacccaggctgagcgcagtggcgcgatctcggctcact

SEQ ID NO: 148246 - DNA, 601 bp, Human
cttaactaaatctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggtttttttgttttgtctcttagccctgccaaggttaaaagtattttattttattttattttatttgagacrgagtgtcgctctgtcacccaggctgagcgcagtggcgcgatctcggctcactgcaagctccgcctcccaggttcacgccattctcttgcctcagcctccctagtagctgggactacaggcgcccaccaccgcgcccggctaattttttgtgttttttagtagagacggagtttcaccgtgttagccaggatggtctcgatctcctgacctcgtgatccgcccgccttggactcccaaagtgctgggattacaggcgtgagccaccgtgcccagctggttaaaagtgttttaaagtctctc

SEQ ID NO: 148247 - DNA, 601 bp, Human
ctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggtttttttgttttgtctcttagccctgccaaggttaaaagtattttattttattttattttatttgagacggagtgtcgctstgtcacccaggctgagcgcagtggcgcgatctcggctcactgcaagctccgcctcccaggttcacgccattctcttgcctcagcctccctagtagctgggactacaggcgcccaccaccgcgcccggctaattttttgtgttttttagtagagacggagtttcaccgtgttagccaggatggtctcgatctcctgacctcgtgatccgcccgccttggactcccaaagtgctgggattacaggcgtgagccaccgtgcccagctggttaaaagtgttttaaagtctctcaaaactgcatc

SEQ ID NO: 148248 - DNA, 601 bp, Human
cagtggcacgatctcggctccctgcaagctctgcctcccgagttcacgccattctcccgcctcagcctcccgagtagctgggactacaggcgcccaccaccatgcccggctaattttgtttttgtatttttagtagagacgcggtttcaccgtgtcagccaggatggtctcgatctcctcacctcgtgattcgcccacctcagccttccaaagtgttgggattacgggcgtgagccactgcgcccagcagacattcagtacttttagcaagtaaacggatgatctgtgcttgaaatatgasatcatttcgttttgattcctaaagtatttccagtaaaggggattatttttaaaaggtctgtttagccattttaataaatggcttatgccaaggatcccagccttgtttttctttttttccccatttcttctctccctagtcctaccatcagtttttctatagagttgaataattggaaagtgatatgacttcttagtgtttaagagattcttggctttttactgccttcatacaaaaaaaggctgtgaaaccatattttaacttcagtgctttctgtctttttacaggatgatgcaaata

SEQ ID NO: 148249 - DNA, 601 bp, Human
ttttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggwgagctagccagctaagagttaggactcttaggtttagttctctcatatggccccataccaatatgtgcctttgacaagtgtctttgcaactttgcttcagtttctccatctgtaaagtgggagacagtactttatctaacaaggctattgtgaggctgatttaatctttaactgagggtcttcagatggagaatgcttttacggggccaagtagtagtattgctatcatcatcatcatcattagtaagagtatcatcatgttgttattattgaaggctagtagtgagcccagcaattatg

SEQ ID NO: 148250 - DNA, 601 bp, Human
ttgtgaaaaagtgtggggagtggctgtcagattgtctcaaagctggagggagagctagccagctaagagttaggactcttaggtttagttctctcatatggccccataccaatatgtgcctttgacaagtgtctttgcaactttgcttcagtttctccatctgtaaagtgggagacagtactttatctaacaaggctattgtgaggctgatttaatctttaactgagggtcttcagatggagaatgcttttacggggccaagtagtagtattgctatcatcatcatcatcattagtaagartatcatcatgttgttattattgaaggctagtagtgagcccagcaattatgttcagcagacagaccatttgggaatctctttcccatgcattcatagataatgtggagtggagttggcttaaaccagctaagtgccagtttttaagtgggaacactgctatgggcgttggtccatgatcaaacggctggcatgactcatcatagtcacgaacagttattagccagccatggctgtggttgcttgccttagcagtcctgtgttagcattgctttactctgggcacatttttcttattctcta

SEQ ID NO: 148251 - DNA, 601 bp, Human; identical to SEQ ID NO: 32225

SEQ ID NO: 148252 - DNA, 601 bp, Human; identical to SEQ ID NO: 32226

SEQ ID NO: 148253 - DNA, 601 bp, Human; identical to SEQ ID NO: 32227

SEQ ID NO: 148254 - DNA, 601 bp, Human; identical to SEQ ID NO: 32228

SEQ ID NO: 148255 - DNA, 601 bp, Human
catcctcccgaattaatatgcaaagggagcacatgtccaaccagggtctcagtgagatcttaatggaaaaaattgttgtaaatgttcatattgaagaaaatgcatgtgagaattgccaagaaaactttgaggaagtagagttacaagggggacttctctgggagatatgaaagcactctgtaaagattctgcagtggaaggaggaagatggcagcccagaaggagatcagccaaggaggaaggcactggagtgatctcaggaacagccgagtgtatttgggaatttaatctgtgctaaagrtgtattgcaaatatgacttatgctttcatctctttattcttttcttctgcatttgttgagcatgtccgccatgtgctaagagaaagggactccatttaatgtgcattagcaagcactgagccaacacatgtataagaccaacctcagttcacccaacaaacatttattaggcacattctacaattcccataacaatattatttagcaagtgcaattatcctccttaacagatatgaaaactgagactcggagaggttaagtaatttgtcaaaggtcacacagctggtaatcagggaagct

SEQ ID NO: 148256 - DNA, 601 bp, Human
gatgttccggaagcataagatacaccattgattccagagacatggtatgaatgtgagagcgcaatattcccattaataatttttatattaactccatattgagatgataatattttgaatatactgggttaaacacaatctattattccactaaacttcatctgtttcgtattactttttaataccgctactagaaaatgtaaaatttcatctatggctcttattgtattttactagatggtgtcggcctagaaagacacaagtgtgcctaaggctatgataacaggtagggagggagaawtgccaagggttctaatcccagtgtctccacttacaggctttgtgccctcaggtaagtagcccagcttttctgagccaggatcatctctgtataaaggaatatattaacattagtactattggcttgttaagggtgttgaatggggaatgaagcagagacaaagcccacaaggccccagaacacccaagggaaggattctattgttccaatagcagggcaggggaattccaacttgagtggatgcaccagctgcaggcaaggccctatccaatgagcaggggtttataaagacctcaggct

SEQ ID NO: 148257 - DNA, 601 bp, Human
ccagtgtctccacttacaggctttgtgccctcaggtaagtagcccagcttttctgagccaggatcatctctgtataaaggaatatattaacattagtactattggcttgttaagggtgttgaatggggaatgaagcagagacaaagcccacaaggccccagaacacccaagggaaggattctattgttccaatagcagggcaggggaattccaacttgagtggatgcaccagctgcaggcaaggccctatccaatgagcaggggtttataaagacctcaggctcagcaccagttggctagsaggaggggcaggctgaggggcagactaatgggcaggctgtcctggctcagtgctgggcatgtgttctaaagatcccacagattccatagcctggccagcttacctggcacatttagagggtcagtgaacacttttgggttattgtgtaggagaaagaaatgatgatgatgatgatgatggtggtggtggtggtggtggtggtgcctgtaggtgagatgtgtatcttactaacctgagtcaggatgtccctcaatgccaactgtgagtttctgagcctatttcctttttccatggagccca

SEQ ID NO: 148258 - DNA, 601 bp, Human
ggtgaagaggaggcgggcagcacacagcctgggtcaagagccagctccaccacatcccagccccaagcccttaaatttcctgggtctcagtttctcatctgtaaaatggatgtaaatgcccgtgtcacagagaccttaggactaagaaagaggacttagaaagaggttgggtgtggagcatgtgtcgagaaggggcttggaggagccataattagacagggaatatcaagctgctttgagattagacagtgttgtctcatggtccttttgggagctcatggataacagagctggcaggcgygcgtggagtgagattgcagccacctgtcttcccagccatgctatttgtatttaaatctgtcgcctacatacacatgcacacacgcacacacaggcacgcatgccagttgacttccttgacagctgtttctggccttgtgctccagtgccaagtcctgatgcttgcaaactttggctcttagatgatcaaagagccagcccttgttgggcccttagtgtgagccaaggcccacggcgagccccttcccacaggtctcatctgatgttcacgagagccctatgtggcaggagctcctatcag

SEQ ID NO: 148259 - DNA, 601 bp, Human
ctgtaaaatggatgtaaatgcccgtgtcacagagaccttaggactaagaaagaggacttagaaagaggttgggtgtggagcatgtgtcgagaaggggcttggaggagccataattagacagggaatatcaagctgctttgagattagacagtgttgtctcatggtccttttgggagctcatggataacagagctggcaggcgtgcgtggagtgagattgcagccacctgtcttcccagccatgctatttgtatttaaatctgtcgcctacatacacatgcacacacgcacacacaggcacrcatgccagttgacttccttgacagctgtttctggccttgtgctccagtgccaagtcctgatgcttgcaaactttggctcttagatgatcaaagagccagcccttgttgggcccttagtgtgagccaaggcccacggcgagccccttcccacaggtctcatctgatgttcacgagagccctatgtggcaggagctcctatcagcctcattttaaagaggagaaaactgaggcgccgagagttttacgcacttccatggcatgcaaggttcagaacaccaccgtgtgccccaagcaggctgc

SEQ ID NO: 148260 - DNA, 601 bp, Human
ccttttgggagctcatggataacagagctggcaggcgtgcgtggagtgagattgcagccacctgtcttcccagccatgctatttgtatttaaatctgtcgcctacatacacatgcacacacgcacacacaggcacgcatgccagttgacttccttgacagctgtttctggccttgtgctccagtgccaagtcctgatgcttgcaaactttggctcttagatgatcaaagagccagcccttgttgggcccttagtgtgagccaaggcccacggcgagccccttcccacaggtctcatctgaygttcacgagagccctatgtggcaggagctcctatcagcctcattttaaagaggagaaaactgaggcgccgagagttttacgcacttccatggcatgcaaggttcagaacaccaccgtgtgccccaagcaggctgcctagaccagctcctaggggtatccttgtgtgtcagtcccttaggccagttctgtttctccctatctgagccagggatccagtgcaggaggagggaagggagatggagtcacgctctgggcggtggagggaggacagatagactttatcccctgctttatttccct

SEQ ID NO: 148261 - DNA, 601 bp, Human
gaggagggaagggagatggagtcacgctctgggcggtggagggaggacagatagactttatcccctgctttatttccctgatccacgaaccattgccagatgtggaaggcccacagtgatcccttcatcccagcctgctcttgttacagagaaagtgacttgtccaaggccaccagcttcagcatggggactggagcccagggcctctcccctccagggaaggagctcaggagactggaagacgatccccactaccccatcgggtagatgcccactctgcccttgtaggtggaacaagccygagctcaatgacagcaaagagcttcattcttccacccgtgtctgtgttcgctgtggctccagggctggccccctccatggtctccccatagccaccgccaagcccaggcctgggacatgaaaggccctcggttacatatggttatttgaatgaactggacagtgggcaagaacaaggtgccttagaggtagctggaggaggataggacctggagtcaaaacagctgactgtgtcattttcttgttgtgtctcaacctttttgggtctcagtttcccatctgtcaaattggggccatcaat

SEQ ID NO: 148262 - DNA, 601 bp, Human
ctgatccacgaaccattgccagatgtggaaggcccacagtgatcccttcatcccagcctgctcttgttacagagaaagtgacttgtccaaggccaccagcttcagcatggggactggagcccagggcctctcccctccagggaaggagctcaggagactggaagacgatccccactaccccatcgggtagatgcccactctgcccttgtaggtggaacaagcctgagctcaatgacagcaaagagcttcattcttccacccgtgtctgtgttcgctgtggctccagggctggccccctccrtggtctccccatagccaccgccaagcccaggcctgggacatgaaaggccctcggttacatatggttatttgaatgaactggacagtgggcaagaacaaggtgccttagaggtagctggaggaggataggacctggagtcaaaacagctgactgtgtcattttcttgttgtgtctcaacctttttgggtctcagtttcccatctgtcaaattggggccatcaatgctgacctcatgggattgttttgatgatcaggaaactgacttcaggaaagaccactgccttccccaggggagggagc

SEQ ID NO: 148263 - DNA, 601 bp, Human
atgctgacctcatgggattgttttgatgatcaggaaactgacttcaggaaagaccactgccttccccaggggagggagcacgcatcctctgtcccgggcccctgactgccatctccgtgtccttgaacattaagccctagcaacatggcccactggtcatcacgtgtcatgccacgttgcttctgcctgcacacccctgctcatgtcatccccagcttcagggccctctctgccctccctctcatcaatttccactcatcctttaggattcagtgcaaatgtctgctcctctagggagcaytctctgctcctactcccaaccccatgccctttcccctcttcatctcatcctcgtagcccttacttagactatgctaagttaccttacagtgtggcccttaggtgtgaagccttaagaaacggatgctttgagtcccagggctgaggttcaaacctcaacgttgccatttgctagtggctttggaaaaattatctgacctttacctttttgtgactcagtttgctcatctaacaaatgaggaagctaataataacagcagcctgcctcttaggataatcacaaggattaaattacttactt

SEQ ID NO: 148264 - DNA, 601 bp, Human
gtgaaaccccatctctactaagaaatgcaaaaattagcagggcctggtgggaggcatctgtaatcccagctactcgggaggctgagggacaagaatcacttgaactctggaggcagatgttgcagtgagccgagatcacgccactgcactccagcctagacgatacactcagattcagtctcaaaaaagaaaagaaaagaaaagaaaagaaaaaaacccatacatgtgtggggaaaatggaaggaacaagaccaactaagtgttgataattatcaaagctgccgatgcgtatgtagggttygttatattattctctcaacttgggtgaatatttaaatatgtctctagcaaagaacacagtttaaatttgtgtacagtattcagtgttttttgttgtggttttctcactactctctaaaactgtgagaacattcagcattctttcccctgctcagtaagcaggtcttgtgcagttaaatgaaaatgatgtattttacccttgatgttttgttaaaatgactgaaaatgggagaaaaccaaaaggagtagctcccgatgaaaagacccttaagttcttcacctccctggacaaacagggtta

SEQ ID NO: 148265 - DNA, 601 bp, Human
agaaatgcaaaaattagcagggcctggtgggaggcatctgtaatcccagctactcgggaggctgagggacaagaatcacttgaactctggaggcagatgttgcagtgagccgagatcacgccactgcactccagcctagacgatacactcagattcagtctcaaaaaagaaaagaaaagaaaagaaaagaaaaaaacccatacatgtgtggggaaaatggaaggaacaagaccaactaagtgttgataattatcaaagctgccgatgcgtatgtagggtttgttatattattctctcaacktgggtgaatatttaaatatgtctctagcaaagaacacagtttaaatttgtgtacagtattcagtgttttttgttgtggttttctcactactctctaaaactgtgagaacattcagcattctttcccctgctcagtaagcaggtcttgtgcagttaaatgaaaatgatgtattttacccttgatgttttgttaaaatgactgaaaatgggagaaaaccaaaaggagtagctcccgatgaaaagacccttaagttcttcacctccctggacaaacagggttatcatatagtgggcaggccct

SEQ ID NO: 148266 - DNA, 601 bp, Human
agaccaccttccagctgcgagatcttgagcaagattcttgagctcttggagcctcattttcctcatctgtgaactagggatgacactaataactgctcattaaggctgctggaggatgttgacatcaccatcattttacaaatgatgaaacaagctcagagcaggtgagcacggctccagatcccaaagctgggagtggcaggaggttggggaattgtcaaatggggtcccctcattgcagatgacgtgccctttctgcaaattccatgccctgttcacaataaactgcacacactcttasaagagaaagggatctatctccttcatcaaacgggacgcttcagatatcctgggcagtccaccccaccgctgctagcctcccacgttctgctcctatgcctattgctaagcatttttgtaaaaatgaatactgatatgcaaacgtcaaattatagacttacctcttcccaagtccactttcaaagagctgaaatacaccataataatcagttaccactcacctttaaatattatctcaaaaatacatgtgaaacatttcctccagggctttattttttttccttcccaattttaatcagct

SEQ ID NO: 148267 - DNA, 601 bp, Human
aggctgtgcctgggcaagccctgggcatcttgccaggcagaagcaccgcagagtggccaccacctctgtcttccccataaacatagtgttatctgcagagtctatttccagaagtacatcatgaaagagacttttatgtgaacatctgcaatttggaaatcccaaggctgttttggtttgttgttgttcttgtttgtttgtttttgtctttgtcttttttttccccctcctctggccttccctagacaacactctccttgacttacgatcttttctcctttttgccttcttggcttctgtkgttggacagaatgatgcaggctccatatgacagtgtgtttgcaaagatcattttctccatctgcagaacaggcccaggcaccccagctcaggtagctcatggtgggtaagaagatagccgtcagggctctctggggactctacaggataggatatggggcaggctcctgcctgtggctggggaaaacaggaatagcttccaatccccaaggaaaatgaaagcctggtagaaacctcagagggtcccaggggcccaagcaagcatcctggggtttgaggatgagccccagcccccagaagg

SEQ ID NO: 148268 - DNA, 601 bp, Human
caggggatgagctgcctcagcctgcctggggccgagggaggctgccagtggatgggcacaaggtgccagggatcacactggaattaaggtcccagaactaactgggaggttctaagatgtgacctcgccacccctacactccaagccactgccagggggttcttggacaggctttttcattagaagctggtatcattcactgtatatgccaccggcccaggaggagtgaaagccgccatggcaccatgcacctccagttgatcagggccccagagcagctttggagtggagcaggaaggcrggggggaaactatggcttcactcagggagaggtggagactgtaagcacaggcttagagtcaagcacttcagactagagtccttctgccgttccctgctcatgcagggacagattgggtaaaggagttctaagatgactcacagcgttaagactcaccggctctccaggagaagttctggccatgaggcccctcccaaccctcactcttcagcaatgagcatcatttgttgtctctggaagctgagtgctcatgcactagaccacccgaatggcagcttaggctggacttcaggggagaag

SEQ ID NO: 148269 - DNA, 601 bp, Human
gttctccatatagaatgagccctcactcagatcttaggtatgttgattataagggcctgtgagtttgtgcatgcaggggaacagatgggcggcatgtggtttctgccttcaaaggatggcagattggttggggaaatgaacattcactcatgtattcaccctatcaacagatgcttattgacacctactatgtgtcaggctttgtgaggcttgatgtccctctacaactgccagcccaaataattgtctagctgcttcttgattacttccactgatggtgcactcactacctttcagctgttttttttttttttcatcagaaaattctccctcatgtacagtagtgggaaaaacattaactgaaacagttccagattcaaatccaagttctgtcatttactaggtgttgggcataagcaagccactttactgatctgttaaatgggaataataataccagtcactgtgcagaagacaaatgagatcagccagagtcactgagggctagggcaagacagtccccaagtggtcatcagagtgatggtttgcaatggatgtaccagcaggaggaattccagctgtgacctcatatgatgctcac

SEQ ID NO: 148270 - DNA, 601 bp, Human
ataccagtcactgtgcagaagacaaatgagatcagccagagtcactgagggctagggcaagacagtccccaagtggtcatcagagtgatggtttgcaatggatgtaccagcaggaggaattccagctgtgacctcatatgatgctcacttccagtcacttgcgagctaagcgatggtagcaatgccgttttacagaggagaagacaggctcagaaagtgaactcccagagtaacatgaacagtgacaaagcctggactggatacagtgtggtgtttctaaaacacaaatctaaccctgccrtcctcctgctaaaatccttcaataaaccattcttccagacctcagcccaaaccaaggcattcaaggtcttccttgatgtatgctgtgccttgaacccatcctcatccgtcctagccttcgcctcctcctgcctccaccctgcaccctactccaggctctgcaggccccaggccctggcacatgttgccagctcagtgcctgtgcacttgagggtccttgcgcattgggtaccctctcctgcttcctcactgatctattcccaccccctcttcaaaacccgttcccagtgcctcctgtctt

SEQ ID NO: 148271 - DNA, 601 bp, Human
atgccattgttatagcattgattgcactgaattgcaatcattatttatgtgtctgttggcctcactaggtggggagccagtcaggggctctgtcttaggcaccttcgtctcctcccagcctggcacaaatcctgtgcatagtagggattcaataatcctcggtccctagaatgactcagtcatcgtgcacatccccagctaaactgtcagtgctggagggcggaaaccgcccttgcgccagtcatctgctttccctcgtgctcacacagagaggtgaggattgatcgattatcacgagtcwggactcacttgtggcctgcagacccaaatcctaggtaagcgtctatgctggacataccctaggtatgtgtcagtgctggacaaggcagctggcactcagaggctcacacaccaaacccagcagtcctcatgccctggggtccagagggttttcccctgcacagatcttgtccagcaccttctcctgagtctgggagattttctaccactagatggtgccaattgcaaaggctggctcagccgactgcccacagcccttccctcctctgcccagggatgccataaatggttcccctgtcca

SEQ ID NO: 148272 - DNA, 601 bp, Human
aattgcaatcattatttatgtgtctgttggcctcactaggtggggagccagtcaggggctctgtcttaggcaccttcgtctcctcccagcctggcacaaatcctgtgcatagtagggattcaataatcctcggtccctagaatgactcagtcatcgtgcacatccccagctaaactgtcagtgctggagggcggaaaccgcccttgcgccagtcatctgctttccctcgtgctcacacagagaggtgaggattgatcgattatcacgagtcaggactcacttgtggcctgcagacccaaaycctaggtaagcgtctatgctggacataccctaggtatgtgtcagtgctggacaaggcagctggcactcagaggctcacacaccaaacccagcagtcctcatgccctggggtccagagggttttcccctgcacagatcttgtccagcaccttctcctgagtctgggagattttctaccactagatggtgccaattgcaaaggctggctcagccgactgcccacagcccttccctcctctgcccagggatgccataaatggttcccctgtccaagggaggacttctctgcagcttcccctca

SEQ ID NO: 148273 - DNA, 601 bp, Human
gccctactgtgtgctctgtgctgtgtttcaggcgcacagagagatgcaaggcccgggccctgccctttccaagttcacattccagtgagcgaggtaagggcagggaagccttcctggaggagagggcatctttatttcctctgccaagagcacgtcctgagtgtggtggctctgagagatggtctgctagtgctcatgaggctctgaggcttctagaatcatggcctaacaaggaaatgtctctccccaaagtcaaaaagaggggtgtgtgtgtgtgtgtgtgtgtgtgtgtgtgtgtgtgttactgattcggatatgtagggttttcttgcatcctgttgtgtttttgaggaaatatgaacaagggcaggctaactagtgcctcctcggtgaaccacccagaactgccaaccccaagagctctctgttccctaccagcaaggccttccaaggccacatcgcccacagagccttcctccctgcagggggctgcaggcaagattttttttggccattctggtgtctgtctgggccataacagagaagtcacccatatgtccccagtgaagactggcaatgtgcaggcactctgtgggggcct

SEQ ID NO: 148274 - DNA, 601 bp, Human
aagcaggctcctctgcttccagatggagggagcagcccagagcccagccagccccctgtcccagccccacagaagccctggattctcctctgcttacttcagaactcagccgtcaaggacgagaagtgctgggcaggatgatccatggcttgcccaggagagggaggactgactcaaagcctggctcccgtccccgctcctgtgtcctcaggcgattctcttcctcttgcaggcccaggtctctttcgagatagagcaaagggcacagatgggattcaggggggcaaccagatgggacagsaggtgactgggtgctggagatacaggcagcttgaagctcctgcactcagacacccaggcatctccatctgccgctcctcaggcctgggcagctcttagggccttggtttcccttcccagctggcctcttgtgtccatcatatttgccaaaataaagatgaagctgttgactgggggatgggaatggggatgctggggaggagtgcgggttggtagagtggagtgtgtatgtgttgggtggggggtctcattgccctgacagcaaaataaaagggctcctccatgtagggcttgtgctggc

SEQ ID NO: 148275 - DNA, 601 bp, Human
ctgccgctcctcaggcctgggcagctcttagggccttggtttcccttcccagctggcctcttgtgtccatcatatttgccaaaataaagatgaagctgttgactgggggatgggaatggggatgctggggaggagtgcgggttggtagagtggagtgtgtatgtgttgggtggggggtctcattgccctgacagcaaaataaaagggctcctccatgtagggcttgtgctggcaaaggaagcgccaactcactccccaagggctggggcccatgtagctgccaggagctataaagttgaawacctgccgctgcaccacgccagccctttccggatgctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaagga

SEQ ID NO: 148276 - DNA, 601 bp, Human
ttggtttcccttcccagctggcctcttgtgtccatcatatttgccaaaataaagatgaagctgttgactgggggatgggaatggggatgctggggaggagtgcgggttggtagagtggagtgtgtatgtgttgggtggggggtctcattgccctgacagcaaaataaaagggctcctccatgtagggcttgtgctggcaaaggaagcgccaactcactccccaagggctggggcccatgtagctgccaggagctataaagttgaatacctgccgctgcaccacgccagccctttccggatrctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccac

SEQ ID NO: 148277 - DNA, 601 bp, Human
tgccctgacagcaaaataaaagggctcctccatgtagggcttgtgctggcaaaggaagcgccaactcactccccaagggctggggcccatgtagctgccaggagctataaagttgaatacctgccgctgcaccacgccagccctttccggatgctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccycgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccaccgctgaccagcggaaggattcgggcaattggtttaacttcgctgcatgttgggctcctctgttctatttgttttactgagaataaaggagatgtttggctatcaaaagcgtgatagaaaaaataattttatgaaaaccttttgaacag

SEQ ID NO: 148278 - DNA, 601 bp, Human
cggatgctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggmcccaccgctgaccagcggaaggattcgggcaattggtttaacttcgctgcatgttgggctcctctgttctatttgttttactgagaataaaggagatgtttggctatcaaaagcgtgatagaaaaaataattttatgaaaaccttttgaacagcatgaggacaggaatgcaatggcagggccctttgggcgttgaaacccctgtctcagcagcccccctttccctctgccctccccccgcaggccctctctccagcccctacgaccatggactttaccccagctccactggaggacacct

SEQ ID NO: 148279 - DNA, 601 bp, Human
ggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccaccgctgaccmgcggaaggattcgggcaattggtttaacttcgctgcatgttgggctcctctgttctatttgttttactgagaataaaggagatgtttggctatcaaaagcgtgatagaaaaaataattttatgaaaaccttttgaacagcatgaggacaggaatgcaatggcagggccctttgggcgttgaaacccctgtctcagcagcccccctttccctctgccctccccccgcaggccctctctccagcccctacgaccatggactttaccccagctccactggaggacacctcctcacgcccccaa

SEQ ID NO: 148280 - DNA, 601 bp, Human
cctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccaccgctgaccagcggaaggattcgggcaattggtttaacttcgctgcatgttgggctcctctgttctatttgttttactgagaataaaggagatgtttggctatcaaaagcrtgatagaaaaaataattttatgaaaaccttttgaacagcatgaggacaggaatgcaatggcagggccctttgggcgttgaaacccctgtctcagcagcccccctttccctctgccctccccccgcaggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctca

SEQ ID NO: 148281 - DNA, 601 bp, Human; identical to SEQ ID NO: 28993

SEQ ID NO: 148282 - DNA, 601 bp, Human; identical to SEQ ID NO: 28994

SEQ ID NO: 148283 - DNA, 601 bp, Human; identical to SEQ ID NO: 28995

SEQ ID NO: 148284 - DNA, 601 bp, Human; identical to SEQ ID NO: 28996

SEQ ID NO: 148285 - DNA, 601 bp, Human; identical to SEQ ID NO: 28997

SEQ ID NO: 148286 - DNA, 601 bp, Human; identical to SEQ ID NO: 28998

SEQ ID NO: 148287 - DNA, 601 bp, Human; identical to SEQ ID NO: 28999

SEQ ID NO: 148288 - DNA, 601 bp, Human; identical to SEQ ID NO: 29000

SEQ ID NO: 148289 - DNA, 601 bp, Human; identical to SEQ ID NO: 29001

SEQ ID NO: 148290 - DNA, 601 bp, Human; identical to SEQ ID NO: 29002

SEQ ID NO: 148291 - DNA, 601 bp, Human; identical to SEQ ID NO: 29003

SEQ ID NO: 148292 - DNA, 601 bp, Human; identical to SEQ ID NO: 29004

SEQ ID NO: 148293 - DNA, 601 bp, Human; identical to SEQ ID NO: 29005

SEQ ID NO: 148294 - DNA, 601 bp, Human; identical to SEQ ID NO: 29006

SEQ ID NO: 148295 - DNA, 601 bp, Human; identical to SEQ ID NO: 29007

SEQ ID NO: 148296 - DNA, 601 bp, Human; identical to SEQ ID NO: 29008

SEQ ID NO: 148297 - DNA, 601 bp, Human; identical to SEQ ID NO: 29009

SEQ ID NO: 148298 - DNA, 601 bp, Human; identical to SEQ ID NO: 29010

SEQ ID NO: 148299 - DNA, 601 bp, Human; identical to SEQ ID NO: 29011

SEQ ID NO: 148300 - DNA, 601 bp, Human; identical to SEQ ID NO: 29012

SEQ ID NO: 148301 - DNA, 601 bp, Human; identical to SEQ ID NO: 29013

SEQ ID NO: 148302 - DNA, 601 bp, Human; identical to SEQ ID NO: 29014

SEQ ID NO: 148303 - DNA, 601 bp, Human; identical to SEQ ID NO: 29015

SEQ ID NO: 148304 - DNA, 601 bp, Human; identical to SEQ ID NO: 29016

SEQ ID NO: 148305 - DNA, 601 bp, Human; identical to SEQ ID NO: 29017

SEQ ID NO: 148306 - DNA, 601 bp, Human
tgttttcaggaagatgtcacaggatggtgcctagcttagaaaagtaacacagatccagctcttgcggggctaagtataaggatgatattatattatgggctgccagagtttggtaaacaggagtctaggtttcagaattggatgggcctggattggaaatttaacagcaaatgcccagtgatgtggatcccattccctttgtgaggctcagtctccctatctggaaaataaagtgattaaaccagctgatcttggagatccatctcaaaatgccaaagatttgacacccttcaggtgcgcygagcacccaattcttttcgtcttttaattatgaagtatttgaaccacaaacaaaactagagagacagatataatgagcccttcggtacccattgccccatttaagtagttaccggcatccaccaccgcccagtctttaccacaggctcttgtagcacagactcaagcatctcaccagagaagccagacttaccctccgggttgggcaggggcctctcggcaggcgcaggggtggatttcatgctgtttcccatttctttctttttccctggggccgctggtgatgcccagagcctgtggt

SEQ ID NO: 148307 - DNA, 601 bp, Human
ttcccaagaccccacaatatgagaattatggactaggaatctgaggaaataaaggtcaggccattagaaggggccagcatagctgagtccacagcatggtggatttgatgttcagccttttccctttgttcactggtgttccctcccaggcctctgaccagttgctgagggactctttgtagctttgggagtctaaccaaacctgacatctctccaaaaagctgactttggtcatcactgattaacctgcaatattaggctcttcccccgagaatgcttgtcaccttgcaatcccaccaaygggacataaggtttcctttgttttcaggaagatgtcacaggatggtgcctagcttagaaaagtaacacagatccagctcttgcggggctaagtataaggatgatattatattatgggctgccagagtttggtaaacaggagtctaggtttcagaattggatgggcctggattggaaatttaacagcaaatgcccagtgatgtggatcccattccctttgtgaggctcagtctccctatctggaaaataaagtgattaaaccagctgatcttggagatccatctcaaaatgccaaagattt

SEQ ID NO: 148308 - DNA, 601 bp, Human
gagggtctgtggtgcctctctggcactgaagctaatgtgggagctggctctaattgcacattggcctaaagcaaccagcaagacctgcaccgtctcctaggttacttgtttgagggtaaccggatgagcagccataggagcttgagctgagtagcagctcattccataaaaactctgaccctgtgcatgaggcagatggggactacttaacacggcatcactgcaccgccttcccctcccttactcaagtaggtagaagagaaaagaggaaacaacgttaggaccaatgatcgggggaacrtttcagggctgggggttgaaaaagcagcccaccagcgcttgatgtggttgcctggatcacaaacggggtatgaccaggggaattctcttcaccagggggtggaggggtggggagacccctctctctatgtctgttctagaggtgacctcccacccacataatggaacaaaatcaacttatttcatgacaatttgcattgaaaagttgaaggcaaatgagcaagccttggagactgatgttttcatgaggttcgctcaagcatgctgccccctctgccccaggctgagaggtgacgaccca

SEQ ID NO: 148309 - DNA, 601 bp, Human
tttgctggtgcctgccctgcatcatgctgtcgctgtgaggagggacttgttccagatctctggggcagcccgagtgactcacctaaagtcacacagcttccacggaacattactggaagctcagtgagggccttctgcctctgaaacttgctctatttccctcaagtcctgcttccttttgtaggtttaagacattagttcctgagaaattgactaatcaagaatattctggaaatcttagtttagcaaaacaaaaaacaaaaaaaaaaaaacaaaaaaacagatgggtaaagccatgttmcaaggcattcactgtcctggcttgggagaagaatgatctcccaaaagctcagaaaacatggttgtctaaaagtgtccaggctggcctctgggtgatccttgtgcacggccagggtctgtggagggtctgtggtgcctctctggcactgaagctaatgtgggagctggctctaattgcacattggcctaaagcaaccagcaagacctgcaccgtctcctaggttacttgtttgagggtaaccggatgagcagccataggagcttgagctgagtagcagctcattccataaaaactctgacc

SEQ ID NO: 148310 - DNA, 601 bp, Human
ccttctttgctggtgcctgccctgcatcatgctgtcgctgtgaggagggacttgttccagatctctggggcagcccgagtgactcacctaaagtcacacagcttccacggaacattactggaagctcagtgagggccttctgcctctgaaacttgctctatttccctcaagtcctgcttccttttgtaggtttaagacattagttcctgagaaattgactaatcaagaatattctggaaatcttagtttagcaaaacaaaaaacaaaaaaaaaaaaacaaaaaaacagatgggtaaagccrtgttccaaggcattcactgtcctggcttgggagaagaatgatctcccaaaagctcagaaaacatggttgtctaaaagtgtccaggctggcctctgggtgatccttgtgcacggccagggtctgtggagggtctgtggtgcctctctggcactgaagctaatgtgggagctggctctaattgcacattggcctaaagcaaccagcaagacctgcaccgtctcctaggttacttgtttgagggtaaccggatgagcagccataggagcttgagctgagtagcagctcattccataaaaactc

SEQ ID NO: 148311 - DNA, 601 bp, Human
cggagatgataataggcagaagcctcgtggggctgtgagaatcgagtctgcatatgtaaagcactgggcactgtgtctggaggctgtgagcaccaagcggctctaatcattcccgttttacaaaggaggacagagagactaaggagataaactctttctcatctctcgttgtgtgtcagtgcaggggcaggactaaaagctggtctgtggtctgcaagctttaggggttacagagtccccaggaactcctaggaaattcagctggcggctaccttccaccatccccaggttctgattcgtrggcctggggtgggacccaggaatctgcatttcagttacttcccaggggattctgatgcaggtggtgcgaagaccacttactgagaagctgcaagctgggtttgagaggtccctacctccttcttccttccccgagccccacccgcccccttctttccactgggcaactatgtaaacagcattatttctacccttgcacggacagaaaggggtctgtgctgctgcctctgttggtgcctcttcaggtcagggtgataagaagagaaggaacaaagaggggaaaaagatcacagcagagaga

SEQ ID NO: 148312 - DNA, 601 bp, Human
gcaatgtgacatcgtggatttcttgggctagttatatattttatgatgttcatcaatgtacaattatgtaaaagttgaatgatcaagttctgcctaagaccatctcatgtaccagcagcgaggttagattcaaatagaaaaaagggatctggtccaagatttgacacggattcactgtctgtgggaccccttgctagggcacttgatcatctgggtcattaaatctgggggccaggcacattctcattcattcgagacgagcccatcctcttccagagcatgggggcttcttgaaaccctrtcctttccaggcacacactgaggtggggagagggaccctggagtcagaccacctggctttgaatcccagctgtctcctctgagctgtatggcctaaggcaagtcatttaagcttcttgtacctcagattctccaactgcaaaacggagatgataataggcagaagcctcgtggggctgtgagaatcgagtctgcatatgtaaagcactgggcactgtgtctggaggctgtgagcaccaagcggctctaatcattcccgttttacaaaggaggacagagagactaaggagataaactcttt

SEQ ID NO: 148313 - DNA, 601 bp, Human
ccagcagcagcagcagcagcagcagcagcagcagcagcagcagcagcagggcgcacagctctggggggaatcaggcactgggctgtggtggtaccgaggttacccctgaagtcctcacgcctccctgtgaggttgatagattgaaactaccttattttgagtatgaggaaatagaggcacagtgaggtccagagaccgcccaagagcacacacctaggaagctgagtgccaggtttcaaaaccaggtctccctgggcagggcagggcatggctgtgtttgaaccactcaggtctcctttgwcatagttgacagcactagttacttgataatgtctttttaaaaattaatttacttaaaaaaacttgagtgctattctaagcaatgtgacatcgtggatttcttgggctagttatatattttatgatgttcatcaatgtacaattatgtaaaagttgaatgatcaagttctgcctaagaccatctcatgtaccagcagcgaggttagattcaaatagaaaaaagggatctggtccaagatttgacacggattcactgtctgtgggaccccttgctagggcacttgatcatctgggtcattaa

SEQ ID NO: 148314 - DNA, 601 bp, Human
ggttgcattttcccatttgtgtgactgtcaggggaatgcccatctctccccacccccggctgtgagttccgggagggcagaatactggtgtcttctgtgtctgtagcctgtgccacacctgttttacaaaggatgctcaaagcaggcttactgaatgtgcagagcggtccctgtgctgcaatgccccttaaatacagctgtcaagctacagttttaaagcagatccaggcagaaggaaacctgatttgtgggaggcagctgggtaggtggccattgtggaaccagccccttgcaaaaaacrtgttgaaatggggaggcacagtgtgtgttctctgtgacaataatagaaccttgaggtagatggtgtgtctacagaggggtttgaggtttgatatcaaattcaagattaagactgtggaacagaacaattgtctttcctaacattaaaaacaaaaaccaacagaaacaaaaacaaaagcaaaatcccattataaaaaccactgttccaatgagggaaagggaggcttagagtgttggagagtttcaatttcacaataacaaagttaagtttcctgtggaatttccgtaatagtgatgtttt

SEQ ID NO: 148315 - DNA, 601 bp, Human
tattaacatggcactgtgctgcctcggctacatgtgatgggcctttctccaacttgccaggcaccctggttctcagagcctccggataggctgttccctctgcctggaacacaccctgctcttccctccttcaccgttcccacctttgtcaactctaaactcacctctgcagaggctccagaggaggctcagccttcctgctgtactaattcttcctcttggcccctaagattttcctctgaagcggttaccccaggttgcattttcccatttgtgtgactgtcaggggaatgcccatctstccccacccccggctgtgagttccgggagggcagaatactggtgtcttctgtgtctgtagcctgtgccacacctgttttacaaaggatgctcaaagcaggcttactgaatgtgcagagcggtccctgtgctgcaatgccccttaaatacagctgtcaagctacagttttaaagcagatccaggcagaaggaaacctgatttgtgggaggcagctgggtaggtggccattgtggaaccagccccttgcaaaaaacgtgttgaaatggggaggcacagtgtgtgttctctgtgacaataata

SEQ ID NO: 148316 - DNA, 601 bp, Human
agatgagtgaggttttgggcaaaggttatgcttatcgattgataaataaattagaaacaagtaatcacggtggaacagtgcagtcaaatgtattgttcatttggggaagctgagtccctgacaataagccatgtaaaagcaagagtttctgggtgtaagacagaaaccaagagtgatctttagtggctttacaatatggaaagggatcagggcttttgagaaacagtcgtgtcgggacgtaaaagggctggcccagccagacctctgacctgtcctgctgcagaccttccccaaacctgtkggggcagctccctcacattctgctttgctgaattcaaaaaagggattcttccctgtgtagctttgactccaccccagtaagtagaggcagcattacagttgtgttaagtttgaagccagaagtcccaagttctcacaaagggcaggttcacatttggcagggcataaagcttaagcaaatttggcagtcctctttaagaaaaaaatacacaattgcaaatacaaaatgaaggacagaccccagcaaggtgctgtaccagcaagggggtctcaggcgtatgatttgtttggcttcctggca

SEQ ID NO: 148317 - DNA, 601 bp, Human
actgttccctggttcgctcaccccaagatctggagaaatcccagtactcaggcatgtgggctttggggcccaaacaagccactttctaggatccacacacctctagatcctgcctcttacaactcatatgtcttgcagcctccgagtcataagcctcttgggcagactaagtctaaagagagattaaatactagaatcagtgagaaagatgagtgaggttttgggcaaaggttatgcttatcgattgataaataaattagaaacaagtaatcacggtggaacagtgcagtcaaatgtattrttcatttggggaagctgagtccctgacaataagccatgtaaaagcaagagtttctgggtgtaagacagaaaccaagagtgatctttagtggctttacaatatggaaagggatcagggcttttgagaaacagtcgtgtcgggacgtaaaagggctggcccagccagacctctgacctgtcctgctgcagaccttccccaaacctgttggggcagctccctcacattctgctttgctgaattcaaaaaagggattcttccctgtgtagctttgactccaccccagtaagtagaggcagcatt

SEQ ID NO: 148318 - DNA, 601 bp, Human
ctatgactttcatcactccacctgctggctgggactttgaacttaaaattctgggtaacatcacctgtttattcattcggcaactacttactgagcacctgtcgtaagcagcataggtgagaaaagcaagcccattcttgctgctttcacggagctcatgttctacaggatacataaatagtcatgggaggaactgttccctggttcgctcaccccaagatctggagaaatcccagtactcaggcatgtgggctttggggcccaaacaagccactttctaggatccacacacctctagatmctgcctcttacaactcatatgtcttgcagcctccgagtcataagcctcttgggcagactaagtctaaagagagattaaatactagaatcagtgagaaagatgagtgaggttttgggcaaaggttatgcttatcgattgataaataaattagaaacaagtaatcacggtggaacagtgcagtcaaatgtattgttcatttggggaagctgagtccctgacaataagccatgtaaaagcaagagtttctgggtgtaagacagaaaccaagagtgatctttagtggctttacaatatggaaag

SEQ ID NO: 148319 - DNA, 601 bp, Human
gtaaaaaccccccttctcactaccaatgcctcgggtgtccactctgggactcagagttgttatatctatgacacttttggggaaggagtgtgaggcaaaatgagttctgaggacccattaggaccatgaggcagtaactctgaggttaaacaaaatacttatttcttgcagaatataaggccccacgctgggcatctatttaatagggacatttgttgagggtgggggtggtggaagaaaaacttagtacttttcctaatagtgtattgaaaggaattctggtgaagttttgaaaaggaargagggctgtctggttcctgactgtagaggagagacagtgattttgctttttgacactgagcgatacgtctgcttctatccttagtgatttgatgtaattcagatgcattagatgcagggtaatatttggatacatttttgggggaaataacaagatgtcttctgtatcagcaaatacagttattatttgctatgactttcatcactccacctgctggctgggactttgaacttaaaattctgggtaacatcacctgtttattcattcggcaactacttactgagcacctgtcgtaagcag

SEQ ID NO: 148320 - DNA, 601 bp, Human
cacgcagtttctcccctcggcggaatatcggggggctgatgtcaggagacgggtagtcacttagcacggcaaggaagtcgctatccagtcctggggaaacaaaggcaagggggaagggggcaaggtgctttttattcacaaggagcttaaaggtaggcttgggagggagggtatgaagatgagattttccagcaggaaatacctttcttgttttgaaccaccaatttacagcaaggtcctctcttcagagatggctctgcagggtgtgcgtacgagccctgagggtcaggtgacatgctcstattcttaagcctgccttggccctcatgttctcatctgagaaatgggatccaaaggctgtgagatgagtcatggggtctggcttcagcgcctgttacgagtctactagcctcaccctctccatctttaaaatgggactaatactacctcattccagggtccttaggagaggagatgagagtatgttacaccacatacgttcacataagttgctgtaaaaaccccccttctcactaccaatgcctcgggtgtccactctgggactcagagttgttatatctatgacacttttggggaagga

SEQ ID NO: 148321 - DNA, 601 bp, Human
aggggcttagaacttctgtcatgttctatagcccatattgaatcagactgcagaggtaagaggagagaaggcaaatttttgttttttctcatccgaaggatttccagaccctgggggctgccttcccggtcttcattcctacatagcatcaacactgcacatgtggtgggagataagaagaatatgagaagaggctggatcataaaggatctcaaaagccaagttaaggaatttaaatttgatctaccaggcagtggggagctatggaaggttctagagcactggccacattaaagaggarggttgcagtatgggtcaaatttctcacctcataataggaccaggactcatgtggaactagaccactctagctaacaatcaaatacttttctcccaaaccaagtttatcctgctttgaagattgcacaagttttggagagctgactcactcagaaatcacacgcagtttctcccctcggcggaatatcggggggctgatgtcaggagacgggtagtcacttagcacggcaaggaagtcgctatccagtcctggggaaacaaaggcaagggggaagggggcaaggtgctttttattcacaag

SEQ ID NO: 148322 - DNA, 601 bp, Human
ccatgtgctagaaatagctgcttttcagggattagcagctaatgttcccaactgttggaggctttttaaaaataaatgtttactatgttgatttatgctctgcagtatagccaaagatagtttcatatatctgaatcagtgaagatctaaataaaaggggcttagaacttctgtcatgttctatagcccatattgaatcagactgcagaggtaagaggagagaaggcaaatttttgttttttctcatccgaaggatttccagaccctgggggctgccttcccggtcttcattcctacatarcatcaacactgcacatgtggtgggagataagaagaatatgagaagaggctggatcataaaggatctcaaaagccaagttaaggaatttaaatttgatctaccaggcagtggggagctatggaaggttctagagcactggccacattaaagaggagggttgcagtatgggtcaaatttctcacctcataataggaccaggactcatgtggaactagaccactctagctaacaatcaaatacttttctcccaaaccaagtttatcctgctttgaagattgcacaagttttggagagctgact

SEQ ID NO: 148323 - DNA, 601 bp, Human
ctcttcttgacccagtgccttccttaccactatgaatgctggaatctttgttccaccttatgagtcaccagcatacgcatcatgcttaattgctgccatttgagaaatgtactcacccatggtaaactctggccacacatattccagggatgtaactctctcgaccagtgctaagagaaatagctttccaccagcccccttcactgtaagaacaagaacagagaagaacacagagataggtaaatagcaaaaccaaaggatgaatgaacagagtaatcagatttaacccaggacagtttgraacattcctcttttaagatctgtcactggccacgttaacccatatttcgtcatctgaaaattttctttttaaaggatatgtgtccagtggatagccctccattgcaagccaactggtaaaccctcccatgtgctagaaatagctgcttttcagggattagcagctaatgttcccaactgttggaggctttttaaaaataaatgtttactatgttgatttatgctctgcagtatagccaaagatagtttcatatatctgaatcagtgaagatctaaataaaaggggcttagaacttctgtc

SEQ ID NO: 148324 - DNA, 601 bp, Human
ctatctcttcttgacccagtgccttccttaccactatgaatgctggaatctttgttccaccttatgagtcaccagcatacgcatcatgcttaattgctgccatttgagaaatgtactcacccatggtaaactctggccacacatattccagggatgtaactctctcgaccagtgctaagagaaatagctttccaccagcccccttcactgtaagaacaagaacagagaagaacacagagataggtaaatagcaaaaccaaaggatgaatgaacagagtaatcagatttaacccaggacagkttggaacattcctcttttaagatctgtcactggccacgttaacccatatttcgtcatctgaaaattttctttttaaaggatatgtgtccagtggatagccctccattgcaagccaactggtaaaccctcccatgtgctagaaatagctgcttttcagggattagcagctaatgttcccaactgttggaggctttttaaaaataaatgtttactatgttgatttatgctctgcagtatagccaaagatagtttcatatatctgaatcagtgaagatctaaataaaaggggcttagaacttc

SEQ ID NO: 148325 - DNA, 601 bp, Human
gcagaagagataagttagcccaaggttgctcctttccttattgactgggttgggagcaggactatctcttcttgacccagtgccttccttaccactatgaatgctggaatctttgttccaccttatgagtcaccagcatacgcatcatgcttaattgctgccatttgagaaatgtactcacccatggtaaactctggccacacatattccagggatgtaactctctcgaccagtgctaagagaaatagctttccaccagcccccttcactgtaagaacaagaacagagaagaacacagagrtaggtaaatagcaaaaccaaaggatgaatgaacagagtaatcagatttaacccaggacagtttggaacattcctcttttaagatctgtcactggccacgttaacccatatttcgtcatctgaaaattttctttttaaaggatatgtgtccagtggatagccctccattgcaagccaactggtaaaccctcccatgtgctagaaatagctgcttttcagggattagcagctaatgttcccaactgttggaggctttttaaaaataaatgtttactatgttgatttatgctctgcagtatag

SEQ ID NO: 148326 - DNA, 601 bp, Human
aggcctcactggaacgactacaggggaaagcagggtgcttattttcttatctgttgagcctagttttctaagatatctcttgtttatcttacccatttttcaaggaaggcacataagcatttttggcagtaaggattctgtgtgtttctggataggtatttgattagaatagagctaatatttatcgagtgcttactgtaatgcctggcattgctccaagaactacacatgtatcattacatcttattctcctaacaaccctacactttgatcatattatcatatattattatccctgtcrttctatgttatgatctctacttgacaggtgaggaaagggaactgatgcataaaaagcttgttcactggcacacagccagtaagtgacagaggcaggatttgaacctagacacactgacttctagtctctgcactgtgctgtgccctcccataacatttcccagctgtttaccactctgtgccaggagcaccatgttagagctgaaaggtccaacttccttcattttactgagggagaagttgagtcccagagagcagaagagataagttagcccaaggttgctcctttccttattgactg

SEQ ID NO: 148327 - DNA, 601 bp, Human
tcagccctgctcttcctatttgatatgttaagggatgtgatcacctctgttggattggtagcctcatagggtcataattatgtcactcctcctggttccttaccacccccagctcgtgccagctgcagcctcacatcttcagcatgaaggcattgatgcatgcttgctagtgaatgaatggctccagggcaagcagctgatgtaggagagtcacgtgactcccatctctttcagaacgtgactcccacggcagctcctgcttcagttttgtttagcttcatcatcctaagcatggaagtgscatctggtattcacaattaagatcatgaatactaaaattaaactcgcagaattccagtcttcaaaggattcaggtggttatctctgttttgcaagatgagcatgtggcatgtagagtcctctggacatgaagaagtaacttagtgtttatcaatggatgcctccttctttcttttccatttccaatgtgctttgcatttctttgccaacttccagcttccgacacttgacagatgaggataatgtaactccaggaggtgaagcgacttttacaggaccctcacatggaaggaaggaagcc

SEQ ID NO: 148328 - DNA, 601 bp, Human
catccaattccataaccacctcacttcactgctgctcttccttttatttatgtaattttttttttggaaatggatccctgctctatcacccagactagagaacagtggcgtgaccttggttcactgcatcctccaccttccaggttcaagtgattctcctgcctcagcctcccaagtagctgggattacaggcatgcaccaccacgtctggcaactttttgtgtttttagtagaaatggggattcaccatgttggctgggctggtcttgaactcttgacctcaagccatctacctgcctcrgacttccaaagtgctgggattacaggcgtgagctaccgtgctcagccctgctcttcctatttgatatgttaagggatgtgatcacctctgttggattggtagcctcatagggtcataattatgtcactcctcctggttccttaccacccccagctcgtgccagctgcagcctcacatcttcagcatgaaggcattgatgcatgcttgctagtgaatgaatggctccagggcaagcagctgatgtaggagagtcacgtgactcccatctctttcagaacgtgactcccacggcagctcctg

SEQ ID NO: 148329 - DNA, 601 bp, Human
atactgagggttccagtgattaagtagtttgctcaggaaaccatgtcagcagttgatagagttaaaattagaatgcatttttctgggacatccaattccataaccacctcacttcactgctgctcttccttttatttatgtaattttttttttggaaatggatccctgctctatcacccagactagagaacagtggcgtgaccttggttcactgcatcctccaccttccaggttcaagtgattctcctgcctcagcctcccaagtagctgggattacaggcatgcaccaccacgtctggcwactttttgtgtttttagtagaaatggggattcaccatgttggctgggctggtcttgaactcttgacctcaagccatctacctgcctcggacttccaaagtgctgggattacaggcgtgagctaccgtgctcagccctgctcttcctatttgatatgttaagggatgtgatcacctctgttggattggtagcctcatagggtcataattatgtcactcctcctggttccttaccacccccagctcgtgccagctgcagcctcacatcttcagcatgaaggcattgatgcatgcttgctagt

SEQ ID NO: 148330 - DNA, 601 bp, Human
tgcttcccgttagagactgcagaagtgtattattgtgtcaaagcagatatgttcatcacatggtccttacaggttttcaggaacacaggtttcatcctctttgctttttttttttttttttttttttgagtctgggtcttgctctgtcacccagactggagtgcagtggtgccatctcagctcactgcaacctccatctcctgggctcaagggatcctcccacctcagcctccagagtagctgggactacaggcatgcgccaccacgcccagttaattcttttattttttgtagaggtgcrgtgttgctacattgcccaggctgatctcgaactcctggactcaagtgatccgcccacctcggcctcccaaagtgctgggattacaggcctgagctaccatgccgggcctcatcctctttgctttttgaggcaaacacatttggggtgcttccacatcctgaggccaaatggaatgattgtagtttggttgcaacctgtagctccaggatccatggtcgtttttggactccttcccgagtactctccaagatgtgatccctactgttttgctctttcagcccctgtcccaccaatgctgcc

SEQ ID NO: 148331 - DNA, 601 bp, Human
ctaactcctatagcttcatcgcagaggcgtttcatgttggtcttgaaggccaatgaggattctgacaagcagaaaaggggaaatgagtggcactctacaacaaagccccagaggcttgaatatgtatggcccacttaaggatgtgcaagctggttgcagttgtgaatttaggcacaccctaacttgtttaatgtacacttcgagagagggcaaatttgagattagctgcatttgacttattaaggcaacatgcacaggcagtctgtttcagcctgaaatttacagtctgaattaacgagaragcatatcatgaaggcagcataggcagtaagcaagacccctctgcattccagacggatggcgccacagagcaattagctaagaggggtcccaccatcacaatcactccatattgtatgtctcttaccagaatagtggttcaccaggtcctccaggcactggaaggtgagcctcggggaaatgtagtaccagttgttgggcagacggaaaatgcggtaatgctttacctgcctgtgtctcaccgacagtgagtaaaaccctgcaggaggtggaggataagtcagtgggctccacctgtcct

SEQ ID NO: 148332 - DNA, 601 bp, Human
cttatcagcctgggagaattcagacctctctcctgggtctgtgaagggcacaaaaatgaattaaatgtaattcttagtctttaggagcctgttgaggaatacagcctagcacacaattaaccaggccacggggaagcatgatcggaatgctgggaaagaaacccttggcatgctctgagcacagcgaagacaggtagccactgctaactcctatagcttcatcgcagaggcgtttcatgttggtcttgaaggccaatgaggattctgacaagcagaaaaggggaaatgagtggcactctayaacaaagccccagaggcttgaatatgtatggcccacttaaggatgtgcaagctggttgcagttgtgaatttaggcacaccctaacttgtttaatgtacacttcgagagagggcaaatttgagattagctgcatttgacttattaaggcaacatgcacaggcagtctgtttcagcctgaaatttacagtctgaattaacgagagagcatatcatgaaggcagcataggcagtaagcaagacccctctgcattccagacggatggcgccacagagcaattagctaagaggggtcccaccatc

SEQ ID NO: 148333 - DNA, 601 bp, Human
tgtggacccatttctccttgaaatgcactttgcttgctcagttcaagagcccatatgcaagagaatgccaacaaagttgccccagtgtgtgaggtcaagcatcctgaacccagaagggggaagatgctgtcaaagcaaaagcaacctctttctttcctccctccaatatgcagaggaagtggggaggatggcaatgttccgctgggtaaaagtggctggcatttaatgggagctcacgattatgggccaggcaccctccccactttccatgaactaactctgtggatcctcacggtgtccytgggagggggaactactagtgtctgcctggcatagatgaagaaagtgagacacaaacagccaacctcaggctgcctagctaacagtgagtggatctgggatagaaacagagcttcctgagtgggtttttggaaatgtagcatttagccaaccgttcacaatttctcccttttctgtagggtaaagttccgattcctgagctgacatttgggcctttcacagtataactcaactttctctctctggcagtatcctacactcttccagccaccacaccacatgatgcttgctttatctcagt

SEQ ID NO: 148334 - DNA, 601 bp, Human
cacctcagcctcccaaagtgctggaattacaggcatgacccaccatgcctggcccatctgtgtctttagagtgaatccagtggagataaaagtggccatgtggctcccacttggagattctcaaggggcataggaaacagttccggtttttacccttttcagttattcacagaggtgaacagatgactgtaatccattgagtggttcgatgaccaggaacatactgcgggaaggcgccagtgctgcactggggtgagatattccccatggtcaagcagcggcagttagatttcggtatttytggcctggtagcctcatggcctcatggtccctagaagctttgctaggacagcatccttctcatgtttgcttttgtctatgcaaaacttatggtctccacaccccctccgatggttgttattaaaagccaaataccacaaccaaccttttctcataaccaatataagttggctgtttccaggactcccttcctctttcgtttttacctggctgctaagttttcggatatcacaagtaatatgtgttatcatttattttgcatctgctatgtgacaggctatgctgaacgcactacatgaac

SEQ ID NO: 148335 - DNA, 601 bp, Human
tcttttttttttaactggactagtggcaatcctgtgaaaattattgcattttaatccccatgttgtaagtaaaaaaattgagcttccaagatgccaagtaatttgcctaaaggcatcatgatgaaaattataagcaacctgttgctagatgtcaattcaaacccctggtgcacaattcctctcattctgtgtctttttttttttttttttttttttttttttttgtgagatggagtcttgctctgccacacaagctggagtacagcagcactatctcagctcactgcaacctctgcctccygggttcaagtgattcccctgcctcagccttccgaatagttgggattacaggcgcccaccaccacacctggctaaattttgtatttttagtgcagacagggtttcaccatgttggtcagactagcctcgaactcctgacctcaggcgatccgcccacctcagcctcccaaagtgctggaattacaggcatgacccaccatgcctggcccatctgtgtctttagagtgaatccagtggagataaaagtggccatgtggctcccacttggagattctcaaggggcataggaaacagttccggt

SEQ ID NO: 148336 - DNA, 601 bp, Human
gagcaaaagaaccaccactcataagcacataacatgagcccagcactgagctagcctcgtaccctggatctcattgaggccttgatcagcttgtggtcagtttttttttttttttttttttttagacggagtcttgctctgtctccaggctggagtgcagtggtgtgatcttggctcattgcaacctctgcctcccaggttcaagtgattctcttgcctcagactcccgagtagctgggattacagttgcatgccaccacacctggctaattttttgtatttttagtagagatggagtttyaccatgttggccaggatggtctcaatctcctgacctcatgatccacccacctcagcctcccaaagtgctgggattacaggtgtgagccaccacacccggctgtcagtgtttttatacccattttggggagggaaaaactgagcatcccgagatgaagtaacttactcagggccgtagaaatgtgaccaaaatcaatcttattgactcattctaaaagcaactcattgcctcttaaatgaagaagaaagacatcctccagctgtctcttgggttcagaccccctggtctaattcacctctg

SEQ ID NO: 148337 - DNA, 601 bp, Human
aacaggtggactaaatagatctctaggaagaaagataaaagaaacaatgaaagaaggaaggaaaggagggagggagcagaggaggaatgaaagagggcgaggaggaaaagcaaaagtgagagggagaaggaggaagaggaggaggtgaaaatagcacaaaaagtagaagacacaggaagggagggaagagaaaacaaagataaagagggcaaagagaatgcagacaaagaatgaagacaatctctctttcactctagaagctcacgcacaaaaagaataaaagttaaataaacccgtttcttttttctcttgcatgaaaatctctgtataaaatgtctgactctcaggatcccccatctttccaggcacattacgatgtagcttccgtctcttggaaggcttctccctagcccatgttatcatgagaaagacttgattctgctgtactcagccatcttagagattgaggaaattctgcacagtcttactcaggctgaaaaccccagtgcttctcctgtgccctggggggagatgatgtggtcaagggggtgaggtgccactggcctccggcagggctaagccacccctggcctcagagcca

SEQ ID NO: 148338 - DNA, 601 bp, Human
aacacacattcttacatggaaatgatacccatattcctcatttttatcaaacatgtctatatgagaaaacccttacagaagttgtttacctttttttgcctttggaaaacagtttttttctgagtgtgagggaggattttgggggaatatcctcatcaatgtacaagtggaagcagagcttgtcctccaagtcttctaaatttgttataactttagttacagtaaactgtagtacatcagtgacttctgggaattcatacactttcagatttaaatggaaagtgctatttgtagctgaggrctcctaaaggaattctctccagggaattttattaaacggttttatgttttgtttttgccttttcaatttggtatgagatgcttgcaagtcagaagacactgcaggctgttttccccttcacccatttttcctcctcttttcctgtggtccaagtgatttctaagaggccgtagctcagtgatgctggcaggatgcaacccttttcagtcttccatgtgagaggatgaaagagagctcgcagcagagggaggaggcagttgttttgaaagttgttttgcgttgggagctggtgggaaagtt

SEQ ID NO: 148339 - DNA, 601 bp, Human
taggcgtgatgtttagctgtgaaataacttgcagaaccacctcttgttttcagaatttggcttactgtagttgcacttactagtctactactgggttgagttgaatgaaaggacccctcagcagacttcccataccaccattagcacagagcactgtcaattctattacttccttcagaaagtagggaaaggggatggttggccgtagaaatccagaatttgctactgggactattccttacagccgtgtcaaatcactttcccccttccctaaggaacagtatttgaaggaatccgggakactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttg

SEQ ID NO: 148340 - DNA, 601 bp, Human
tcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaacyaacctaagaggtgagggttctcttatcctatttccctatcttgcatttaactgaagctcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgat

SEQ ID NO: 148341 - DNA, 601 bp, Human
taaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagckcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaat

SEQ ID NO: 148342 - DNA, 601 bp, Human
actttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaataggaagagtctttctacatgtactttttatctgacttattaatcttgcccttctttaaatgttttcgtttaaatagcaaaagatgttacaatatgtactattgtgctgacataccggggaatttttttttttacaagaccatttttcattatgaatttgtaccatgtgtcagcaccttttttttttttttggttaaaacaaaacatacaaatcatatttctgatcttgaccctcatttttagattgggtttagaatcattctgcacctttaatgaaaaactgttcttacttcctatttccagaactgaaatcaaatatagacctactattcaaaactttgaaaatgttttaaactgatgggttattcttttatgggggttttccccttgtcctcctgaaataatctcttatgactacttgactacagaaaaa

SEQ ID NO: 148343 - DNA, 601 bp, Human
aaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctsctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaa

SEQ ID NO: 148344 - DNA, 601 bp, Human
tacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctcttkgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacct

SEQ ID NO: 148345 - DNA, 601 bp, Human
ctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctcycagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgag

SEQ ID NO: 148346 - DNA, 601 bp, Human
tttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaaygttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaag

SEQ ID NO: 148347 - DNA, 601 bp, Human
acattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgycctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcagg

SEQ ID NO: 148348 - DNA, 601 bp, Human
gactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacytatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcc

SEQ ID NO: 148349 - DNA, 601 bp, Human
ttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatctt

SEQ ID NO: 148350 - DNA, 601 bp, Human; identical to SEQ ID NO: 40621

SEQ ID NO: 148351 - DNA, 601 bp, Human
gacagacaggattcagcgcacccttggaagtgccgcgtcgtaaatgctgggaaaagcctttcgttatctgcctgagcccgtgagttaatgcacagatactttggtttcgggtgtgaacaaaaactttcttcgaagccgagttgtaaacgcctggcgcacgcctgctcaggagtcaaagacccagcaccgcgttccttatctttgaggtgtgcgggcgccgtcattggaaattatggttaggtgcgcgatagggaacttcagtctctggggtgagcgacgttggcagttccggattcgcttrtggtctccagggtcaaaggaaagggcgaaccaacgtttgaaggcagcggcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacatagcgggagggccacagccttccaacgcaaatccccaacccatttacaggcggaggctgctgccggcgg

SEQ ID NO: 148352 - DNA, 601 bp, Human
gggaaaagcctttcgttatctgcctgagcccgtgagttaatgcacagatactttggtttcgggtgtgaacaaaaactttcttcgaagccgagttgtaaacgcctggcgcacgcctgctcaggagtcaaagacccagcaccgcgttccttatctttgaggtgtgcgggcgccgtcattggaaattatggttaggtgcgcgatagggaacttcagtctctggggtgagcgacgttggcagttccggattcgcttgtggtctccagggtcaaaggaaagggcgaaccaacgtttgaaggcagcrgcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacatagcgggagggccacagccttccaacgcaaatccccaacccatttacaggcggaggctgctgccggcgggtgggcgggggcgatccccacattttgggcagtcagtgcatttggaag

SEQ ID NO: 148353 - DNA, 601 bp, Human
tatggttaggtgcgcgatagggaacttcagtctctggggtgagcgacgttggcagttccggattcgcttgtggtctccagggtcaaaggaaagggcgaaccaacgtttgaaggcagcggcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacrtagcgggagggccacagccttccaacgcaaatccccaacccatttacaggcggaggctgctgccggcgggtgggcgggggcgatccccacattttgggcagtcagtgcatttggaagttaggggagcttccttcacccttgccctcagtaatctgtttctgcatccttgctgaaatggaagattgcctctctgtgaggtccagatatagagcagagtcactttgtaataatcggaactcagaaacggcctcaattgagcatgggttgcagagatgagcagttttactgagctttgtctac

SEQ ID NO: 148354 - DNA, 601 bp, Human
gtgcgcgatagggaacttcagtctctggggtgagcgacgttggcagttccggattcgcttgtggtctccagggtcaaaggaaagggcgaaccaacgtttgaaggcagcggcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacatagcgggarggccacagccttccaacgcaaatccccaacccatttacaggcggaggctgctgccggcgggtgggcgggggcgatccccacattttgggcagtcagtgcatttggaagttaggggagcttccttcacccttgccctcagtaatctgtttctgcatccttgctgaaatggaagattgcctctctgtgaggtccagatatagagcagagtcactttgtaataatcggaactcagaaacggcctcaattgagcatgggttgcagagatgagcagttttactgagctttgtctacaatcacagc

SEQ ID NO: 148355 - DNA, 601 bp, Human
cgggggcgatccccacattttgggcagtcagtgcatttggaagttaggggagcttccttcacccttgccctcagtaatctgtttctgcatccttgctgaaatggaagattgcctctctgtgaggtccagatatagagcagagtcactttgtaataatcggaactcagaaacggcctcaattgagcatgggttgcagagatgagcagttttactgagctttgtctacaatcacagcttaagttaattttaaaaaaagattgaatgtgatcaggtacattaggaaaaaaggtttgtctttttkttgtgataaactttaaaaaatcacctacttgaagagtggggaaaacactggatgaggaggtaggagcgccctttctgccgctgttgctgttggtctggtgagcttatctcgctgcagttgggagtgtcggtggttgcaattgtacatgttttatacgccatgtgctggtgtgttcgcacagtggatggctctatgctatgtgctccagggataaaacccatggcaggacagccaggcgatgtgtgtatgtgtttgggatctttctgtaacgccgtgtgctgctgtgttcgcacagtggat

SEQ ID NO: 148356 - DNA, 601 bp, Human
atgtgtttgggatctttctgtaacgccgtgtgctgctgtgttcgcacagtggatggctctatgctaagtgctccagggataaaaccccctggcaggacagccaggcaatgtgtatgtgtgttcagggtgtttctataatgccacatgcaagtgtgttcgcacactgagtggctctatgctgagtgatctcaggataaaaccccctggcaagacagccaggcaatacatatgtgtgttgggatctttaatttctacttaatccatggtaaggctggggactgctttataattggtgatggtmtggttagagatttcacagttgaaaggacagggcatggacttggatgagagagggcattatctctgtgagtcgcatctgttaggtggcttcttccactccactcagcagcgctgcctaatgcttacttcccaagtgaaccagaggacccacatggagggcagacagctgatttttggagacatttaaagatgaagaataaaacgagcctcaacaagtgctcaagcgaggtttgcatgagtgagtatgatccatggacatcaaagaagacagacataaaaatctgtaatttaatgctctgac

SEQ ID NO: 148357 - DNA, 601 bp, Human
tggttagagatttcacagttgaaaggacagggcatggacttggatgagagagggcattatctctgtgagtcgcatctgttaggtggcttcttccactccactcagcagcgctgcctaatgcttacttcccaagtgaaccagaggacccacatggagggcagacagctgatttttggagacatttaaagatgaagaataaaacgagcctcaacaagtgctcaagcgaggtttgcatgagtgagtatgatccatggacatcaaagaagacagacataaaaatctgtaatttaatgctctgacrgatactttggaagcattctggagttgcagggttactagcatcctggggttacaataaggtgattttatgaagatcagtggctactaaaatgcagtgtggaatgatggagggtcaggggctggctcggtctccagctggctgtgtggcttgggtgagttactcgccttctctgggcttgtatttttcctctgtaaaattagccattggattcagcccgttacaatgctccaaatgccatcagggtcaccacctggttactgtttggtgtgcccagaacaatgattaaaaagtctttaagaa

SEQ ID NO: 148358 - DNA, 601 bp, Human
tgagagagggcattatctctgtgagtcgcatctgttaggtggcttcttccactccactcagcagcgctgcctaatgcttacttcccaagtgaaccagaggacccacatggagggcagacagctgatttttggagacatttaaagatgaagaataaaacgagcctcaacaagtgctcaagcgaggtttgcatgagtgagtatgatccatggacatcaaagaagacagacataaaaatctgtaatttaatgctctgacagatactttggaagcattctggagttgcagggttactagcatccyggggttacaataaggtgattttatgaagatcagtggctactaaaatgcagtgtggaatgatggagggtcaggggctggctcggtctccagctggctgtgtggcttgggtgagttactcgccttctctgggcttgtatttttcctctgtaaaattagccattggattcagcccgttacaatgctccaaatgccatcagggtcaccacctggttactgtttggtgtgcccagaacaatgattaaaaagtctttaagaaagtagaatgatattaggaatgtaccccgtaaagccccaaaaaag

SEQ ID NO: 148359 - DNA, 601 bp, Human
atgaagatcagtggctactaaaatgcagtgtggaatgatggagggtcaggggctggctcggtctccagctggctgtgtggcttgggtgagttactcgccttctctgggcttgtatttttcctctgtaaaattagccattggattcagcccgttacaatgctccaaatgccatcagggtcaccacctggttactgtttggtgtgcccagaacaatgattaaaaagtctttaagaaagtagaatgatattaggaatgtaccccgtaaagccccaaaaaagtttttgaaatatattggagagaytcttttttgttttgttttgttttgttttctttgagacggagtctctctctgtcgcccaggctggtgtgcagtggcgtgatctcggcttactgcaagctccgcctcccaggttcctgccattctcctgcctcagcctcccgaatagctgggactacaggcgactgccaccatgcccggctaattttttgtatttttagtagaggcggggtttcactgtgttagccaggatggtctcgatctcctgacctcgtgatccgcccgccttggcttcccaaagtgctgggattacaggtgtgagcc

SEQ ID NO: 148360 - DNA, 601 bp, Human
ctaattttttgtatttttagtagaggcggggtttcactgtgttagccaggatggtctcgatctcctgacctcgtgatccgcccgccttggcttcccaaagtgctgggattacaggtgtgagccaccgcgcccagcctctttttaaattccaaatagttttgtgcttcttttggtttgtttttcatgtttggtttcttaagaggaaaacccccatctattcataaagttcaactatccaaaacaagtcagcaactctctgaattctgcatagctaatattttgctgtctttggttcaactartttttttctttcaaattctgtctgatgaaaggaactgtagttccatcttcagctaacattatgtatccagtgtatttttataaacttgaagcctaagatacaaatcatgcaaaggggtgaattgggagagtttacaaagtgggcgggatgaccagactccagaatgcctccatatagctataatacttcatccttgcaccatggtgggaggggtatcattgtcctggcttcatagaagagagacctgaggaccttccagggtcccacgccatttatgtagccaaactgaattcaaatccg

SEQ ID NO: 148361 - DNA, 601 bp, Human
ctatccaaaacaagtcagcaactctctgaattctgcatagctaatattttgctgtctttggttcaactaatttttttctttcaaattctgtctgatgaaaggaactgtagttccatcttcagctaacattatgtatccagtgtatttttataaacttgaagcctaagatacaaatcatgcaaaggggtgaattgggagagtttacaaagtgggcgggatgaccagactccagaatgcctccatatagctataatacttcatccttgcaccatggtgggaggggtatcattgtcctggcttyatagaagagagacctgaggaccttccagggtcccacgccatttatgtagccaaactgaattcaaatccgggggccttgattgtaagtcagtccactttcctccataaagtgctcaaaatccttcaagcaagtccatgaaacatagtactcagatctctcacactttataacctgcagaaacctcgttgaaactttgtatttattttcttactatcatggtcctccaatgggctactttgtttcattttacggtgtcaggatccacagtcagccagactggcagatggggaggctgtgctt

SEQ ID NO: 148362 - DNA, 601 bp, Human
tggttcaactaatttttttctttcaaattctgtctgatgaaaggaactgtagttccatcttcagctaacattatgtatccagtgtatttttataaacttgaagcctaagatacaaatcatgcaaaggggtgaattgggagagtttacaaagtgggcgggatgaccagactccagaatgcctccatatagctataatacttcatccttgcaccatggtgggaggggtatcattgtcctggcttcatagaagagagacctgaggaccttccagggtcccacgccatttatgtagccaaactgrattcaaatccgggggccttgattgtaagtcagtccactttcctccataaagtgctcaaaatccttcaagcaagtccatgaaacatagtactcagatctctcacactttataacctgcagaaacctcgttgaaactttgtatttattttcttactatcatggtcctccaatgggctactttgtttcattttacggtgtcaggatccacagtcagccagactggcagatggggaggctgtgctttcatttggtgggaatggttctctagcctcctgatgtgaaagttgcaaaatggtcattt

SEQ ID NO: 148363 - DNA, 601 bp, Human
cagccaccccactaggtgtctgattcttggtctaggcagcagaatggccaaacagattcatgcagcaatgctttctggacctcagaacaaggaaaatatttacaataaggaccttcattatgagaatgtgcaagagtatctcctgctcctctctggcagctgatattttggattatcaacatcagttcagctgaagtttatttagcatttattttattctaggcactgggctaggctggggatacaaagatacacgagtctttctcaaaacagcgtgaagcttggcagggaaaattgcagmgataatgtgatgacagtggctgtgggtgtgataaagggtaccaccctctgatgggacagaggagtgaaccagggcagaaagtacattgaccttaacctcaacctctgagtacaaggaggagtccaagaggaaaatatgagggaaaagatgttctattctcacaccctctcatcttcattattttctctgcacccatttattttgtgccctcaggagcagtggttggtgtgcattctcgggtcgcacacacagggtttggaatcaaaagacgagggttggagttcaggaattttccttttt

SEQ ID NO: 148364 - DNA, 601 bp, Human
tgggacagaggagtgaaccagggcagaaagtacattgaccttaacctcaacctctgagtacaaggaggagtccaagaggaaaatatgagggaaaagatgttctattctcacaccctctcatcttcattattttctctgcacccatttattttgtgccctcaggagcagtggttggtgtgcattctcgggtcgcacacacagggtttggaatcaaaagacgagggttggagttcaggaattttcctttttcacaaacatctagggcccttttcagatggtccatggaccacacagagagacragctgggtgtttcttaatgaggagcatgatgagaatataatgactgggagagaattgccagttccaccaagcacaccctggagactctcggaggggaacattatccctttatcctcagacaggtatcccaaatcttatcagatgaaatgctgctgtttattttcagagagctttgagctctccagggatgggcaactgataataaaatcctggaattaactggggagcgggggaagcccacagctgaaccacactttctgggagtcttggtaaaccttagaaaggagctttgggcaaagg

SEQ ID NO: 148365 - DNA, 601 bp, Human
gttgcagagacatctgtacttttggacccacgggttatttttggcattggcatcttagtagagtggaaagaatacacatgtcctttggtgtcagataaatcttgtcctaaatcccagctcctctattaacttgaagggcaagtcaactgagcatctgcctgagcctcagtttcctcagcactagaatgggtacaagaatgcctgccttagcaattggcttgacatatgcttgcaaagtgcctggtcataggtggtgctcagaacagttggttcctgtgaacacataaagacccttaagccrggtgggagtcaggagggagggaaggaacaggctatgggccagatttgaccctagagctgtaagtttgctgatccctggtctagcataataaatcactgataaatttgccttaaatataaatagtcaaagccttggccagttgtggtggttcatgcctgtaatcccaggagtctgaggccagcctaggcagcattgtgagactccaactatacaaaaatattttaaaatttttaaaaaattggccgagtgtggtgatgcatgcctgtagtcctatctactcagaaggttgaacccaggagg

SEQ ID NO: 148366 - DNA, 601 bp, Human
cttagtagagtggaaagaatacacatgtcctttggtgtcagataaatcttgtcctaaatcccagctcctctattaacttgaagggcaagtcaactgagcatctgcctgagcctcagtttcctcagcactagaatgggtacaagaatgcctgccttagcaattggcttgacatatgcttgcaaagtgcctggtcataggtggtgctcagaacagttggttcctgtgaacacataaagacccttaagccgggtgggagtcaggagggagggaaggaacaggctatgggccagatttgaccctrgagctgtaagtttgctgatccctggtctagcataataaatcactgataaatttgccttaaatataaatagtcaaagccttggccagttgtggtggttcatgcctgtaatcccaggagtctgaggccagcctaggcagcattgtgagactccaactatacaaaaatattttaaaatttttaaaaaattggccgagtgtggtgatgcatgcctgtagtcctatctactcagaaggttgaacccaggaggtcgaactgtgctgctgtattccagcctgggtgacagaggaagaccctgtctct

SEQ ID NO: 148367 - DNA, 601 bp, Human
tctattaacttgaagggcaagtcaactgagcatctgcctgagcctcagtttcctcagcactagaatgggtacaagaatgcctgccttagcaattggcttgacatatgcttgcaaagtgcctggtcataggtggtgctcagaacagttggttcctgtgaacacataaagacccttaagccgggtgggagtcaggagggagggaaggaacaggctatgggccagatttgaccctagagctgtaagtttgctgatccctggtctagcataataaatcactgataaatttgccttaaatataaakagtcaaagccttggccagttgtggtggttcatgcctgtaatcccaggagtctgaggccagcctaggcagcattgtgagactccaactatacaaaaatattttaaaatttttaaaaaattggccgagtgtggtgatgcatgcctgtagtcctatctactcagaaggttgaacccaggaggtcgaactgtgctgctgtattccagcctgggtgacagaggaagaccctgtctctaaaaaataaaataaaatatctcggacactaatttgctctaaaggctgagaataccgatactttcccac

SEQ ID NO: 148368 - DNA, 601 bp, Human
tgcctgtagtcctatctactcagaaggttgaacccaggaggtcgaactgtgctgctgtattccagcctgggtgacagaggaagaccctgtctctaaaaaataaaataaaatatctcggacactaatttgctctaaaggctgagaataccgatactttcccactggaccccacaggtaggtcatatttcccagcttcccttgaagctagagaggccacgtgtctgagtcctggtcagtgatgttggggaagtgaatgtggaactgctaagcctggagccggagcaaccttcctcctgcagtmcccggaggatggtggaactcttacacggaaggatatgcgttcctggaggcatgcgaggcaggcaggagccccacagctcccctccacaccaattcatctgcacaggaatatgggattgcgaataagaaataagctttattgtgttacacaactgaggcttgggagactgcttgttgcagctcttcctgttaggctgctctgactcatacagcatcttagtgtgcttcctggcagggcacaggtcacgaggctgtgggcacctgacaaaatggtatggaggctggtgcctctaagagcatc

SEQ ID NO: 148369 - DNA, 601 bp, Human
gatggtggaactcttacacggaaggatatgcgttcctggaggcatgcgaggcaggcaggagccccacagctcccctccacaccaattcatctgcacaggaatatgggattgcgaataagaaataagctttattgtgttacacaactgaggcttgggagactgcttgttgcagctcttcctgttaggctgctctgactcatacagcatcttagtgtgcttcctggcagggcacaggtcacgaggctgtgggcacctgacaaaatggtatggaggctggtgcctctaagagcatcctcccctrggtctggtacacaaggtctctgtgcctccaccccatgtctccgcctatagaggcttttccctctcttagcccccggggctcccactctccaggcagtcaccctgggacatgtgccacagctgtcctccccttgggctcttgtgtgcgctgtttcctttcctttcctcaaaatacctgtctttcctcggccgggcacggtggctcacacctgtaatcccagcactttgggaggccaaggtgggcagatcacgaggtcaggagatcgagaccatcctggctaacacggtgaaaccccgtctc

SEQ ID NO: 148370 - DNA, 601 bp, Human
ccaccccatgtctccgcctatagaggcttttccctctcttagcccccggggctcccactctccaggcagtcaccctgggacatgtgccacagctgtcctccccttgggctcttgtgtgcgctgtttcctttcctttcctcaaaatacctgtctttcctcggccgggcacggtggctcacacctgtaatcccagcactttgggaggccaaggtgggcagatcacgaggtcaggagatcgagaccatcctggctaacacggtgaaaccccgtctctactaaaaaaaaaaaaaatacaaaaacrattagccaggcatggtggcggctgcctgtagtcccagctaccggggaggttgaggcaggagaatggcgtgaacccgggaggcggagcttgcagtaagctgagatcgcaccactgcactccagcctgggcgacagttagagactctgtctcaaaacaacaacaacaacaacaacaacaaaaaacttgtcttttctcatgaggctgttccgttttgtacctttacacacaccaattccagacacaccttccccactgctgcctctacccagggctgggcttggcttcctttatctgtctagc

SEQ ID NO: 148371 - DNA, 601 bp, Human
ttcctttcctcaaaatacctgtctttcctcggccgggcacggtggctcacacctgtaatcccagcactttgggaggccaaggtgggcagatcacgaggtcaggagatcgagaccatcctggctaacacggtgaaaccccgtctctactaaaaaaaaaaaaaatacaaaaacgattagccaggcatggtggcggctgcctgtagtcccagctaccggggaggttgaggcaggagaatggcgtgaacccgggaggcggagcttgcagtaagctgagatcgcaccactgcactccagcctgggygacagttagagactctgtctcaaaacaacaacaacaacaacaacaacaaaaaacttgtcttttctcatgaggctgttccgttttgtacctttacacacaccaattccagacacaccttccccactgctgcctctacccagggctgggcttggcttcctttatctgtctagctgccttccctctactcatcttgtgctcactgcctcatcagactctgaggtgctggagggccggcgctctgccctcctagcctaacgcagtgtttggcaaatatttgtgattaaattaatgaatgaaaga

SEQ ID NO: 148372 - DNA, 601 bp, Human
acacctgtaatcccagcactttgggaggccaaggtgggcagatcacgaggtcaggagatcgagaccatcctggctaacacggtgaaaccccgtctctactaaaaaaaaaaaaaatacaaaaacgattagccaggcatggtggcggctgcctgtagtcccagctaccggggaggttgaggcaggagaatggcgtgaacccgggaggcggagcttgcagtaagctgagatcgcaccactgcactccagcctgggcgacagttagagactctgtctcaaaacaacaacaacaacaacaacaacaaaaaacttgtcttttctcatgaggctgttccgttttgtacctttacacacaccaattccagacacaccttccccactgctgcctctacccagggctgggcttggcttcctttatctgtctagctgccttccctctactcatcttgtgctcactgcctcatcagactctgaggtgctggagggccggcgctctgccctcctagcctaacgcagtgtttggcaaatatttgtgattaaattaatgaatgaaagagaaagggattccttggcacgtgtaatgctttttatgaccatggctagg

SEQ ID NO: 148373 - DNA, 601 bp, Human
aacatggaaaagcgtcccagaagcctttcccagttgctgcgtccacctagcatacacacaggatggctctgatttcatgacacttctgccaacgggaagctttgggcaatcgacagcacaaaatgaaagacaacatgtgtgcttccaggctagtggggagggacgccgtaagctgatgcttctgagacagaaaccgaagggacaaggtgccaggagctcctatactaaaaactgtttgtagcacatttatggggattaagtggttgtggtgaaaacagcctgcacgtttaatattgatgaygttttaaaaagcaatgcactgcaaatatctgttgagaaatgaatgccctttaattgttcacaaatgagtatcttaaagaaaatacccatagagaagtcacctggatagttaaaaacattaactacccagggtagaggagaaaattagattgaaactaattcagattaatttggcatcaactttaaagaaatcaaataaataaatgtccaagttattagagtgtaagaaagtgttccaggaaccttttccacagaggttcttgatcttcctgtgtggcagttagtgggaaattatgtgaca

SEQ ID NO: 148374 - DNA, 601 bp, Human
ataaataaatgtccaagttattagagtgtaagaaagtgttccaggaaccttttccacagaggttcttgatcttcctgtgtggcagttagtgggaaattatgtgacaaatttatcacatctcttgtcagctcctagcatccttgtaagattgctacaattccctatccagtctgtatctaatagagcatacataatgatttttattttaattccaaccaagttgaatacattataaaaccaaataaaattgtctatttatcaactccagagatcattagataataacaatttattgttgcaragttttgtgaaaaaattatcaaattttagatccaaactggtttagtgtagtgtattgctaaggcaaataggtggctaagaacgtagacttcctagttttgtggatgcaagcaaatggctgaatttgagggtttttgagctctggactagcccagtcctgagatttcctggttttagtggggagacttaggtaaataaggcattcaaagtgcttgtcctgttgtctgagatatgtaagtagctggtgatgatcatagatgctgacaacagatactgagaaagttgactcagagaggcagct

SEQ ID NO: 148375 - DNA, 601 bp, Human
ctaaggcaaataggtggctaagaacgtagacttcctagttttgtggatgcaagcaaatggctgaatttgagggtttttgagctctggactagcccagtcctgagatttcctggttttagtggggagacttaggtaaataaggcattcaaagtgcttgtcctgttgtctgagatatgtaagtagctggtgatgatcatagatgctgacaacagatactgagaaagttgactcagagaggcagcttgggcctggaaattcaggcaaatggcaagcccctagggctgagggaagcgtgctttargcagggcaccaagattccaatactaaggacgtggccagggtccactctctggagctggtataaactggagcttagtaatgaaaactagggaaaggcccagggtagaggtcggagctaccagatttggcaagatttctcaagcccccgtggattcagttgtgatatagagtgaacaatccccccatccgggtggctctggggacaaatgagaaacatgcaggaaccgctgagcatgtggaaggtcctgggcacatgccagttccctccttcttgctctttgtcactaactgtggtgcccaa

SEQ ID NO: 148376 - DNA, 601 bp, Human
tttttggccaaaaggagagcctgcagtttaattaatggtctacatcaaacaggatattttatgaagcaatagaaagctgtaattaaatctagccttctggatttgatacatcacaaaaccaggagataaaaacaacagaaaattggtgatagggttgaaactcaaccttgttcaagaagcattcacaatggaagctgttgacctatattctatatactttacatttcaacagatagtctatgtttgaacagtgatttttttatatgtgaagattttctgtaaagaactgtattaacatttktaaacagagtccaagaaaaattaattatgactccttttttggatttcacattggtacagcatgacctttaactcattatcttattacaactattagaagaatagtaaaaacatatttcatatacttttcaaatatttataatcatagtattctttttataatagttttcaattcttatttgatagcatgctatacaattatttttccttactaaactttcatagacatttcacttaaatgatttttctttttttaaaccatataacctgtcaaagtataaaagacacatacaagcggccg

SEQ ID NO: 148377 - DNA, 601 bp, Human
aaaattggtgatagggttgaaactcaaccttgttcaagaagcattcacaatggaagctgttgacctatattctatatactttacatttcaacagatagtctatgtttgaacagtgatttttttatatgtgaagattttctgtaaagaactgtattaacatttgtaaacagagtccaagaaaaattaattatgactccttttttggatttcacattggtacagcatgacctttaactcattatcttattacaactattagaagaatagtaaaaacatatttcatatacttttcaaatatttwtaatcatagtattctttttataatagttttcaattcttatttgatagcatgctatacaattatttttccttactaaactttcatagacatttcacttaaatgatttttctttttttaaaccatataacctgtcaaagtataaaagacacatacaagcggccgggcacagtggctcatgcctgtaatcacagcacttcgggaggccaaggtgggtggatcacctgaggtcaggagttcgagaccagcctggataacatggtgaaaccccgtctctactaaatatacaaaaattagccagcc

SEQ ID NO: 148378 - DNA, 601 bp, Human
tgagccaaaatcacgccattgcacttcagcctgggcaacaagagcaagactctgtcttaaaaaaaggatatatacaaggtacaaattatttgaattagtctatattgatctcccttttcattctctcagtttctctttattaaacctctttctcttaagaacataaacaaacaacaactactagaaaagctttaaagtccagcattagtcaaattgaagtactgtcctgacccggaaagcattatccaagaaagtgcatttcaaggccacctttcctaaaccagtctcaggaaggtccacrctctatttccctttgcaaaagcatttaagttaatgctgatatatgatttgtatttattaactcccccccgccccaaccaatgtagtcttttttaccttaacctattattgacttggtgacaagatatagagtgatcatggagctgggatccatgttcctatgtgtcatcagttagaagaatgaagaggccaagggagtcattctaatatttatatggaagaataaaggcccagaagcaggtaaatcattctaaaagaaggggtagggagtaagaggagggcttcctctaccagaaattaa

SEQ ID NO: 148379 - DNA, 601 bp, Human
gaaagactttttaaagaaaagtataagccaaaaatggattatctagattatatcagatttctgcctcatgacagataccatcagcagagttaattaagtgatgacaatgatactgagtagagccatgctactctaatcaagggtcgttatgggagttatacaatgcatattgtacaatgcatattgaagccaaaggcttcaataatgttcactgtgtgctcaacactgttgtagacacttgacatgtgttcaactcacttaatccctacccacttcatgaggcatgtgccatttttgtagrttttttttagaggaggaaaggaaggtacagagagattagataatttgtccagaatctggagctgcaggataggagacttggaaaagaaattgcaatgtctgaaccaacaagtaattaactgacatctctagaacaggaaaagaagttctgtaaatcaacaagtaaaagatagcaagtcttgcagaggaatcagcaaaggatacagatagttttcatgagaagaaacttctccaaaaggcgactaagcacatgaagaaatgtgtgtgtctggggagctttccccttctaatactaggtcag

SEQ ID NO: 148380 - DNA, 601 bp, Human
cttcatgaggcatgtgccatttttgtaggttttttttagaggaggaaaggaaggtacagagagattagataatttgtccagaatctggagctgcaggataggagacttggaaaagaaattgcaatgtctgaaccaacaagtaattaactgacatctctagaacaggaaaagaagttctgtaaatcaacaagtaaaagatagcaagtcttgcagaggaatcagcaaaggatacagatagttttcatgagaagaaacttctccaaaaggcgactaagcacatgaagaaatgtgtgtgtctggsgagctttccccttctaatactaggtcagtttctgtgtggtaacttgagaatacaatgaaacatcgtttaaagtaacctgtggcatgttactggtaccttgcaggctaaatacatcctaagtgtgctaatactgcagataccttgatccccttaggacagttgacccaagccttcccaggagctgtttacctgtgggtgtcacctggctgcaaaacagggatgaacaatgcacagatttcaggggtcacccagggatgctgcgacctcagaacacgtcacatggaagatgcctctcagttt

SEQ ID NO: 148381 - DNA, 601 bp, Human
aaagatagcaagtcttgcagaggaatcagcaaaggatacagatagttttcatgagaagaaacttctccaaaaggcgactaagcacatgaagaaatgtgtgtgtctggggagctttccccttctaatactaggtcagtttctgtgtggtaacttgagaatacaatgaaacatcgtttaaagtaacctgtggcatgttactggtaccttgcaggctaaatacatcctaagtgtgctaatactgcagataccttgatccccttaggacagttgacccaagccttcccaggagctgtttacctgkgggtgtcacctggctgcaaaacagggatgaacaatgcacagatttcaggggtcacccagggatgctgcgacctcagaacacgtcacatggaagatgcctctcagtttccatctgaaaagcctggtattaatccaataattcaatcaccaaatttagtagttgcattccccagattttcttttgggcaatccacagtttgtagaatgcttttctgtgttcccaggttcagaatttcagggattgcttctgtcttcaaggagcacttcagcttcctggttaggaagagaaggtagcagacgt

SEQ ID NO: 148382 - DNA, 601 bp, Human
tgcccagcttagatccacctgcagctggctctgaacgctggatggggctgggttggggttttcctgtggcctggggtgagtcccagcaagccaccaccatccttgcccactccccacaggacagagcatagaccctgttcctaatcctcccaggccacactccgcagaatgctgcttctctgtttccaagcgcctgcatgtcttgcatcccctgccaccatcttttgtccgcctgaaggggcagccccataaaccttacttagacatgtccctgcccccagcacaggggctgccttcaagmccgcctttgtctgtggggtttttccttgatgactgttcagcatgccggccccactttcttctgcttgcatctggggttctcccaggctgaccagctgtccccacttgctgggagtgaaggggtttcctgggatacgaactttcagtattaaaaccaggagagtcccagacaaactgggacaattggtcaccctaactgacccacaagtagaaaaatgattcattaaatgtataataatgaaaagctgtgaattatttgcatgtataatagagggagaacatggttaaataaatgtggtgt

SEQ ID NO: 148383 - DNA, 601 bp, Human
ttgtccgcctgaaggggcagccccataaaccttacttagacatgtccctgcccccagcacaggggctgccttcaagcccgcctttgtctgtggggtttttccttgatgactgttcagcatgccggccccactttcttctgcttgcatctggggttctcccaggctgaccagctgtccccacttgctgggagtgaaggggtttcctgggatacgaactttcagtattaaaaccaggagagtcccagacaaactgggacaattggtcaccctaactgacccacaagtagaaaaatgattcatwaaatgtataataatgaaaagctgtgaattatttgcatgtataatagagggagaacatggttaaataaatgtggtgtagccatttgaaatagctactacagggatgaggaaacaatacctataaaataacacagaaatgttgatgacatattaaggaagaagaagtctgggttatacatttgtgcaaactgtatgatttcaaccatatttgtacactccatgtggtagatgggttgttggaaggtaaagactggctgcataggggccctaaaggtgagagcttttcattactgctgcttac

SEQ ID NO: 148384 - DNA, 601 bp, Human
ctgccttcaagcccgcctttgtctgtggggtttttccttgatgactgttcagcatgccggccccactttcttctgcttgcatctggggttctcccaggctgaccagctgtccccacttgctgggagtgaaggggtttcctgggatacgaactttcagtattaaaaccaggagagtcccagacaaactgggacaattggtcaccctaactgacccacaagtagaaaaatgattcattaaatgtataataatgaaaagctgtgaattatttgcatgtataatagagggagaacatggttaaayaaatgtggtgtagccatttgaaatagctactacagggatgaggaaacaatacctataaaataacacagaaatgttgatgacatattaaggaagaagaagtctgggttatacatttgtgcaaactgtatgatttcaaccatatttgtacactccatgtggtagatgggttgttggaaggtaaagactggctgcataggggccctaaaggtgagagcttttcattactgctgcttacgctttcttcttaactaattcagatattattttgccaaatgcagagccaggaggtgtgaagcagcc

SEQ ID NO: 148385 - DNA, 601 bp, Human
aaaaatgattcattaaatgtataataatgaaaagctgtgaattatttgcatgtataatagagggagaacatggttaaataaatgtggtgtagccatttgaaatagctactacagggatgaggaaacaatacctataaaataacacagaaatgttgatgacatattaaggaagaagaagtctgggttatacatttgtgcaaactgtatgatttcaaccatatttgtacactccatgtggtagatgggttgttggaaggtaaagactggctgcataggggccctaaaggtgagagcttttcawtactgctgcttacgctttcttcttaactaattcagatattattttgccaaatgcagagccaggaggtgtgaagcagccttcatggtggcaccacatgtgacacagatgagtagatgggtgcagcgttgacaataactgcagtcatattgttcatcttgacgggatttctgagtaacaagtcaaagatgcagaaattaaagtatacaaattggattgggttttcagtaaaggaaaaggcaccaaatcgtttctcagtaaggcacagtaaagggaggctatcaaaacctattgttagtaaaa

SEQ ID NO: 148386 - DNA, 601 bp, Human
atattaaggaagaagaagtctgggttatacatttgtgcaaactgtatgatttcaaccatatttgtacactccatgtggtagatgggttgttggaaggtaaagactggctgcataggggccctaaaggtgagagcttttcattactgctgcttacgctttcttcttaactaattcagatattattttgccaaatgcagagccaggaggtgtgaagcagccttcatggtggcaccacatgtgacacagatgagtagatgggtgcagcgttgacaataactgcagtcatattgttcatcttgaygggatttctgagtaacaagtcaaagatgcagaaattaaagtatacaaattggattgggttttcagtaaaggaaaaggcaccaaatcgtttctcagtaaggcacagtaaagggaggctatcaaaacctattgttagtaaaagtacctattgatgatctcttaagcaaaattgttacctagttgtccacgtgaaggaaaggactctctgaaaagagggggctgtttagagaagaatcaagcctctggcaccagaggggactccccagttaggaaactgttgtaacaaaaggactccatcgct

SEQ ID NO: 148387 - DNA, 601 bp, Human
taagtatatttacatagtaaaatcaataattttttttactgtgtagcaaaatacacttacttgattcatgaaccattaagtttttaaaatctgtgtgagataatgtattctctgggtttattttgactactgaaaatttctagtcacaagacattatagctagatacattccaggtgtttttaaatgttaaactgtcttcagcatcagaaatggcctcatgaggtaagtcattattttcccctattttcaaggatggaattgaggctgggagcagttttgtgactcacccaagttaagatrtcatgaaaaattgtttccttgcaaggtctgccacaccctaaaccaatgtcctgtcccaatccacctgacttgagggctgttagattttagatgtcagaatcacatggagggcttgtggaaccagactgctgggcctcactggagtttctgatccaatgggtctggggtagggcctgaaaatttgcatttctaacacttgcagttcccagatgttgccgttgtcacaggtcttgggaccacactttgaggatcactggtctagaaggaggcttgtattagctagtgatttttttcattgtg

SEQ ID NO: 148388 - DNA, 601 bp, Human
gatgcaagagatgggctcccacagccttggacagctctgcccttgtggctgtgcaggatacagccccgtcccagctgccttcatggctggcattgagtgtgtggcttttctaggcacacggtgcaagctgtcagtgaatctaccattctgggttctggaggacagtggccctcttatcacagctccaccaggaagtaccctagtagggactctgtctgagggctctgaccccacatttcccttccacactgccctagcagaggttcttcatgagggctgtgccccacaatacacatctgcytggacatccatgtgtttccatacatcctttgaaatctagatggaggttctcgaacctcaattcttgtcctctgccaacccccgggaccaacaccacatgaaagctgccaatgcttagggctgagacctcctcagcctggattccattgtccactatcagcattttggtcaaagtaattcaacaagtctctaggaacttccaaactttcccacatcttcctgtcttttgagccctccaagtctctaggaagttccaaacttttccacattttcctgtcttcttctgagccctccaagctgt

SEQ ID NO: 148389 - DNA, 601 bp, Human
gcccttcccactggcctgcctgggctgagagcactgctggagacaccactcccagtacatgctgctctgtcctctctagttcccggtgtcctgatattgcctgatagtcatgttgagtgtcctgacgtccactctggctctccagactctgttctctgccaacttccaacctgcccctccccactcataccctctccccctactcttagcaaaccactcactctccacttccctgagaaaatagaaaacttggaataatacgcttcttcgatgtcctgcaccaggacaatcaacttctctrtctctgctcccatagcttccttctaaccccacagcagaagagttataatactgccccctgttgaaagcttattttccacctgtgctctggtccccacccctcctggcttctcaggtgatttccacctgcctaccacacccttgatgcctgtcttcagtctctccttcactggtgttctttgcttgtccacccttaaacctgcttaagttcacctgtccacgcttaaacctgcttaagttcacctcctatttaaagcagtgtcccttatccctgtgttcctctgcagctgagcacctgtaa

SEQ ID NO: 148390 - DNA, 601 bp, Human
tgtagcttgggcttcctcctagcatggtggctgcagacgtcttacaaagtggttcagagccccacaggtgtgttctataatagctcacaaggcagaagctgcattgcctttcaggacctagcctcagaagtcacactgcctcatttctgctgtattctgtcagttccaggagagtcacaagcccttcctggattcaagggaaagggaattagatgccatttcctgatgaaggtggggcaaagttttgaaagagcatgtgtgggggactcatgccatctttggatagtcccagtctccctcstcaaggacatcaactcttgtagtttgtctccagtccaaacatgtgtgggcactttccctgcatatgtgggtatccacgtgaatgtctcttcattgcttctccatctttctaaaaagtaatcacagagagtcatgaaatccagtgttagaaccaggcattgttaatgctcttatgttattattattcaagctgggctaggggaatgtggcattaataaaacaatatgtacattggatttagttatactatactctctattctaatactttgtaatcattagtaataaatagtagcatatta

SEQ ID NO: 148391 - DNA, 601 bp, Human
ttggccggataaatgtcttcttttgagaagtgtctgttcatatcctttgcccactttttgatggggttgtgtttttcttgtaaatttgtttaagtttgtttacaagtgggatgacagtgtaaagtctcccactattattgtgtgggagtctgaatctctttgtaggtctcgaagaacttgctttatgaatctgggtactcttgtattgtgtacatatatatttaggatagttagctctttttgttgcattgatcttttactattatgtaatgcccttctttgtcttttttgatctttgttsgtttaaagtctgttatatgaaactctgggatgaaaattattgtcattcagaatgtcgaatactggcccccactctcttctggattgtagggtttctacagagagatccactgttggtctgatggacttccctttgtgggtaacctgacctttctctctggctgccctttacattttttccttcatttcaaccttggtgaatctgacgattatgtatcttggggttgctcttctcaaggagtttctttgtggtgttctgaatttcctgaatttgaatgttggcctgttgtcctgggttggg

SEQ ID NO: 148392 - DNA, 601 bp, Human
aatttttagcatttttgccctggtttttcctcatcttcgtggatttatctacctttgatctttgatactggtgaccttcagatggcgtttctgtgtagatgtcctttttgttgatgttgatgctattcctttatgtttgttagttttccttctaacagtcaggcccctctgctgcaagtctgctggagtttgttggaggtccactttagaccttgtttgcctgggtatcaccagtggaggctgcagaacagcaaagatttctacctgtttcttcctctggaagctttgtctcagaggggcrctcaccagatgtgagccagagctcttttgtatgaggtgtttgtcaacccttgctgggaggtgtctcccagtcaggaggcatggtggttagggaatcacttgaggaggcagtctgtcccttagcagaacttgagtgctgtgctgggagatctgctgctatgttcagagctggcaggcaggaacgtttaagtctactgaagctgtgcccacagctgccccttcctccaggtgctctgtcccagggagatgggagttttatctataagcccctgactggggcttctgcctttctttcagagag

SEQ ID NO: 148393 - DNA, 601 bp, Human
tgcatccacctcgccgggagctgcagaccagagctgttcctattcagccatcttgccacctgtgaaagtcttttgaatggatgaatgaataaatgaatgaatgaactgttttttcactggcttcatatgctcatgcctcactaaggttgtagaaaatacaggatcttgaatactttaaagtggcaatgtcttgtgagacagacatcatccctgctgtcccaaaattacccagcgtgtgtggagaggcccctggctttggagatggggggcatttcccttgactcccacctcctcagcaccrcagggctcatctctggggacctggctttccagttagagcagacctggatcaagaagggccacaggaaagagaaaagaaagacttggcagtgggagggcagggcgttcaggcctctccagggaagggtgccaacctctggacttagcatgatgtttttaaaagaaatgaatgtgtgtcttgtctctaccttcaacttgtaaggcaagtgcagtgccagaggctggggtatctctgctgcccaggtgcactccacagagacagagcaagagcacgtgcagactgtgctgtccaactcgcata

SEQ ID NO: 148394 - DNA, 601 bp, Human
cctggctttccagttagagcagacctggatcaagaagggccacaggaaagagaaaagaaagacttggcagtgggagggcagggcgttcaggcctctccagggaagggtgccaacctctggacttagcatgatgtttttaaaagaaatgaatgtgtgtcttgtctctaccttcaacttgtaaggcaagtgcagtgccagaggctggggtatctctgctgcccaggtgcactccacagagacagagcaagagcacgtgcagactgtgctgtccaactcgcatagaaggctgacaaccacttcygtcctaatggggaaagtgaagttggcaaggcagaaatgaccacatgctcacccaaaaccttggtagcagcatgtctttccagaaattttgcaagccagatctggaaatttgatggctttgctcctctttttcctgaaagaaatggaaggaatcaggctcatgaaaagccagatttcacctccatgcacacaaccaggacccttgccttcctgaaatgccccacaggctttcacagaatagatgcagtcttagcagtgggcagcttgcttgttgtctggcctaagtctgagccaagataaa

SEQ ID NO: 148395 - DNA, 601 bp, Human
ttcctgaaatgccccacaggctttcacagaatagatgcagtcttagcagtgggcagcttgcttgttgtctggcctaagtctgagccaagataaagacatataaactgccaaggagacactctattccagaaccttctcttctttgcaaagcaaacataattttaagatcaagatgcataactcttgtaatcaaaagcttacacatttcctagcccccccaccaccctccacccccaagcaatgggttctaagcaatataaactgccaaagtggtgtgtagagggaaataaaaaccagactrgtaagataccaacttttttataccagtttcagaaagtgcttatgcagagcaagtgtgggacaatattcaattggcaaaaatatgatgaaagtagctcacttaagaaaggaataaagtcttgtttattgaaagaacagtgacaagtttttttaaattctgaaagtcttgcatatttcctgcactgtatatttacctaagtacaagtgttttaagaatgatctcttgagcctgcttaaatcaagaacgcatatttcagcaatttgaaaaaaattgcatttctttgttcatggctgttctcgg

SEQ ID NO: 148396 - DNA, 601 bp, Human
tctagagcgaactgaaccagatatctgctaaggctctgatagagaacagctggaagctcagaaaggtaaacataattcaaatattggtgaatatgccagtgcagccgagaaggtgacaggatttgaaaaatgtgccaggacacaatgagaaaggccttggaataaatacaaaaagcccaaactttattctgtaaaagtggggagctactgaaggttttaatcaaagcagggataatctcatttccaaggcaaaaaaacaaaaagaggcattccttcctaataccacatgtaggagctgttyttattctatggtggattattactttagtagtatcttataaagacagtgcctgaaggtcttttatctgtacattgatgtaacacttttcaaaagcatatcagcagacacatttttggaagcatgcattctgaaacttgaacttcaaataggagttatggctgatatcatggagtaaggtaaaacagaagctgactcctctccagtattcaaggctgactgttgtctctggaactgagaatactgggaaaagtgtgagttggacactgtgcacaactctaattaacactgttctaaagggaa

SEQ ID NO: 148397 - DNA, 601 bp, Human
ttagaaaaagaaataaaaatgcagatccatttattcacttattaactgagtacatttcctgaatccatgtgcacgttgggtgataggaagctgaggccctgctggctaaagatgtaagagaacagagcctaaaactggcacaccagctggaaattaggagggcaagtttccctagaaatgggagaaccacagataggatgaaccccaaaatctgaatataaactctttccaaatacttggctgaccaccaacttatgcaaacataagggagacttcagtaggccagcctgaaacaaagcawctgcagaagctgaaaaatttagggatttgtcagttgctgcatatcacaggagagcagagcttgtagtttgagtccaggtcagctaacttcttaccagaacaataagccaatgatcaccaggagagcacaatagaactcagaaaggctgcagtgactattatctactagctttaggccctgtcctctgatatatcaagctagtaagacatgcaaggaaaccaggaatgtgataatgcctggggctgggagattatggaaattgtcagtcacccaaaactgactctaaataggcctccatgt

SEQ ID NO: 148398 - DNA, 601 bp, Human
actatttacatagctatgttgtattaggtattgtaaataatctagaaataatttaaagtgtatggaaggatattcataggttatatgcaaatactacatcagttttggtgggggggatggagtctcactctgtcacccaggctggagtgcagtggtgccatctcagcttactacaacatctgcctcctgtgttcaagcaattctcctgcctcagcctcctgaatagctgggattacaggcgcacaccaccaggaccagctaattcttgtatttttagtagagacggggttttcccatgttrgctaggctgatctcaaactcctgaccctgtgtgatctgcccacctcggcctcccaaagtgagccaccacgcctggctcaaatactatatcattttatatcagggacttaaacatctgtggattttggtatccaaggagggtcctagaatgaatcaccagattatggtcatctcctgaggatgattgtatatacataaattcggggtgttttacaccaatggaatcatatgcccagttttataatctgattttaatttttactcagaatgtggatatcagtccaaatcaataaatatagac

SEQ ID NO: 148399 - DNA, 601 bp, Human
tgctcgactcccaccttccttccaccctcagaatttctctgtgggcctcattgtgactccgctcccctccttcccacccaggggaagccatctccacatgatggactttatctgtgtgcctcatcatgtctccactcacctctttcccatgcagggaaagcaggctccgcacagtgggctttctctgggctcctcttcttgtctcacagtctcctcctctgtggcttatgctctcaggttcctggtgcatttatcaaaccagcgctccgggtcctgctcactctcctctggctgccagtgkgcagctccctgcctcccagtgttcttaagttcagcagttataattttcatctccaatgattcctttttgcaggatgctcctttttcatgattaattgctctcattttgtcaatgcagcagactcttgtgtctcactgaaagcatgaattcaggtttttagttacttcttgtttcttgtgtactgttgtgcatggaatcattttctccagttctgctcttctgaagaattgtgctgagccctgctgccctgcctggccagcatcttctcttcatatctgtagatggacagagttgttcggt

SEQ ID NO: 148400 - DNA, 601 bp, Human
ctccacatgatggactttatctgtgtgcctcatcatgtctccactcacctctttcccatgcagggaaagcaggctccgcacagtgggctttctctgggctcctcttcttgtctcacagtctcctcctctgtggcttatgctctcaggttcctggtgcatttatcaaaccagcgctccgggtcctgctcactctcctctggctgccagtgtgcagctccctgcctcccagtgttcttaagttcagcagttataattttcatctccaatgattcctttttgcaggatgctcctttttcatgaytaattgctctcattttgtcaatgcagcagactcttgtgtctcactgaaagcatgaattcaggtttttagttacttcttgtttcttgtgtactgttgtgcatggaatcattttctccagttctgctcttctgaagaattgtgctgagccctgctgccctgcctggccagcatcttctcttcatatctgtagatggacagagttgttcggtgtagcaggtgccctgcgttctgtcatgggagacacagtgccttgttcaattctttcacttcccagttactgtattttttctggttggtggg

SEQ ID NO: 148401 - DNA, 601 bp, Human
ctgttagtgaaggggaacagaaaaatggatccataaatccttgcttacctccctcgcaggctctcttgcctgggacagatgacatggctcctgcctgctctgctctctgtcaaaacttccccaagtattgagtctgtgggcatgaccattctctagtttctatctgtggcttggaatttgtgttaatgtattggttgggtcctttcaattggaatggggagagagaggaatccataaatctgtgactcagtgacctttaggaattggaagccaaggtctatttcttatgtcttattttgtmttgtgcatagcagtgtctctcaactgtttgaatccaggcccctggagatgaatgtggactgtcagtggtgtggctttttccacctgcaccttctgcagagcagggtgcaccttgagcaccttgagcacgggcatcttctgcctgtgcacctgtgcacatgaaggagcctcttggggtcttgctgcctttggggcttttgctttcgcctccagctccttatacttctgcccatatatctcactctctgttttccagcctgtcttttctgttttctgaagtctgccctttccccttcatggt

SEQ ID NO: 148402 - DNA, 601 bp, Human
tgtgggcatgaccattctctagtttctatctgtggcttggaatttgtgttaatgtattggttgggtcctttcaattggaatggggagagagaggaatccataaatctgtgactcagtgacctttaggaattggaagccaaggtctatttcttatgtcttattttgtattgtgcatagcagtgtctctcaactgtttgaatccaggcccctggagatgaatgtggactgtcagtggtgtggctttttccacctgcaccttctgcagagcagggtgcaccttgagcaccttgagcacgggcaycttctgcctgtgcacctgtgcacatgaaggagcctcttggggtcttgctgcctttggggcttttgctttcgcctccagctccttatacttctgcccatatatctcactctctgttttccagcctgtcttttctgttttctgaagtctgccctttccccttcatggttaggtgaaggaaggggaaatagaaggaaatatttgaagaggaaaggttgtggcactgcagggtatttgtgactttatccccaattgcattcttcaagtgcagttcttggtttttagggtatctctttgagtgag

SEQ ID NO: 148403 - DNA, 601 bp, Human
gtgcaccttgagcaccttgagcacgggcatcttctgcctgtgcacctgtgcacatgaaggagcctcttggggtcttgctgcctttggggcttttgctttcgcctccagctccttatacttctgcccatatatctcactctctgttttccagcctgtcttttctgttttctgaagtctgccctttccccttcatggttaggtgaaggaaggggaaatagaaggaaatatttgaagaggaaaggttgtggcactgcagggtatttgtgactttatccccaattgcattcttcaagtgcagttmttggtttttagggtatctctttgagtgagattatctttaagtcttttgtccttattctgagaaaatcttataaagtttccctatatcttttcatagcctggatttctcagaaaacacatggagaagcaaagcttctgctaggttgctgtgggaaggggaagtataggcccaggcgggcagagtgagggaaggggagtggggcagagtgggcaggaaagtggacacatgtgggtccccacagagccctccagatcccatgcatagagcagctgctgccaccagcagcacagacatcttcca

SEQ ID NO: 148404 - DNA, 601 bp, Human
agccagggcacctgctctccaagaagggcagaggtcggcaggcatgcacagcacttaccccaaggcatggtgtcattattgctgttgctttggagcctcttatgggactggaatctgtggagaggatggagagagtaatgcatctggaatggacctcctggctccttcctatttctcatcttgatggtcacactgcacacttcccaggccgcttggccacctcactgtcatgcagccaccaggacagccagatccctgctccaagcactgcaggaggagtcctcctccagcagggtacaayctggcactgcagctgctgtgactcatgcgcatggcatcaaggcagccatgcccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggagg

SEQ ID NO: 148405 - DNA, 601 bp, Human
ggactggaatctgtggagaggatggagagagtaatgcatctggaatggacctcctggctccttcctatttctcatcttgatggtcacactgcacacttcccaggccgcttggccacctcactgtcatgcagccaccaggacagccagatccctgctccaagcactgcaggaggagtcctcctccagcagggtacaacctggcactgcagctgctgtgactcatgcgcatggcatcaaggcagccatgcccaggcccagctcttacctctggggaagatagacagctgacaggtcaggacayagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgcctgtaagtgagcaggagtctgacccccggcttttctcccagagcctgcttctggctttacagttatcactgccacactca

SEQ ID NO: 148406 - DNA, 601 bp, Human
catgcgcatggcatcaaggcagccatgcccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgyctgtaagtgagcaggagtctgacccccggcttttctcccagagcctgcttctggctttacagttatcactgccacactcatgagcagtatttccaatactgcacagcaagaggggctcccaaggaaatacatgtagacccaatctcagcttaggcaaaaagatttctttgctacaggatttgtcagaaccttaaaatgtcaatgtattggaatgtctgcattcagaagggctatccgagacattatactaatgtatgatggtctccactcatgtttttggaggcctcatgggagtagtgt

SEQ ID NO: 148407 - DNA, 601 bp, Human
cccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgcctgtaagtgagcaggagtctgaccccyggcttttctcccagagcctgcttctggctttacagttatcactgccacactcatgagcagtatttccaatactgcacagcaagaggggctcccaaggaaatacatgtagacccaatctcagcttaggcaaaaagatttctttgctacaggatttgtcagaaccttaaaatgtcaatgtattggaatgtctgcattcagaagggctatccgagacattatactaatgtatgatggtctccactcatgtttttggaggcctcatgggagtagtgtttataggcgtcaccttaggaaatgctg

SEQ ID NO: 148408 - DNA, 601 bp, Human
atccgagacattatactaatgtatgatggtctccactcatgtttttggaggcctcatgggagtagtgtttataggcgtcaccttaggaaatgctgccctagacttttctgactgtttgccagccccatcaggctttggatctcgtatcttcagaaatgctgtcagtattttccaaggtaaaaactagtaaagaaaaccaaacaaaaatccagaaatgtgctcagttaatagttctcctagtatcttcccagaatagcatgtgcatttcacccttgtcctggagataatgtctattacctgkattataatctggaaatgaattctaactccttttattatgggcatgaccttgtttctgtactcccagcctccaaccagcaagaaaatgggggtctcagtcccacagccacaaggactgggattctgtaaatgccccagatgagctgggaggcagattcctccccagagcctgcagatggagttcagcctgcccctgacaccttgcgtgggagacactaacagggagaagagctgagcctcccccagccttctgacctacagcaccatgtgatcatgaatatgtgttattctaagccactaa

SEQ ID NO: 148409 - DNA, 601 bp, Human
acaattagaaaaaaaaatacaaacaatacattatgttgtggttctcaaacgtgagtgtgcatcagaatcccctggagaagtgtattcaaacacagatttctgggacccacccctagaaattttgactcagtgtgcccgaggtggatcccaagaatttgcatttctggtaagttcccagatgatgctgttgctgctagaccaggaaccacactttgagaacactgtgttaagtcatgagctctccttttgaaaataatgatttactaagttgctgtatgtttctcaatctctactttaattrcttattttatgataaaaaatatttctataaaatgctcatagaaatgcctcttattgtgagtccagtccccattaagttgcctgtctacattgtgcttctgaatttagtcatttttccctttgggactgttctatacaccaccttattcactatttttattttcttacaaataaactttacaggaatcagcttaagaagctaacagcaattatctgcaacaagaataagtatgatgaaaatagagatgttacctgattgtggttctttattagagagtaaaggaacagagaaaggattacc

SEQ ID NO: 148410 - DNA, 601 bp, Human
taacagcaattatctgcaacaagaataagtatgatgaaaatagagatgttacctgattgtggttctttattagagagtaaaggaacagagaaaggattaccccaaagctgcattgtgcatcagctgctaagtcatggcctgcttgggcaggtacgagaccagtgttaggaaatgcaataatccagacaactggagctgcagggcactggctgtcagttacccccaaaccaaggagagaagccaaggggaagactcccctcttgggctcccaaagaggtgaatgtattagatagtcactggytagagcatccaatttagtcatctttccagaacactcacggtcagatgacatgatgatgaaatatctcgtatagaaggctgatcatctcacttgattaaaaagttgtgtgacctgatttttccatagaattggcccttaatcatgagccatttttttgtcttgtatttaatatcagtcttgtgccagttccttggaatatccaactgactgatccaatcaatgaacgagtgtttatggagagtctaccaagtgccaagcaggagaacatcaattctgtcagccagtccttggaataatcca

SEQ ID NO: 148411 - DNA, 601 bp, Human
atccaacgtggccatgtgggaggccacggcaaaggatggccaagcaccttaactgacagggttctgttcttgttcacagtggggagggtaattctccaaaattcagtcctgccactgccactggagcaagtaaggggtgtcaggcaactgtcactgtgccctgatgtgcagcgtggcatgtccacttgactctgtgacacgtctctcctcctagcccactggtagagcaggtcagagattggtcccttcttgaccatttgtactcccagtgttgatgatactacacccagatggtcagagygaggctgcaatttcagctcttaactcatgccccggcttagcactcttctctcttagtggaagggaaaccctggtagtgccaggtttatggctgcagggctgagagcaacaaaacccatccaggcagcaggacctgctggttgggctgacagccttggagactgtgttgaacctggtcagcactggctccagcagggatggggcagagtctgtatagtgaagtctaacgtggttggccttgggtgggattctgtgtgggtctcatccttttggatggaattgcattaaatcaatgcagtga

SEQ ID NO: 148412 - DNA, 601 bp, Human
tgctggttgggctgacagccttggagactgtgttgaacctggtcagcactggctccagcagggatggggcagagtctgtatagtgaagtctaacgtggttggccttgggtgggattctgtgtgggtctcatccttttggatggaattgcattaaatcaatgcagtgactcaagatgtttagttcatgaaaaacagtagctatgcttgccaagtatttgtgcctttgattaacttacttagaactaattaatcaccacttataatgtatacttttttaaacagactcctccaaaatggggargcatgaatttaaaatagagtagccctattcagatggctatgatccacttgttaagcactccttagcctgagtggcctaaaaatcggagcctggggcaaaagcttatatattaattcttgatcaagggctgccatcctagggaaggaagaggggggaaagcaagagcggcaggaaggagggagagcaattcagagcgaggaaccccaagccagccacaactccacagccaaggcactggcctcattccccagggagctctgcaaagtctagtggaatatctgtgtctcagaacagccatgg

SEQ ID NO: 148413 - DNA, 601 bp, Human
accaagggcagaagttaataaatgacaggaattattattcaaacagatttaatactttcatgtctcccaatttcacaagtttagaaaaaaagtgatgcatttagaagacatctctccctcctatttcgaagcttagctgcctaacctacagtaaagcctgatagttatgaaccttggagaacagcttctatgacaagtgaggatctaagagcctatatctcataatgatgcctctctgcattaaactaaatcaccccattctgggcaatcattgcagatcccctggtttcctgtcttggcyctggacccacactcccttccccatcaaaggtgggatggggagaagcagctgcccagcttaaaacagtgtacttcccagtcatgtgccaggcagaaccttgttggcacccacgtttctgtctctgtggctggacctgctcctcatcttgtcttcagtgcccttctttttcctttgatttctacctaaatccagctcattgtgggaccttctctggtccaaccttcttcaagtctccagctgctcttacctccatgggccatttctttgtttgaagttatcttacatttagtcgattccatt

SEQ ID NO: 148414 - DNA, 601 bp, Human
caagtgaggatctaagagcctatatctcataatgatgcctctctgcattaaactaaatcaccccattctgggcaatcattgcagatcccctggtttcctgtcttggccctggacccacactcccttccccatcaaaggtgggatggggagaagcagctgcccagcttaaaacagtgtacttcccagtcatgtgccaggcagaaccttgttggcacccacgtttctgtctctgtggctggacctgctcctcatcttgtcttcagtgcccttctttttcctttgatttctacctaaatccagstcattgtgggaccttctctggtccaaccttcttcaagtctccagctgctcttacctccatgggccatttctttgtttgaagttatcttacatttagtcgattccattctgtttagatctcagctgctctacatttgcttcacagaaattgaccttggctcccaaactatataacaagtacctcccagggacagaaacaaggtgtgtatatgcctggtattcctcccagccttctcggcataatgccaagcaaacaaaattggagtgatctccaacatacctgataattactctttatacc

SEQ ID NO: 148415 - DNA, 601 bp, Human
tacatttgcttcacagaaattgaccttggctcccaaactatataacaagtacctcccagggacagaaacaaggtgtgtatatgcctggtattcctcccagccttctcggcataatgccaagcaaacaaaattggagtgatctccaacatacctgataattactctttatacctgtagtataagaagtgttaactttttgacattaaatgaaggtgcccaaatagtgccatcagatcatgttaaaattttttcatggtgacccaaattaataatgacatcctttttcctcatggaaacccaraccaaattattatttatgattactataatttttagccattattaggctctgttatggtactgtgtggttgattaaaaatggaagttgcccatggaggtctacatgtcattgttttggccagtgcaaaatgtagccaggagcacaccacacctgacagtatcagtgattattattattattattattatttttaatactgatgaagagtttagtgactcctgatttcaagctaagagctgattaggaaaggttccattgacaactcatccctagaaaattaaaacagaagcacatagatat

SEQ ID NO: 148416 - DNA, 601 bp, Human
cagatcatgttaaaattttttcatggtgacccaaattaataatgacatcctttttcctcatggaaacccaaaccaaattattatttatgattactataatttttagccattattaggctctgttatggtactgtgtggttgattaaaaatggaagttgcccatggaggtctacatgtcattgttttggccagtgcaaaatgtagccaggagcacaccacacctgacagtatcagtgattattattattattattattatttttaatactgatgaagagtttagtgactcctgatttcaagmtaagagctgattaggaaaggttccattgacaactcatccctagaaaattaaaacagaagcacatagatattgcaatttgacttcagagacttccctttctcctagaacaatgcacaccgcaaatgagggctatttccgatggcttataactaaagtaaaatactgtgatatcgtctaatcttagaatctcttaagtgagaatttgttcaagagggctaacctagaacccagtggaaaaatccagctgatggtcacctgggtccattccctatggtctgaggagcaaatgaggcccctctc

SEQ ID NO: 148417 - DNA, 601 bp, Human
aatctcttaagtgagaatttgttcaagagggctaacctagaacccagtggaaaaatccagctgatggtcacctgggtccattccctatggtctgaggagcaaatgaggcccctctcctgagtttatttatttatttatttattttatttatttatttattattattatactttaagttttagggtacatgtgcacaacgtgcaggtttgttacatatgtatacatgtgccatgttggtgtgctgcacccattaactcgtcatttagcattaggtatatctcctaatgctatccctcccccytccccctaccacacaacagtccccagtgtgtgatgttccccttcctgtgtccatgtgttctcattgttcaattcccacctatgagtgagaacatgcggtgtttggtattttgtccttgtgatagtttgctgagaatgatggtttccagcttcatccatgtccctacaaagaacatgaactcatcattttttatggctgcatagtattccatggtgtatatatgccacattttctatgccttttgaatacttgcattattttctgccttgcttcttacctttgacctttgtaaatgggaga

SEQ ID NO: 148418 - DNA, 601 bp, Human
gcaagctgagagctgattaggaagcgtcagcccctagaggcagaggtctgccccctgactctatgagcaagagtcaacatcaagcccttcaatccttgggcctgcagttttccctgtacaggaaacacaagcgtgtgtggatgtgtgtgcatttctttagaaacacataatttgtttgttgctttattttctacctttgaaagatggcaagatcccagtcacaaaaacagaaaccaggctaggtattttaaccagagagggatttaataaaagcgttaggatttgagctgttttggaagakctgaagaagaaggagaggacaggggtcaggaaggacagttcctgcagtgtcctgccctgctgggtggccattacaaagctggcagctgtggggcagtatccctttgcccccatgtggccaggcacacggggcactggctgactcccacagccaccactgtcaggattggagctggagctgctgccacagccagaagcagaatgtccactacctccctcctaccttctgattttgcactagctccctactggtacaacctacacagaaccctgccagtaaaggaatctgagaaatgtagtc

SEQ ID NO: 148419 - DNA, 601 bp, Human
tgcctatcataaagctttagaaaatgttgtgttatcgctgcactttaaccattgaagtatttattttaaattgattcttatttaaatatcaaatataagagaaatcctatttgactatgccttttatgggacagtcaagaagataatcagtattatattaaagaatattttatgggtttaaagaatattttgggggcattttaattcacatagttcaaaagcagctgaatacatgtattaaaaggcaagctcttgataggccttgctatgtcatctacgaaaagcactcctgtttgcctcygctagctaactcagctatttgaagtacagatggatgaagcaaattctactgtttgggtttttatatttgacactggttgatacttttccaaagcaaatgttgcatttccgctggtagtttgatttcgctgtttgctttctgaaattctatgtacttttattttagtacatagaataactatgcctgcttaattccaatgagaaattatttcagataaataatcatcaacttgtttacttaaaataaaatttttgtacctcgaaaaaccaaaattgataataaaaatcctttaaaatgacc

SEQ ID NO: 148420 - DNA, 601 bp, Human
gaaggaggttaaagaattgagtaacatttctgtagcaaaactcccttcattcccactgatttatttatatggaaaaatcttcttggcccataaatttataaaaatgaaaaacagaaatagaattaattttgagccctaactcattctagtaataaataatatatccactgatttcatgacctaactagaaaaacttagactcgcttttggccatggagacatacatttccaacaaaattttacttctgcataataattatttcttaaaatttattacatcttatttttttatcaattatgrtctaaagataattgtaattataacccaagcagaaaaaatccaatatttagagacttattgccacaggaaaattttaaaaattaaatgtcaatttatatatgtaacttattgtacatagaagtatggtgacaaaacctataaaatattttctacacgaaatacattacattagaataaaagtctgtggaaatgaaaataagagctcaaagagaaaaaaattgatgtcaaatttcagactattaaagaacagtctgtttatagcaattggacacctgatagcatataatattcatactctat

SEQ ID NO: 148421 - DNA, 601 bp, Human; identical to SEQ ID NO: 40622

SEQ ID NO: 148422 - DNA, 601 bp, Human; identical to SEQ ID NO: 40623

SEQ ID NO: 148423 - DNA, 601 bp, Human; identical to SEQ ID NO: 40624

SEQ ID NO: 148424 - DNA, 601 bp, Human; identical to SEQ ID NO: 40625

SEQ ID NO: 148425 - DNA, 601 bp, Human; identical to SEQ ID NO: 40626

SEQ ID NO: 148426 - DNA, 601 bp, Human; identical to SEQ ID NO: 40627

SEQ ID NO: 148427 - DNA, 601 bp, Human; identical to SEQ ID NO: 40628

SEQ ID NO: 148428 - DNA, 601 bp, Human; identical to SEQ ID NO: 40629

SEQ ID NO: 148429 - DNA, 601 bp, Human; identical to SEQ ID NO: 40630

SEQ ID NO: 148430 - DNA, 601 bp, Human; identical to SEQ ID NO: 40631

SEQ ID NO: 148431 - DNA, 601 bp, Human; identical to SEQ ID NO: 40632

SEQ ID NO: 148432 - DNA, 601 bp, Human; identical to SEQ ID NO: 40633

SEQ ID NO: 148433 - DNA, 601 bp, Human; identical to SEQ ID NO: 40634

SEQ ID NO: 148434 - DNA, 601 bp, Human
cagcctgagcaaaaagagtgaaactctgtctaaaaaagaactgggttttgttggttctattgtcccctccccagcccttgaagcttggtcatgtatatttggatttctgccttcttcctctctcttatattaagtggcaagcagtaggctcttttccaaaggtttcaactgaacagatgtcactggtgcaatggtgcaagtacattaatgatgtaccttgaggtttacagatcataaaatgtgtggtaaagataaagcatgatctttttaaaccactatgattagtccatccttgtcactytttgagtgaacacatttgagctgtgtgttccttttagggaaaaataatatacccctgtttcccagcttgcactcatccattgtctatagtcctcatagccaggtcaaagatctgatcatttgtattcaattttaatcatccagtgaataatctctgctcttttgcacacatagtccagaggtaagtccaaggttttgatcttgatttaaaggtctaaatatagaaatatatttaggaatatagaatatagaagaaacaaatatagaagggaatatagaaaaataggatcatagaaaataa

SEQ ID NO: 148435 - DNA, 601 bp, Human
cccgaagcagctgctgttacacatcccatgagtgtacagtttagcactgctcccacagacccactgacccagctttattcatgagcaccgtagagatcatgacaacaggtaagtagttcaatgttccacatggctgtgcttatgagagatcatgaactatgggatccagtggcttccaagtcattttaattttaatatggaaatttccaaacatactcaaaaatacaaaaatagttgaatgaatctctatgcatatccctcagctccaacagttaccaactcctgatcaatcttagttttyctatactctgcctagtttccctatccactgagtaggaatcaatccagccatcatagcatttcatcttgtaatattttcctctaaagtaggaacacataggtatctctggaactatgtgtgcactatcttcaggacactgctgaaggaggagcaagaactattcctgtggttcttaaaattcaatacaagtaatcacacctttgatccacctgtggggactgatccctcttgtgggagcaaagatggggccatggtatataaaatataaatataaaactaatatcaatgtcattgtcctaa

SEQ ID NO: 148436 - DNA, 601 bp, Human
tagtttccctatccactgagtaggaatcaatccagccatcatagcatttcatcttgtaatattttcctctaaagtaggaacacataggtatctctggaactatgtgtgcactatcttcaggacactgctgaaggaggagcaagaactattcctgtggttcttaaaattcaatacaagtaatcacacctttgatccacctgtggggactgatccctcttgtgggagcaaagatggggccatggtatataaaatataaatataaaactaatatcaatgtcattgtcctaagaaaaataaccaygattccttaatatcaagtcagtgttccacttccctgattgtcctacaatgtttcaccctgtctatgtgcattagactcctcctgaagttatggattatgaattgttgatctctttgggtttatttaattcataggttcctgccctttttcatttcattccaactttgggaataaaaaaattcctggggtttttctcctgaagaatttccacagtctaaattttgttgattatatctgtaggatcctttaacacgtttctctgtcttttatattccctgtcaattggtagttagatctaga

SEQ ID NO: 148437 - DNA, 601 bp, Human
atgtgcattagactcctcctgaagttatggattatgaattgttgatctctttgggtttatttaattcataggttcctgccctttttcatttcattccaactttgggaataaaaaaattcctggggtttttctcctgaagaatttccacagtctaaattttgttgattatatctgtaggatcctttaacacgtttctctgtcttttatattccctgtcaattggtagttagatctagagcttaatcaagttcaagtttaatatttctggcaagactacttcataagtggcttagtacatttmcattgagagatacctggtagctgcttgtctcttcttttggaacattacttgccactgataatcactgcctggatttactaactcatcagaggttgccaaatgacaatattctcatcttatcattacttcttcatttattgctgcagtgcttaaataaagaccaatttctcccatcaactcttggtgacactgagatatagctcatatagggaagacaagacatatgcatcattttttcttttccaaataataaattggctccctacatcctcccaaagtgattaatgagttgagtgtgtt

SEQ ID NO: 148438 - DNA, 601 bp, Human
tcctgtaaatcatctcagttacagttcacatggatgttactcatttcatgggtaggcaaactctgtctctgcctcacttgttcctaggcttccatttgccaaggtttctggctggcctctggctttgttgaagagatagctagcactagcagggagaaatacaggtgatcagagtccaggctctctgaacatacaaacagtataactgttgttcactaaatggaaaaatcccaaaatcaaaaaccaatgcaaaacagtgaagtggcttgagctcctaggaggttaggtagaaattaaagasaatcagtggatgggtagaattttaagcagtaggtagttacccaatgtagaacgaggattagcttagacacctagtctggtggttctcagcctttcagcatttgcatacgataacttttaaggcttacttaaaaaaaaaaaacaaattatgggtaagtctacaataatgatagcacaggcacagctacagcatgacagcgtctcacaatgtcttcaggagcatccacaatcatccactgaccccagagagcatgtcaaggatgagaactgctttctgccctggccacaccctctgttttgc

SEQ ID NO: 148439 - DNA, 601 bp, Human
taatcctctcagctattcacttcctctctgtaagaggattttacatcccattcccacccattgccagatgattgacagcagtatctctctgtaggcaatatacttccccacccagtgtcaggcttggccacctgacttgattgcgcccaaggagcagaagtggcagaatatcaattcagggcagaagctttgagaggcatcatgaattcctgacagccctcttgctccttctgtctgccacaagaacagcagatcccaaatcagtgctgttccttcagggtgggtctcagaaggagagctrcagcctggagcagagctgcagcagctgacctacagctgctgtatgggacatggccaagaaaaagctgtttccccagtaaactactgctcaatgtgtctgcatgtactacagagatttgggggtatctgttcttgcagccaaatctagctaatgcaattggtcatattactagttcaactgccagagtagggttcaacacattctttggtgatgcaggggtatctgattgtggtagattaaattactgtttggagagattcacattttccctcatttccaagggatgaaaatacttcctgg

SEQ ID NO: 148440 - DNA, 601 bp, Human
atgtattgtttatagtgaatctactgcttttaaaattaaacattagatgttatatcaataatgttcacacataaacatgcttgaggcagttcccatggtggtatgtttatgtgacatcaggaacggaatttgagctttccaattccaaagggattcctttaggcccatcatcaatataaatgataccattgtttgaaatatttgcaaaatagaaaaaattaaaacctcattagaaagtgtcttactgattttttttattaccttagttgtcagggagacttctagaccttaatagctaccktcttttctataatttaatgagcagtcacacaaacaccaatattgctacagaaagggactttccagctttgggaatatctgtttctgacatttcctttcaaagggggatttttataaacataatttttcttcttccaaaagaggaaccacactatgattccaacttccatggagcccatcggggatggtggtatttcagttcaattagggtgctgtctttgttaactgttgtgtttagttgtgatctcagacttcagatttgaaatctctcttcggggaattcatttcaaaagatccagat

SEQ ID NO: 148441 - DNA, 601 bp, Human
gcagggccagcccacggaaaacacaaagcccttttttccctagctagcctctccatgtggaggaacaagtcctattgcttggtggagagccaaagccctttcctttctcacttactcttctctcactgctactgggatcctggcaaaccacacaggcaggtccatgtggcttatgacacaggagttccgagctttgcgacatgacattggcaactgctcagttatccgtgattagttatgaatctaaatgcgtgggcttcccccttttccttctcaaaggctgagcttccccttgcccttyaggagcaaaagtcttcccctttctactccagcactccttggtaggcagagaagcatttacttcttccctgcctaccctgagccccggcagtattacaaacaaaagtaaaaagtaaaacacaaggcaaaactcatcagccacacgggcttgttttattccattaatattggttgttctcttttctgggagttgtgtaggcatctaatttgattattttagttatgtgtccctctctaatagaaaagaggagtgagtttgcctgtcctttttccgtttcaagcgtctgctggggaagggcct

SEQ ID NO: 148442 - DNA, 601 bp, Human
ttatgacacaggagttccgagctttgcgacatgacattggcaactgctcagttatccgtgattagttatgaatctaaatgcgtgggcttcccccttttccttctcaaaggctgagcttccccttgcccttcaggagcaaaagtcttcccctttctactccagcactccttggtaggcagagaagcatttacttcttccctgcctaccctgagccccggcagtattacaaacaaaagtaaaaagtaaaacacaaggcaaaactcatcagccacacgggcttgttttattccattaatattgrttgttctcttttctgggagttgtgtaggcatctaatttgattattttagttatgtgtccctctctaatagaaaagaggagtgagtttgcctgtcctttttccgtttcaagcgtctgctggggaagggccttctgataccctctctggaatccttccactctatcagtgtgagggaagaggctcagcttcttcatgtatgttgctcctttgccatttggtccattcttgtgttttcagcaaaaccagtttccacaatccaaattactgtgcttctcgactgtggataaatgagaaaatact

SEQ ID NO: 148443 - DNA, 601 bp, Human
ccttgggtcctggtgtgcaggcaagctttggaccctgaataacgccagcttgctttctgtgtctaccgcactagtgggacttgtgggtccctattgtctacatctagatttagtatgctccagtttcctaatttttccagccccctcagtgctttaagttgcacatctctagttactggagattctttgtaccttcactggagcacttggaaaacagaagaaatcaaagggcagtcaggactctcccagcaggcagggaccaggtcagagtcaggatgaagacaaagcaccctgagcaagmagcaatggaagagatgcttgtgacccgagctgatggggaaggttgagggcaacgcagagaccccactgccgacttgccaagaaaacgtgcaggaaatgagggaaggctccattttcctgagaaaagggatggaggaacataggcagcatcaagctccagctactggctctttgagaatgtagtcgggacttgccccagtcacccttgccctgagaactcagtgactggggctaatgtcaccctggctgtccttgacctgtgcagaaagcactgccaaccctggacagtgggggaagggcc

SEQ ID NO: 148444 - DNA, 601 bp, Human
catggaactcaaaattttgtgtatccatacatgctaccatagtttcaggcactgggcatttcaaaaatgtgatatttagaacctttctatttccgtgatgactgttggcatagatgctgctggagatttcgatgacatgttggattcagtccacgcaagttttgatgcatattcccttaatttctgagcctttagagttagagttttagaactgagagtacattctcttcttttttcctttctcctcttatgtcaacaggctcccttccccacccccccacccacacacacaaacaaaaawtaaaaataaaacgctctcagctttgcttttaagaaatgaagaaatgttccaacatgtgacccacagctgcaatccgttcacctttgccaatactgaggctgccctctgggtccctcctgggactgcatagatagaggcccatttgctgttctgggcagcatgcccagtcatctaggaggtgggggactggggcactctttcaggccaactcaaactaatggaataaaatatcttctccatgcagtgtctcaaagaaagagccacctgggctgcaggtgaccagactcgctcagtgcagca

SEQ ID NO: 148445 - DNA, 601 bp, Human
tctcatgctagtctcctggggatgcagttaaaatgcagattctctctctagatctggggcggggcttgttcagcaggctcccaggggagaccaacgctgctgacttgtgggtcatactttgagttgcaaggttgcgtacgtggtatttgccagtgtgcacattcatgaaaaagtatcctgccttaagcctggtagatccacagttccaaatcaacattaaatacatctggtatacttaagaaaattcaacataaaaagaaatccatttcttaaaaaaaaaaaaggcagagcaaccattctytttatctgaggacctttaaaagcatctgcctttatgtgtcacagcattagctactaattactaaaggaaaaagtgctgggtgaattatcacctgaaaataaagtaactctcaaatgttataaaacataagattaatgttgacagcctctgttactatgacatattgtgtgccaggtgtgtgtgtgttataggtgcatatatgtatatatatacacacttgtatgtatctgtgtatatgtacacatatctatgtatctatatagacagatgggttatttaaatgaattttcaaaacactaa

SEQ ID NO: 148446 - DNA, 601 bp, Human
agctctgaacaccatatttataacagatggttatttataatgtctttctcttctttggcaatttaaatgaagacgtcaacttgaagaaatgtttcaccaggaagaattgcaaagagagctgaattaatcaaagaaagacgaataaagtgttcttttaatatggagtacataattgttgatggaaaacacagtcttggcagaattaaaagataatcaaagagatgaatagggcaaatagcaattcagctcattaaataaatacaaggaaactaacctctgcagtttaaccttgagcgatacmttttcccatgaatagagagtgtcgatactaggcaacaagcctctgaacagatagtgttacccggaacatcacccttttctccctttgcttcaaatcaaaaccagcatcccccatttagacagcataaaaggtatgacaaaacgggacgccaagtgagacactgttgattctgtttctatgaaattctagaaaaagcaaaactgtcatgacagaaagcagatctgggtttccagagcccagagtggggggaggggactgacttcactgagacacaaggaaacttttggggatcatggaaag

SEQ ID NO: 148447 - DNA, 601 bp, Human
gctctgaacaccatatttataacagatggttatttataatgtctttctcttctttggcaatttaaatgaagacgtcaacttgaagaaatgtttcaccaggaagaattgcaaagagagctgaattaatcaaagaaagacgaataaagtgttcttttaatatggagtacataattgttgatggaaaacacagtcttggcagaattaaaagataatcaaagagatgaatagggcaaatagcaattcagctcattaaataaatacaaggaaactaacctctgcagtttaaccttgagcgataccktttcccatgaatagagagtgtcgatactaggcaacaagcctctgaacagatagtgttacccggaacatcacccttttctccctttgcttcaaatcaaaaccagcatcccccatttagacagcataaaaggtatgacaaaacgggacgccaagtgagacactgttgattctgtttctatgaaattctagaaaaagcaaaactgtcatgacagaaagcagatctgggtttccagagcccagagtggggggaggggactgacttcactgagacacaaggaaacttttggggatcatggaaagg

SEQ ID NO: 148448 - DNA, 601 bp, Human
tttctcttctttggcaatttaaatgaagacgtcaacttgaagaaatgtttcaccaggaagaattgcaaagagagctgaattaatcaaagaaagacgaataaagtgttcttttaatatggagtacataattgttgatggaaaacacagtcttggcagaattaaaagataatcaaagagatgaatagggcaaatagcaattcagctcattaaataaatacaaggaaactaacctctgcagtttaaccttgagcgataccttttcccatgaatagagagtgtcgatactaggcaacaagcctcygaacagatagtgttacccggaacatcacccttttctccctttgcttcaaatcaaaaccagcatcccccatttagacagcataaaaggtatgacaaaacgggacgccaagtgagacactgttgattctgtttctatgaaattctagaaaaagcaaaactgtcatgacagaaagcagatctgggtttccagagcccagagtggggggaggggactgacttcactgagacacaaggaaacttttggggatcatggaaagggtccgtaccacggttgtggtggtggttataagactatatattt

SEQ ID NO: 148449 - DNA, 601 bp, Human
tttcttctcctctctccactctgttgacaggatagcttcatcttaagacttgttgtctcatcagtgtaagatgactgctaagttgtatgtgagcccacaatttcctcattcattccttgaaggaagaaaaaagatttcttcaggaacttctgacttaaaagcaatgaaggactttcccagaagtccatttctcattggcccgaattgggttgtatgcccatttctcattggttcaaattgggtcacgtgcccagtcactgacatggaggatacgatttccctaaactaatcaggcctcccrctacaactagaaggagactcagctcccacaaacatatgaattgatggtgcgggagagtgtagtgggaattctgttaggaaagagaaggaagtcaacaatcgggtacgctgtgtctaatttaagtccatgactttaaaagtgagcttttttttttgttacaaaaataatgtaggcttaatttttttttttttttttgagacggagtctccccgacacccaggctggagtgcaatggcacgatctcggctcactgcaactccgcctcccaggttcaaacgattctcctgcctcagcctcccg

SEQ ID NO: 148450 - DNA, 601 bp, Human
gaaggactttcccagaagtccatttctcattggcccgaattgggttgtatgcccatttctcattggttcaaattgggtcacgtgcccagtcactgacatggaggatacgatttccctaaactaatcaggcctcccgctacaactagaaggagactcagctcccacaaacatatgaattgatggtgcgggagagtgtagtgggaattctgttaggaaagagaaggaagtcaacaatcgggtacgctgtgtctaatttaagtccatgactttaaaagtgagcttttttttttgttacaaaaawaatgtaggcttaatttttttttttttttttgagacggagtctccccgacacccaggctggagtgcaatggcacgatctcggctcactgcaactccgcctcccaggttcaaacgattctcctgcctcagcctcccgagtagctgggattacagatgcccaccaccaagcccagatattttttgtatttttagtagagacggggtttcaccatgttggccaggctggtctcgaactcctgacctcgtgatccgcccgccttggcctcccaatgttaggcttaatttttaattttcagagatt

SEQ ID NO: 148451 - DNA, 601 bp, Human
tggcccgaattgggttgtatgcccatttctcattggttcaaattgggtcacgtgcccagtcactgacatggaggatacgatttccctaaactaatcaggcctcccgctacaactagaaggagactcagctcccacaaacatatgaattgatggtgcgggagagtgtagtgggaattctgttaggaaagagaaggaagtcaacaatcgggtacgctgtgtctaatttaagtccatgactttaaaagtgagcttttttttttgttacaaaaataatgtaggcttaatttttttttttttttttgagacggagtctccccgacacccaggctggagtgcaatggcacgatctcggctcactgcaactccgcctcccaggttcaaacgattctcctgcctcagcctcccgagtagctgggattacagatgcccaccaccaagcccagatattttttgtatttttagtagagacggggtttcaccatgttggccaggctggtctcgaactcctgacctcgtgatccgcccgccttggcctcccaatgttaggcttaatttttaattttcagagattatttgtagctgaaaagaagaaagtaattaa

SEQ ID NO: 148452 - DNA, 601 bp, Human
gcgggagagtgtagtgggaattctgttaggaaagagaaggaagtcaacaatcgggtacgctgtgtctaatttaagtccatgactttaaaagtgagcttttttttttgttacaaaaataatgtaggcttaatttttttttttttttttgagacggagtctccccgacacccaggctggagtgcaatggcacgatctcggctcactgcaactccgcctcccaggttcaaacgattctcctgcctcagcctcccgagtagctgggattacagatgcccaccaccaagcccagatattttttgtrtttttagtagagacggggtttcaccatgttggccaggctggtctcgaactcctgacctcgtgatccgcccgccttggcctcccaatgttaggcttaatttttaattttcagagattatttgtagctgaaaagaagaaagtaattaatgaaatgatacggcatacttttaaacaataaatatcatattctacatactgcagacacattaccgcataatggttaaaaatacagactttgctatcaacctcctggttcatcttcttactgtctgtgtgtcctccttgggtaaggtacatagct

SEQ ID NO: 148453 - DNA, 601 bp, Human
tgatccgcccgccttggcctcccaatgttaggcttaatttttaattttcagagattatttgtagctgaaaagaagaaagtaattaatgaaatgatacggcatacttttaaacaataaatatcatattctacatactgcagacacattaccgcataatggttaaaaatacagactttgctatcaacctcctggttcatcttcttactgtctgtgtgtcctccttgggtaaggtacatagctttcctccacctcaacttctttctctctgtaataggaatgatagtagtatctgtacaagttkctccagcactaagcctctcattcaggggtcagcaaactacagcttgcaggccagacatgcaggcaacctgtttttgtaaataaattttattggaagccatttatgtatcgtctatgactgttttcacactacgatggtaaagttaagtagttccaacagaggtcttagagctcacaaaaccaaaaacatttaatatatagccctttgcagaaaacgttcgccaacctctaggttaatacataagatctttattttcttgtcaaaatctaacatgtcataattctgtggtcattgagtgac

SEQ ID NO: 148454 - DNA, 601 bp, Human
cattaccgcataatggttaaaaatacagactttgctatcaacctcctggttcatcttcttactgtctgtgtgtcctccttgggtaaggtacatagctttcctccacctcaacttctttctctctgtaataggaatgatagtagtatctgtacaagttgctccagcactaagcctctcattcaggggtcagcaaactacagcttgcaggccagacatgcaggcaacctgtttttgtaaataaattttattggaagccatttatgtatcgtctatgactgttttcacactacgatggtaaagktaagtagttccaacagaggtcttagagctcacaaaaccaaaaacatttaatatatagccctttgcagaaaacgttcgccaacctctaggttaatacataagatctttattttcttgtcaaaatctaacatgtcataattctgtggtcattgagtgactggagatctgccagagaaaggcaattatctacagagctaacatgaaagcaagagatgctcctttattttatcacttaaaaacagtgaagaatcatgaacaactgaaaaatctacaaatgtgtttaaatgtcaaattaggctgg

SEQ ID NO: 148455 - DNA, 601 bp, Human
gtcatagctctcagcagaagtctgaagaggaaataaaagagagccagtaataaattgctgtgaatatttcttttgaaaagcaaagaaaaaagtattgccacctgtgtgtgctgaatggacagtggtattgatatgtagacaagggatcctgtcagggaatccctggagagagaagagtctgagactgacactgcccggcagccccaagtctgagttgtggaaaagccctcagtaaaaggaaaaactcatggcaacgagttggtggtgatactttcatggaggaacattgtccttgcaggaygggtggttttaatcctgaatttaaagatcttcaaaatctaaattatctagtcaaatttttttcataaaacaatgttttaattaaagattcagttttaggtcaagtgcacagtgtctttctttaaaaatatttagatgtggccatcaactatcaagaatgtttctagaatgaaatatattcagcagtgctgtgtggggatcaggaacacaggctccaccaatcagttgcctggtttcaattcctggctgatttacctgtgtactattcactcctgaaagtcctaagccttgttttccttat

SEQ ID NO: 148456 - DNA, 601 bp, Human
ataaaagagagccagtaataaattgctgtgaatatttcttttgaaaagcaaagaaaaaagtattgccacctgtgtgtgctgaatggacagtggtattgatatgtagacaagggatcctgtcagggaatccctggagagagaagagtctgagactgacactgcccggcagccccaagtctgagttgtggaaaagccctcagtaaaaggaaaaactcatggcaacgagttggtggtgatactttcatggaggaacattgtccttgcaggacgggtggttttaatcctgaatttaaagatcttyaaaatctaaattatctagtcaaatttttttcataaaacaatgttttaattaaagattcagttttaggtcaagtgcacagtgtctttctttaaaaatatttagatgtggccatcaactatcaagaatgtttctagaatgaaatatattcagcagtgctgtgtggggatcaggaacacaggctccaccaatcagttgcctggtttcaattcctggctgatttacctgtgtactattcactcctgaaagtcctaagccttgttttccttatttatagaataagattaacagaagtactaactt

SEQ ID NO: 148457 - DNA, 601 bp, Human
aggcagaatttgggagccatcagttctatctgaggctaggaaaggcttcccaggggaggtaaaatcaggactgaggaggtcaaagagccctccatgcagaggtaagagactgacaagcacaggaaactggagctgcggtcactgcagggtatcatgctctgatgcttccgcatgttagactggaggcaggatgtggggattggggggtgtcctctccagcttcgcttttttcagtgttttgtatgtagttggccaatagcagtatttgttgaattgaattgaaaagaccagtttcttggayggccagctagagatgagctgaatttttctggatcaaaaagatgttagattacaataaatgggcaaaagcaaaataatacctttggtgcttactcttaaacttaacattactctattttgtttgtgaaagtcagatttgaggatttagtttataaagaaacccttaattggttggatcccacttgcttcacccaccctgactctcatttcccccaatgtaataaatgtgcatatgtatttagaacatacagagcagtttaacataaagtactgaaattatcctaagaacagattctcagtg

SEQ ID NO: 148458 - DNA, 601 bp, Human
aacccttaattggttggatcccacttgcttcacccaccctgactctcatttcccccaatgtaataaatgtgcatatgtatttagaacatacagagcagtttaacataaagtactgaaattatcctaagaacagattctcagtgcagcaatcctatctttgtgaatttgatgtgttctaaatgcaagagcagaagtgttttaattgtcaggttttaagatattatgaaagcccctagtcacttcagtaagatcatttgattctggttaatgacaagtctatactatgcaggtttttttttttctgtctattgctactgaaatctgcttttcttatatagatcactgttacagatgaggaagttagtaatccatcctttttagatctggtgagaactccccaaatgaggaaatgcacacttattcttatgtttgcttggtaagtttgacttgtgatggatttaaaagcttgcgttaaatttacaatacatcccttccttcaaatcagcttgaagttatctcttacttgttctctggtgtctttcaatgttgctacaggttcacaagcgcagtggtgtatcaaggacttgtcatgcgcctggga

SEQ ID NO: 148459 - DNA, 601 bp, Human; identical to SEQ ID NO: 40635

SEQ ID NO: 148460 - DNA, 601 bp, Human; identical to SEQ ID NO: 40636

SEQ ID NO: 148461 - DNA, 601 bp, Human; identical to SEQ ID NO: 40637

SEQ ID NO: 148462 - DNA, 601 bp, Human; identical to SEQ ID NO: 40638

SEQ ID NO: 148463 - DNA, 601 bp, Human; identical to SEQ ID NO: 40639

SEQ ID NO: 148464 - DNA, 601 bp, Human; identical to SEQ ID NO: 40640

SEQ ID NO: 148465 - DNA, 601 bp, Human; identical to SEQ ID NO: 40641

SEQ ID NO: 148466 - DNA, 601 bp, Human; identical to SEQ ID NO: 40642

SEQ ID NO: 148467 - DNA, 601 bp, Human; identical to SEQ ID NO: 40643

SEQ ID NO: 148468 - DNA, 601 bp, Human; identical to SEQ ID NO: 40644

SEQ ID NO: 148469 - DNA, 601 bp, Human
ttcctcagtccttctcttcgctttgcagcgatattcttttccctgcccttttgccctccctctttccagccagcaggctctgagcttggggaatctcgcctgctctccaagctcatcccgatctctctgcccctctgagctccgctctttctccgcccttcttgacccacgacttcgccctttcccctcgctcctttcccattccctctgcaacaggtcctgctctctaggcaccggcttggaggctccctcgccatggcccctagaacccaggcggagaggacggccgcgctgcgggtgsggagggcgcctgcgggtggggtcaggattccgccctgcgcgcactcgctgctttcgctcagctgggaggcaggaagcgcctggcagcctcggctcacccagcatcaccccagggctctcggcgtcgccgagcatagcttccagcaaacgcagagcgtccaacttcctcactcccccacctacccgccccacaaaagccaactacaacaaccccaaccagcttcttgggaagctggttaatccctgaagagatttaagagtgtgtatgtgtgtgtgtctctgtgtgtgtgtgtctctgtgt

SEQ ID NO: 148470 - DNA, 601 bp, Human
gtttagttttaattatataaaaccaaagctacatgctgctgtccatgaggatgctgtcagcacacatttacaggcttggtaagtaaattgcttcttctagctgagagaagcatggtgcagcaatggaaaaaaggttaacagcttgaaaacttaacaaatttttatctggcttgatgttcgtggaaatgttttgtttgtgtgatgaaaatatatgacaacacttatactggctactattccctgtgcacccatgaaatgctcctaactgtggttctaacttggacgtgagacatatcccagraggttgaatttggaaataccagtattccactgcagaatggcttgttatggccccagaaactgtggaatagaatttaagtgtgggtccaaaaatactacttcttagtagtactcaacactttcatctatgtcttattcatttctgtttcaaaccttccctttagtagtatctttaaatgattaataaaaagaacaaaagctctttttttctctgatcaaggttttattttttcaagtgcctgtcttttgtctatggtgaggtttccattattatgatatgggcacttgacagatgatgttg

SEQ ID NO: 148471 - DNA, 601 bp, Human
ccagtcattcaggattccaggtcttcacttgggacagtatccccagttaggatcctgaaattgtgtgaagtctcatgtcataagcaatttggcaaatgctcacactgcaatgcagtaaacctgattttaatgctccttaatactcatagaattaatttttctcaattacataatgcatcatgatatattggcatataatccctatttttataacattagaaagccttttgtagaccttatccttatttccagatcccagaatgattttagctaccttatattcttagcaagttagaagacrttgccaagcagtgtaataatgtagtctagattgtgaactgattttaatcctaaaatagttgcttacatctatgtgacctctggcaagtctcattttcaccaaaccaattagcatatggatcaaatgaaatccagcacatttaaacatcccataaactgcaaatcgcaatacacataaaagcaataaagttaaagtgagggcttctctgttggtggatagaacttctgggaaggggcctctttccattttaagactgaagatctttcaaattttatgtttgccttaaatacttctaatgcc

SEQ ID NO: 148472 - DNA, 601 bp, Human
agacagcattcttgtttgctacctttgacacaaagtagcacttcttcatatttgttccaggagtacctagttcaggtttcatcctaatattttaaaactcagtgaacatgtctgagatcaacaaatccatcctgtatatgattttatagaggataggggaaaataattatactaaactggcaatgcttaaagacagtgagcaagataagagagaataaaatttacaggaagaaagcaaggcaactgaaaatgaggtgattatcactaacttttaagtttccatgaaatgtataataaaatmcaaaataataattacaataacaacggtggctagttttactgaatatttacgataatccaagtattgggctaagcagtttacctccattttctcggcttatgctcacagaagtcttagacggaagattctattattctctccattttagaggtaaggaaactagtcccatagcttttcactgataaaatcagggtaagggcctgtgttcagtcggcctcagacagtctgtaccatgccagacatcttccagaaatggtcctcattgatcttaatataaaggatccaggctgaaggccttgc

SEQ ID NO: 148473 - DNA, 601 bp, Human
gtctgagatcaacaaatccatcctgtatatgattttatagaggataggggaaaataattatactaaactggcaatgcttaaagacagtgagcaagataagagagaataaaatttacaggaagaaagcaaggcaactgaaaatgaggtgattatcactaacttttaagtttccatgaaatgtataataaaatacaaaataataattacaataacaacggtggctagttttactgaatatttacgataatccaagtattgggctaagcagtttacctccattttctcggcttatgctcacagmagtcttagacggaagattctattattctctccattttagaggtaaggaaactagtcccatagcttttcactgataaaatcagggtaagggcctgtgttcagtcggcctcagacagtctgtaccatgccagacatcttccagaaatggtcctcattgatcttaatataaaggatccaggctgaaggccttgctacttgctgcttctgacaataaataatattgctttccactcacagtactggagagcttccttcttcactctttcatggtgaagactgatggcccctttaggggctcaga

SEQ ID NO: 148474 - DNA, 601 bp, Human
gaataaaatttacaggaagaaagcaaggcaactgaaaatgaggtgattatcactaacttttaagtttccatgaaatgtataataaaatacaaaataataattacaataacaacggtggctagttttactgaatatttacgataatccaagtattgggctaagcagtttacctccattttctcggcttatgctcacagaagtcttagacggaagattctattattctctccattttagaggtaaggaaactagtcccatagcttttcactgataaaatcagggtaagggcctgtgttcagtyggcctcagacagtctgtaccatgccagacatcttccagaaatggtcctcattgatcttaatataaaggatccaggctgaaggccttgctacttgctgcttctgacaataaataatattgctttccactcacagtactggagagcttccttcttcactctttcatggtgaagactgatggcccctttaggggctcagagctgcctttgccaagcctcggctggctttctggagggaagctttctatttcactgccctttgggtctattctggtctttctctttctttttttttcttttttc

SEQ ID NO: 148475 - DNA, 601 bp, Human
gattataagcacctgccaccacgcccggctaatttttgtatttttagtagaaacagggtttcaccatgttggtcaggctggtctcaaactcctgacctcaagtgatccaccgccttggcctcccaaagtgctgggattacaggcgtgaaccaccacgcctgacctaaaaaatatttctggcaaacagctgggcatggtggcacatgcctgtggttctagctacctgagagactaaggcaagagaattgcttgagcctgggaggtcaaggccgaagtgagctgtgattgcaccactgcactycaacctgggcgacagagtgagaccctgtctcaaaaaataatatctgtcatgttaagctgttccatggaattacattgtctttttataatgggcacactaatgaaagaatgaacactttcctaattctattctcaggcaaattaagactagtttcttcatgtccatatgaccttcattgctatggttgcttgtactgcacatttcctgttaaacgggctttctcattgcatttggagagctgcgtagtattcccaaaatcttctaggtatgcttgtaattggcagtcattccagttttttg

SEQ ID NO: 148476 - DNA, 601 bp, Human
aagagtaacatcactcactgtgtcccgacagacaggcttttaaatttctatgccaattagattggtaaaattatgctcttctttttttttaagtgtttcttaaggttaaaaatctgcacattttatagacaaagtatcccattgaatttctgtaatcattgattagttaatggtttaccttggtttatggacctttgaacatttttttgcctatttttctttaagtaatttgtaaatacatagtataatgaccaatttttgtttcatatatagcataatatacctatcatttatctgggtrtgtcaatatagattattttgaaagaaactaaaagttggtgtacaatattaattaaaaatgtggtcttcatgagaaaaagtgtgagctttgtaatttttatgagtaggtgggtactattgtggattaatcgtaacttttttgttaaatgatagatctgagtgggacatacttttgaaggatgtgcaatgttcaatcataagtgtgacaaaaactgacaagcaggaagcttatgtactcaggtaagtcctgtaaaacaagtgttaggtagctaatttcagtcctaatcataatgtgaaacag

SEQ ID NO: 148477 - DNA, 601 bp, Human
actcaggtaagtcctgtaaaacaagtgttaggtagctaatttcagtcctaatcataatgtgaaacagttaagttcctctcagttgtagttctgggggtttttttgttttgttttgtttttttgagacggagtttcagtcacccaggctggagtgcaatggcgccatgtcagctcactgcaacctccgcctccttggttcaagcaattctccggcctaagcctcctgaggagctgggattacaggcaccttccatcatgcccggctaatttttgtatttttagtagagacggggtttcaccrtgttggccaggctggtcttgaactcctgacctcaggtgatccatccacctcggcctcccaaagtgctgggattatacacgtgagccaccgcgcccagccttttttttacattattcttaaaaatatggtataaaaggaaacatttagtgtaacgtggatgtttctaggacataggttttgaagcctcaccggacagttcaaggtgtttgccgtcttttcctcccaattggtaaagaaggacctcttaattagaagttcaggcaaagggaaagttagcttctctatacaaatacagttgtc

SEQ ID NO: 148478 - DNA, 601 bp, Human
tacttgcttttcttgtgggttttttggtttgttttagacaggggtctcattctgtcacccatgctggtgcagtggtgtgatcacagctcactgcagcctcaacatcccaggcttaagtgatcctcccaccttagcctcccaagtagctggggctacagatgtttgccaccccacctggctaatttttttttaatttttagtaaagacaaggttttgccatattgcccaggccggtcttgaacgcctgggctcaagggatccacctgccttggcctcccaaagtgctaggattacaagtgtragttactgcacctggtccatatttactttgacttagatgttttgggagtacagtagtgatctttatatagcttgtaattcaaaatatgcagaatttataaagaacattaaaatatcagataaaatatttttagttaagattaatagcttattgcaaattatgtatacacatgtaaaaataattgtgtatcataaatcagtgctgtttaaatgatggaattttaaaatgtagaattgatcacctgccacctctgatttttcatacagcatagagagagttcatcttcatctggccattcac

SEQ ID NO: 148479 - DNA, 601 bp, Human
ttacctactgtttccattcctttcactgatgacatttcttttttcttgagatggcgtctcgctttgtcacccaggctggagtggagtggcgtgatcttggctcactgcaacctccgcctcccgggttcaagcagttctcctgcctcagcctcccaagtagctgggattataggcatgtgccaacacgcccagctactttttgtatttttagtagcgatggggtttcatcatgttggccaggctcgaactcttgacctcaagcccacctctgcctccctgccaaaaggggtgggattatagrcatgagctactatgcccagtccactgatggatgacatttctaataagtggcaaatagtatcattctgcttattgtggaagggtagtaacaaaccatcctattaaatggatgtgttatatttattttgcgttctcttccctcaacagatggagcagcatattgtatgggacgtatgaattctgactgttggtatgtttaatgcaattttgtggatttttgttgtcctatgtaagatttaaactgccaattgtcatttttaggaactatttttaatttttatttaggtacttatatactctg

SEQ ID NO: 148480 - DNA, 601 bp, Human
ggtgcggcctcgcgggccttccaggctggcgcgcctgtggggctctccccgagcgcaggcccctctctctttgccttatttatttttggaacataacctgccgcctttctagacggctcgaggggcgggctctttgcacttggaagcaggctgatgggcgtgagtgtccggggctcgtccacccggccggacgggctgggggctgtggcgccacatggctcctttttcctgggaagcgccagggggcagtgggaaccgccaccggggccgctgtagcgggccttaaaggatgggaaaccttgatcacagatgccccccgccggccttccttccaccagaccagtgggagagggaccgcaggggcatcaggcctttctcaacatgcgactcttaatttgggacggacagaacagccgtacagaccagtagttctcagcgcctttgcttaccctgggttgctcagaagacttactggttactggttccttcttcccttttgaaggacttaaaggagaagaaggaagttgtggaagaggcagaaaatggaagagacgcccctgctaacgggaatgctgtgagtgtctgctttgctcctgagccc

SEQ ID NO: 148481 - DNA, 601 bp, Human
gtggggctctccccgagcgcaggcccctctctctttgccttatttatttttggaacataacctgccgcctttctagacggctcgaggggcgggctctttgcacttggaagcaggctgatgggcgtgagtgtccggggctcgtccacccggccggacgggctgggggctgtggcgccacatggctcctttttcctgggaagcgccagggggcagtgggaaccgccaccggggccgctgtagcgggccttaaaggatgggaaaccttgatcacagatgccccccgccggccttccttccaccrgaccagtgggagagggaccgcaggggcatcaggcctttctcaacatgcgactcttaatttgggacggacagaacagccgtacagaccagtagttctcagcgcctttgcttaccctgggttgctcagaagacttactggttactggttccttcttcccttttgaaggacttaaaggagaagaaggaagttgtggaagaggcagaaaatggaagagacgcccctgctaacgggaatgctgtgagtgtctgctttgctcctgagccctggcagctaccgccccacaaaatttttcctgttcta

SEQ ID NO: 148482 - DNA, 601 bp, Human
gccccccgccggccttccttccaccagaccagtgggagagggaccgcaggggcatcaggcctttctcaacatgcgactcttaatttgggacggacagaacagccgtacagaccagtagttctcagcgcctttgcttaccctgggttgctcagaagacttactggttactggttccttcttcccttttgaaggacttaaaggagaagaaggaagttgtggaagaggcagaaaatggaagagacgcccctgctaacgggaatgctgtgagtgtctgctttgctcctgagccctggcagctacygccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcatgatggagcctggagggtgttgactggagaagggtct

SEQ ID NO: 148483 - DNA, 601 bp, Human
tgagtgtctgctttgctcctgagccctggcagctaccgccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcaygatggagcctggagggtgttgactggagaagggtctctggggtgggcttggcttggctgggctgtagatgcagccgccagcctctggtgggaggccgggcatcaggagcaacgctctgtccagcctggggccagctggtaatgacatggcctgttttctgtcgaggagaatgaggaaaatggggagcaggaggctgacaatgaggtagacgaagaagaggaagaaggtggggaggaagaggaggaggaagaagaaggtgatggtgagtagccttgtctatcttccccttttcaggtactt

SEQ ID NO: 148484 - DNA, 601 bp, Human
gtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgaatacatgtgggggtgaggctaacatgttgaaactggaaaaatgtaatgatttaacacaacaaatcacactccaagccctgcagaggcacatgtaaaagaaatycccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggataaaattacctcttctccactgctatcatcttcttcatcttctgacatttcctcatcttcactatcttcttctacctcctttggaggaggagccattttcttgggg

SEQ ID NO: 148485 - DNA, 601 bp, Human
ctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgaatacatgtgggggtgaggctaacatgttgaaactggaaaaatgtaatgatttaacacaacaaatcacactccaagccctgcagaggmacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggataaaattacctcttctccactgctatcatcttcttcatcttctgacatttcctcatcttcactatcttcttctacctcctttggaggagg

SEQ ID NO: 148486 - DNA, 601 bp, Human
aaaatcccgtagttttatcaggcaatgtgtggaagagtaaaactttcattcagttctcaacgagaaacctgagcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgaacacatgtgggggtgaggctaacatgttgaaactggaaaaatgtaatgatttaacacaacaaatcacactccaagccctgcagaggcacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggataaaa

SEQ ID NO: 148487 - DNA, 601 bp, Human
taaaatcccgtagttttatcaggcaatgtgtggaagagtaaaactttcattcagttctcaacgagaaacctgagcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgactacatgtgggggtgaggctaacatgttgaaactggaaaaatgtaatgatttaacacaacaaatcacactccaagccctgcagaggcacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggataaa

SEQ ID NO: 148488 - DNA, 601 bp, Human
ttaaaatcccgtagttttatcaggcaatgtgtggaagagtaaaactttcattcagttctcaacgagaaacctgagcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgmatacatgtgggggtgaggctaacatgttgaaactggaaaaatgtaatgatttaacacaacaaatcacactccaagccctgcagaggcacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggataa

SEQ ID NO: 148489 - DNA, 601 bp, Human
cattaaaatcccgtagttttatcaggcaatgtgtggaagagtaaaactttcattcagttctcaacgagaaacctgagcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatcagaatacatgtgggggtgaggctaacatgttgaaactggaaaaatgtaatgatttaacacaacaaatcacactccaagccctgcagaggcacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttggat

SEQ ID NO: 148490 - DNA, 601 bp, Human
acattaaaatcccgtagttttatcaggcaatgtgtggaagagtaaaactttcattcagttctcaacgagaaacctgagcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatatgaatacatgtgggggtgaggctaacatgttgaaactggaaaaatgtaatgatttaacacaacaaatcacactccaagccctgcagaggcacatgtaaaagaaatccccagatctcgtcttacactcacattcaaatacttagccaaatgacatcttgacatgtcaatgaagagcttgtgaaacactcaaccactacaataagacatacctgaataaaatcttatttttgccacagatatccaatttcatgtcttaactctccattttgtagttttaacataattctgcattaagttgga

SEQ ID NO: 148491 - DNA, 601 bp, Human
aattgctatgtgtaaattattcagaaccttacacataggaggctccaagcattaacttattaaatcatttggggctcctacagtgggtggcggtaccaagcccagtgaagctcaattcttaggacctgagacaaaaaatgaataggctaaatataaatattccttacaaaactatcacacatcaaagagtgtgcatggtagtttgataaaagtcatcatttagctacattaaaatcccgtagttttatcaggcaatgtgtggaagagtaaaactttcattcagttctcaacgagaaacctragcacaattcagtgctcagctgtctttatagtgagcaaataaaaggccaggagtgctaaagagggtcaatggtaacacaaagagaggtggcagccctcagtctacaccagagataactataaaacacagtgagtagtattacaaagtttatatataatggaatggagaccaattaattttaattggaggctaggaaaggaatctggtaaggttatcctcaggatctgaatacatgtgggggtgaggctaacatgttgaaactggaaaaatgtaatgatttaacacaacaaatcacactcc

SEQ ID NO: 148492 - DNA, 601 bp, Human
accacaacaacccagagaattcccacaaggattctaatctcatctccaggttgtcgtggaaggaatatgttgatcccagaatctcaagataccttgtaatcagaagcccagtaactaccaagacaactccttaccatcttcctcatcgtcatcgtcatcctcatcatcttcgtcatcctcatcgtcctcatcctctgaggcaggggcagcagctgctgctttcatcgctgctggttcaatttcatcttcatcctcatcctcgtcctcgtcatcctcctcatcctcctcactgtcatcatcytcctcttcatcactgtcttccttcttggcattcttgccattctttgcccccttggctgggatggcagcacccttcttaccaggagttgctaccaatgctttgcctggtgtggctcccttcttgccaggtgtggtaactgctttggctggtgtaactgtcttcttggcaggtgttgctgctgcctttttgcctggagtgacagctgctttcttggctggtgtggcaactgcaaccttttttgttggggaaacgaccaccttctttgctgaggttgcagcagccttcttgcctttcttctga

SEQ ID NO: 148493 - DNA, 601 bp, Human
gatcacttggggccgggcgcagtggctcacgcctgtaatcctagcactttgggagaccaaggtgggtggatcacctgaggtcaaaagttcgagaccagcctggccaacatggtgaaatgtcgtctctactaaaaatacaaaaattagtagggtgtggtggtgggcacctgtaatcccagctactcgggaggctgaggcagaactgcttgaacccaggagatggaggctgcagtgagccgagatagcgcgccattgcactccagcctgggaaacagcaaaagctccatctcaaaaaaatttaaaaaaaaaaaaaatcacttagaaacaaaatcctacattataaaaaacactaatagaatgtgctattgaaattttctcaagaggcacaaaaatcattcatgggtaattaagtctagcacaccacaacaacccagagaattcccacaaggattctaatctcatctccaggttgtcgtggaaggaatatgttgatcccagaatctcaagataccttgtaatcagaagcccagtaactaccaagacaactccttaccatcttcctcatcgtcatcgtcatcctcatcatcttcgtcatcctcat

SEQ ID NO: 148494 - DNA, 601 bp, Human
gggtggctcacgcctgtaatcccagcacttcgagaggccgaggtgggtggatcacttgaggtcaggagttcaaaaccagcctgaccaacatggtgaaatgccatctcaactaaaaatacaaaaattagccaggcatggtgaagtgcacccgtaatcccagctactcgggaggcttaggcaggagaatcgcttgaacccgggaggcagaggttgcagtgagccaagattgcgccactgtactccagcctgagcaaaagccagcgtccgtctcaatacataacaaaaacaacaaaaaaacttaactaaaaattattctgtgctataccaagttacgactgattatggaaattgcaacttaggggatctacagtttaattctaacttagttcactaatgctaatccttgaagatgtttacagtattcatgtttaacagtggcaggctaaagtaactgtgctaacaggggaaggaaaagcattaacagacccacgtgtatgtaacgtgcagtgaagcacttacctagtcataccaattctgacatccacaacagcaagatcatttttagcaaaaacatcgctgataccagtttttaattcaggag

SEQ ID NO: 148495 - DNA, 601 bp, Human
ttagacctctaagacatatatagcctataactgatgatacaaaggtattatcttaccctttagatttgccattttggttctggggtactttgataaaagttgctttctcaaatacttcctgaagagtttcttctgttgcactgtaggagaggttgcttaaaaccagagtttttgattcacctgcaaatagagatgccacattcctaagactctgaaacagtggttcccagcttcggtcacaacagtaatatcttattcctaagaatttcagtgcttgagttaatatacaaatactcatgaygtaagctaaatccatttctgttactcaacatattaagtacctagtacgtgttgcaatgtcctgctggttgttcttacataggctgatgactggtctgttttcctagaatcatctgagttcaaaacgcacatggtcaagtcatttaaagtataaaacatgcctacaaaggaagcttgatttgcctactgtattccaatgcaaaatgattttagagctctcattcaagattggaaattactattccaaataagagtatgacttggggtatcatgtccttgatcttcacctacatttgagtaa

SEQ ID NO: 148496 - DNA, 601 bp, Human
ggcctccttggcagctttggcatcctcctcactgttgaagtctacaaaaccaaacctagaacaccaaatgaaattgcccattataaaaagcacctactacacatgtcccaagttaactgtacatgctggggagccatcccacagaaagtagccttgtttatttgggaaaagataccagtgacagagtagctctctatggaaaactaactggtgtgacagcttgaaccccagaatgtctcacaatacagctaaatatacctctgtaaagacagaaggtaaaataatgctagttctgtgaatkctctcttcttctcgtgcgaatccataaactgccactgatagacagaaaggagctcaatgagaagacacattagactcaaggtctgcacagaacaaaaaccccttcaagtggaagcagcactcacgcttccttcccttaccctttggaggacccagtttcccggtcagtaactatccttgcccgaacggagccgtcaaatgactcctttaatgtctcttcagtggtatcctcagacaggcctttgacaaacagagttttggatggctctgggaaggaaaaaaaaatgtgactttatgtgaa

SEQ ID NO: 148497 - DNA, 601 bp, Human
ccttggacaagcccttcttgttggctcctttgtatttgcgcgcgttggggtgctcttgcagaaggcgagcccacgctgcccgcgacttggtgtccacgcgcaggtcccggagcagtcgcgaccggtcgcccttgagattggcgcccccgcccccgggagccttgtcgcccttcttctgaccgccgcccgcagcctgcggctcggccagctcctctgccggcggggttcgcgggacctgtccgaggaaagagcgggcaggtgaagggacacgcggctgcagcacgggggactctgatgctcyagccccacgcgcccgccggcgcggggtgtccctcccaagcccagagccgcccccaccgatgccggccagcttggccccgcatccacctgccacgcggccgccttcgccgctccctccggaagccccctgccctccctttgctgctcgccgggcaggccacactggggtagggggctgcgcatgggccgatgttctccggaggctggagaagtggacccccgaatccgcgcttcgagggctccccggctctcgcccacgcgcatctcggaggagacagccgcctgccttccctctctcctg

SEQ ID NO: 148498 - DNA, 601 bp, Human
aaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcrgctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggaga

SEQ ID NO: 148499 - DNA, 601 bp, Human
tgttttgctttgggtgctgacctttaaaaaattagagcaaaatgaacgtgaacaaaaagaaaaggagaaatgtttcgagctggggcagagggagcagagaaggagccctcaccgcggccggaatgcagagcggaccctggcccaggactgggtttccctttaggctcgggcctaccctggccctcgctgttggaatctccaggaggtaaagcgacctcgatttttgttgcccgcattcccgggcgtgagtgtccttcccaggaggctcaggaggccgtttctgttgcattctgagcctccrttgcaaaaactgaagcccgtgggtctcggcaggcctcctagctcgctcgccccgggacaggccctcgcctacacccctggaagtaaggagccccgggctctttcgtccttttcggggtgtggagcccctggggccctagaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaag

SEQ ID NO: 148500 - DNA, 601 bp, Human
ggcccaggactgggtttccctttaggctcgggcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggccctwgaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcag

SEQ ID NO: 148501 - DNA, 601 bp, Human
gaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacctgcgtccctcgggcccggggcagctaggaggtcggcgcgcagcgggccgggtcaggactgggtcgagcagacagagctgcagcccccgccttgcccrgcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagc

SEQ ID NO: 148502 - DNA, 601 bp, Human
actattgttatttttaaaattaaagtgttaattaagttaacagtttaatactccctttgttttgcgggaggaagcatttctaagtccctataaaccgcttcaggcacttgttggactcttgaaccttagaggaaaagaatccctccctttctaaacggccaaatattaccctctccctgacactcctccagggtcggtggccaccccaggcttgaggggattccagggaaagttctcttgaggtggggtccatggggggtggggggatacagcctagagaaatcagtcagattcttaattwaaaaaaaaatcaggctcaaagagcactggaaaaaaccgggaggaagagatccacacaggaccaagtgtgtggaggccagtcttctagggagaaagggcttaggaaatggagggagcctgtcccaagctaacccgacagggaaccgacaacttgcgtcgctcccctctcccttgcctagtcccgaaccactttgcggagaaaataattttttcctaaaagaaataatttctctaaagcgactcaccaagcattttttaaataggtaaagcgaaagttggccaattaccactacccttatta

SEQ ID NO: 148503 - DNA, 601 bp, Human
cttttttaaattattattattctgaaagattttgacactgggtaaggcccacaccctgtggctctaaagccggcccaagggacctaaagaatttagcatctaaaccacaagtagcaagcaggagaaagagctttgttattgtgcctgcccaccccacactcactcctagcagcatcaagctcagtcccctgatcacttgcctgggatgcagaagtaagcggcacacagacatctgagtcaaggtcaccaccacctttagctgagaccaccaagtgagtgctagccacttggaagagaggcmgtgctttctgaagggttgtgcattttcaactctggagaagcagggctgctctggaagtgggcagtgggaatccagcacccatgtgaccttagctatgccttgtcagaaaagggcagggtgaggaagaagagaagattcaaaaggaaggtgcaactgggaccctcctcaagcttccatatccctgtcctccttctctgcttagaatttgggcccagtcggttgttttggtcttgagtaggcagaactgtctcaaagagacagaggaatctggcatgggctgaatatgagccaaagcttcta

SEQ ID NO: 148504 - DNA, 601 bp, Human
aagcttctagaaagagtgagcagaacctcttgactcagtttccagctcaataataggctgattttaactaaggagatcaaccttctggtcctacactttgccctctccttatcagcgactcagaccctcagtacagagtcctccatttcacttgtggaaagatccctgagggtgcattagtcagcagtcatcctttggtaacaaaatagtaaaacacttttcactaattgatatatatagggtacatgtatacacatgcatatattgtctgctgctagtgaattgttctgacatctttttytgaagtcatgtctgctcatattgttttctaatagttttggattaaccacaaaaacagaagatatttgcattgagataaattttgagctctctagccctgttacctgtttaattggctactgtatcagtttctagcttcaccatatggacacatcacattttacacgcataggactgtatcccaataactccacaggattgtgcgattactgcgggttgtcagatttgaaccaacttctacttagattgtcttttgcttttatgcagtgaacagaattggaaaatcaagatctctgatgtt

SEQ ID NO: 148505 - DNA, 601 bp, Human
tttatctgtagatttcctctttcaatggctaatgtttttacagaaaattgcattaggtaaacatctaatttctcatgcatctcagataaatatttctaaagaagtgactacctttattttttcagttactatgctaacagtctgagcccatattatcatttagtctgacagtccatcacattaccttcctggtcctgtttacatggtgagcatttctatattttgctcaagacttgagctcttcctttttcaccctcatcttctctaggccttgccctcctaaactctcaccttccaggawgggctgtgtttctatgcacctgggccgaggctagtctttaaggcaactctcaacttgctgataataaggttggcttcatacaaaagcaaaagtgaggtaataggagagtgaagaataaatgggagagatttatctgatagataaacgggctctcccagaaagtggcagaaagaggtagactcaagtactgaaagcagaaagaatcgttggtgggagggcggtatggtgtgaatcctgacccaaaagccagctcttaacggaaggaacttagtggcctctttctctggggccaagtcgctg

SEQ ID NO: 148506 - DNA, 601 bp, Human
caagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtccgggactggccctcttgaagtagcctgggacgtcccagccccttctcgatctggccctgctcatgcccaaggccctcgcgttttgcaggcccaggctcggggctccagggcctgcggccgggcaaggtcgcrcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctggga

SEQ ID NO: 148507 - DNA, 601 bp, Human
aagaccagaagaaccaacgttcatttttagaggagaggaattggctacagctggaggaagggctccagaattccaaatcttggcatgtatgatcttgggcaaagccatgagtttctaacgcaagtgcgaaatgtggagatcacactgttagaacagtttgaggaatctgagttcatttcccatgctcccctcacctacttctgaggcaggtggatttacagcagggttgattccataggagcagggccacagcctgaaccacctggaaaggctgccacctaaggcctaccctccaggcctmcagctgatacctactaacacccccactccaggctgatgagggcctaggatctccctcagaggagggccagctgcagccccacactgcagggaagccagacacctgggcacatgcacacgcacaatatttaatatggctttcttacccttgatgtgtataataagctctggaaagtagtgttatgaatatgttgtcagttatgaatgggaatgctctgtgaatgattaagatgtctaattgaaatatttccataatatactaatcctttctaaaaatactcatatgcatatttgtgtttgg

SEQ ID NO: 148508 - DNA, 601 bp, Human
acgctgtctttgcaagaccaggtatgaccacactgaggccttgggagaaagagagctgggaaagaagcagtagcactcagccttataaaacttcctctatccctgggtaaaccacccaaggcaggcatccattcttaatagcagtgaggaaactacttgtttttacttgcttcttcctgtgggttcaaaatatctacctatatgatccttagtaagaaacgtaattacattatttcagaaaggatgggtccagtctgtgaaaacacacatacaagaacattacctctttttgtttgattgraacagcaaatataatctcaaattttaaaattgtaatgattttctaaaactgttgatgaaacaatgttttactaagaacattggaactgagagaagtagaaggtggtaagagtatgccctcatgagatttttcagaactgatgttattattttatattcccagctttatattctccattgcgatgctcccagttttggtcattaattgataagcatgtaagaccaaagggcacagtgcacacctcctgtaggctaggttcttccttgattcttcatgtacttttagacattttgtaaacaa

SEQ ID NO: 148509 - DNA, 601 bp, Human
gtaattacattatttcagaaaggatgggtccagtctgtgaaaacacacatacaagaacattacctctttttgtttgattgaaacagcaaatataatctcaaattttaaaattgtaatgattttctaaaactgttgatgaaacaatgttttactaagaacattggaactgagagaagtagaaggtggtaagagtatgccctcatgagatttttcagaactgatgttattattttatattcccagctttatattctccattgcgatgctcccagttttggtcattaattgataagcatgtaaraccaaagggcacagtgcacacctcctgtaggctaggttcttccttgattcttcatgtacttttagacattttgtaaacaaataggcattttgcttaattccgtggttgtaaatgacattcaggggaagaaaaagtgtgtgcagtgaaacattgtattgtactgagacccagaaattttgttgataggaatattagaaatgctaacatttttctaaccttaaaggaaagaaagaaaataaagtgttcccaaccattggctgttaccagtgcattcacaggaattaatgacaaattttccaa

SEQ ID NO: 148510 - DNA, 601 bp, Human
agggctgcagtgaggaggtggcttgcaggcatctaaaggcagcagaagattgaacttgcacatctgagcacagatatatgttggacatcaaaagaggaaattgttaagcaatttctcacatctttaattacatgccaatttcattgacatgagagttgggtggcactgccacccaacagaacttagtctttaatttgcagtgtaataaggatggaattattcctgagagagactaagtataatgcctgaataataatttggagaattgcttagaaaaagaagccattttatttgagggaartagccttgaggagtccttagaattagaaaacatgggttctgttgctagccttatcctcaatgccctggtcgttttctataatggaaaccttaaatttattatttggcttaaaattagtattatgcttcttaaatttctttttttttcccaaacaaaatgcaatccatttgttaatgtagagagggtgtccgtgtgattttggcagcatcatttatggtctccctgcctcaagtagtctacctgcaaaacggggacaacagtgcctgtccagaactttgctgcagggatactgtgttattc

SEQ ID NO: 148511 - DNA, 601 bp, Human; identical to SEQ ID NO: 33376

SEQ ID NO: 148512 - DNA, 601 bp, Human; identical to SEQ ID NO: 33375

SEQ ID NO: 148513 - DNA, 601 bp, Human; identical to SEQ ID NO: 33374

SEQ ID NO: 148514 - DNA, 601 bp, Human; identical to SEQ ID NO: 33373

SEQ ID NO: 148515 - DNA, 601 bp, Human; identical to SEQ ID NO: 33372

SEQ ID NO: 148516 - DNA, 601 bp, Human; identical to SEQ ID NO: 33371

SEQ ID NO: 148517 - DNA, 601 bp, Human; identical to SEQ ID NO: 33370

SEQ ID NO: 148518 - DNA, 601 bp, Human; identical to SEQ ID NO: 33369

SEQ ID NO: 148519 - DNA, 601 bp, Human; identical to SEQ ID NO: 33368

SEQ ID NO: 148520 - DNA, 601 bp, Human; identical to SEQ ID NO: 33367

SEQ ID NO: 148521 - DNA, 601 bp, Human; identical to SEQ ID NO: 33366

SEQ ID NO: 148522 - DNA, 601 bp, Human; identical to SEQ ID NO: 33365

SEQ ID NO: 148523 - DNA, 601 bp, Human; identical to SEQ ID NO: 33364

SEQ ID NO: 148524 - DNA, 601 bp, Human; identical to SEQ ID NO: 33363

SEQ ID NO: 148525 - DNA, 601 bp, Human; identical to SEQ ID NO: 33362

SEQ ID NO: 148526 - DNA, 601 bp, Human; identical to SEQ ID NO: 33361

SEQ ID NO: 148527 - DNA, 601 bp, Human; identical to SEQ ID NO: 33360

SEQ ID NO: 148528 - DNA, 601 bp, Human; identical to SEQ ID NO: 33359

SEQ ID NO: 148529 - DNA, 601 bp, Human; identical to SEQ ID NO: 33358

SEQ ID NO: 148530 - DNA, 601 bp, Human; identical to SEQ ID NO: 33376

SEQ ID NO: 148531 - DNA, 601 bp, Human; identical to SEQ ID NO: 33375

SEQ ID NO: 148532 - DNA, 601 bp, Human; identical to SEQ ID NO: 33374

SEQ ID NO: 148533 - DNA, 601 bp, Human; identical to SEQ ID NO: 33373

SEQ ID NO: 148534 - DNA, 601 bp, Human; identical to SEQ ID NO: 33372

SEQ ID NO: 148535 - DNA, 601 bp, Human; identical to SEQ ID NO: 33371

SEQ ID NO: 148536 - DNA, 601 bp, Human; identical to SEQ ID NO: 33370

SEQ ID NO: 148537 - DNA, 601 bp, Human; identical to SEQ ID NO: 33369

SEQ ID NO: 148538 - DNA, 601 bp, Human; identical to SEQ ID NO: 33368

SEQ ID NO: 148539 - DNA, 601 bp, Human; identical to SEQ ID NO: 33367

SEQ ID NO: 148540 - DNA, 601 bp, Human; identical to SEQ ID NO: 33366

SEQ ID NO: 148541 - DNA, 601 bp, Human; identical to SEQ ID NO: 33365

SEQ ID NO: 148542 - DNA, 601 bp, Human; identical to SEQ ID NO: 33364

SEQ ID NO: 148543 - DNA, 601 bp, Human; identical to SEQ ID NO: 33363

SEQ ID NO: 148544 - DNA, 601 bp, Human; identical to SEQ ID NO: 33362

SEQ ID NO: 148545 - DNA, 601 bp, Human; identical to SEQ ID NO: 33361

SEQ ID NO: 148546 - DNA, 601 bp, Human; identical to SEQ ID NO: 33360

SEQ ID NO: 148547 - DNA, 601 bp, Human; identical to SEQ ID NO: 33359

SEQ ID NO: 148548 - DNA, 601 bp, Human; identical to SEQ ID NO: 33358

SEQ ID NO: 148549 - DNA, 601 bp, Human
acctgcagggtagctggggatgcagggagtctccaagtcctaggctggagtcccgaccccgtttgctctcaggaagatgacaaggaccatggttcctagcacggagtagtgtcctcctgtctcccaccttcagtgtgacctggcagtaagacaccactcccacttctatcaggaggtgaccctgacactcagagacacctgcggacccgatgatgtctggccaccagtggacaggcgctctcagccctcctgcaaacggctggcacacctacctgagagaccaaacatttccccaaagcayattatacaacaagaacaatttcaatttgcaaaaaaaacgagtgacacagtagagctttcttttcaggccctacaattcaccagtgctggcaatatgtgtaacggaatgtggctcacaacagtaaggcaagctccttcgcaggaccccaagttccctgagatgacagaagtgtgttcaaacccatcgaggcactccttctacaatgaggtagaccatgtgtttaaaagagagactatcgtgcctggaaaactcggaaccggtacaaatacgaagcgagttctcctccacggagaggcccgt

SEQ ID NO: 148550 - DNA, 601 bp, Human
cgttaaaacataacattcccatacacacccccaaaaggcacagactcaaaaagtccacatacccctggttttatcaaccgagctcttgagaaaaaaaaaaaaagttaacaacatatattttaattgcattacaaatatgagtaaatagtaaataaaaacaagcctgtttcagtttcccactaaagggctattttccttgtgaactttgacccctaagggaaatcaagaaaagtatcaagtctaaagatcctgaactgttccacagttaggttactgcttttttggtaacgcacaccacaayggtgtgcctcctcctctcccacctgaagtcaagtgggctcagtgaagtttcacctgcagggtagctggggatgcagggagtctccaagtcctaggctggagtcccgaccccgtttgctctcaggaagatgacaaggaccatggttcctagcacggagtagtgtcctcctgtctcccaccttcagtgtgacctggcagtaagacaccactcccacttctatcaggaggtgaccctgacactcagagacacctgcggacccgatgatgtctggccaccagtggacaggcgctctcagccctc

SEQ ID NO: 148551 - DNA, 601 bp, Human
caacaagatgtgactgtctaaaaattactcaacaaatttcataaccccgaaattcaaaacatttaaggaaaagtaaacattttttactacgtagcttaccaagcaatacagagagtctaaaaaacatgactatcgattatcttccttgtgcaaaccactaacgaataaattaaaaagacaatactattttgtaaaaaacgttaaaacataacattcccatacacacccccaaaaggcacagactcaaaaagtccacatacccctggttttatcaaccgagctcttgagaaaaaaaaaaaaagttaacaacatatattttaattgcattacaaatatgagtaaatagtaaataaaaacaagcctgtttcagtttcccactaaagggctattttccttgtgaactttgacccctaagggaaatcaagaaaagtatcaagtctaaagatcctgaactgttccacagttaggttactgcttttttggtaacgcacaccacaacggtgtgcctcctcctctcccacctgaagtcaagtgggctcagtgaagtttcacctgcagggtagctggggatgcagggagtctccaagtcctaggctggagt

SEQ ID NO: 148552 - DNA, 601 bp, Human
caagtaaatcttccagaatgtggtaacttcctcctcttttaatcatttacttcaaacacaatcaggctgaaatactgcatttttccactagatgcctccagtcaacaagatgtgactgtctaaaaattactcaacaaatttcataaccccgaaattcaaaacatttaaggaaaagtaaacattttttactacgtagcttaccaagcaatacagagagtctaaaaaacatgactatcgattatcttccttgtgcaaaccactaacgaataaattaaaaagacaatactattttgtaaaaaaygttaaaacataacattcccatacacacccccaaaaggcacagactcaaaaagtccacatacccctggttttatcaaccgagctcttgagaaaaaaaaaaaaagttaacaacatatattttaattgcattacaaatatgagtaaatagtaaataaaaacaagcctgtttcagtttcccactaaagggctattttccttgtgaactttgacccctaagggaaatcaagaaaagtatcaagtctaaagatcctgaactgttccacagttaggttactgcttttttggtaacgcacaccacaac

SEQ ID NO: 148553 - DNA, 601 bp, Human
ccagtctctccccattacatgtttcccaaatttgttatttcctaaatcacggggccttttcccgtaattcaaggttcgtctgtctcaagtaaatcttccagaatgtggtaacttcctcctcttttaatcatttacttcaaacacaatcaggctgaaatactgcatttttccactagatgcctccagtcaacaagatgtgactgtctaaaaattactcaacaaatttcataaccccgaaattcaaaacatttaaggaaaagtaaacattttttactacgtagcttaccaagcaatacagagmgtctaaaaaacatgactatcgattatcttccttgtgcaaaccactaacgaataaattaaaaagacaatactattttgtaaaaaacgttaaaacataacattcccatacacacccccaaaaggcacagactcaaaaagtccacatacccctggttttatcaaccgagctcttgagaaaaaaaaaaaaagttaacaacatatattttaattgcattacaaatatgagtaaatagtaaataaaaacaagcctgtttcagtttcccactaaagggctattttccttgtgaactttgacccctaa

SEQ ID NO: 148554 - DNA, 601 bp, Human
tgtaacttttctattgttttttaataaatcaatagtaactgaatttttaaaatgggaaagatacatgcttaatgagagataatttaataatcttaacatcttacagtttgcttactcattttaaaattaataaaaattgagggcttaatatctgcttttaagaacacttttctgaaattcaacattttatttggtttcagtttagtttttgcctcaaataataataaaagtcaaatgctttttgttgaaaaatattcatattagtcagttaaatgtgatgagattatgacattgttttatyttttttccccaagttttcaaacatgaaaatctttttaataatttttaaaatatgtttaagtaaaagaaagctctgcaggtactcaatcacttataaacaatatagtacaatacaataaaaagcttttttccagtgggttgtattacataagtaaggctctgattccacaagtaaaggactgaaattaagttgtttttaaaatactgaagagaaaggttcctggtgtcagatgttgccttacaggaagtactttcacaactggggtattccccagtctctccccattacatgtttcccaaa

SEQ ID NO: 148555 - DNA, 601 bp, Human
gccaggcgtggtggcgtacgcctgtaatcccagctactcaggaggctgaggcaggagaattacttgaacccaggagacggaggttgtagtgagccgagatcacatcactgcactccaacctgcgggacagactgagattccgtcaaaaaaaaaaaaaaaaaaaaaagtatgtctgactaggcacggtggctcacacctgtaatcccagcactctggaaggccgaggtgcgtggataggggagcccaggaattcaagagcagcctgggcaacatagtgtgaccccgtctgttttttttagayagaattaaaaaaaaaatttttaaaaggaacatacgtagacaatgctgctttctgaaacaagctccagttgtttagcgattcagaaaggagagaaccaactgatatctgaatacacagctaatctcaaagggttttttaaagacaccaactttttttttcctttgttaggtttacaaacagttttttatagatctgtgtttcccttattaaattttcttgagagtcactctaaaaatagatgtaacttttctattgttttttaataaatcaatagtaactgaatttttaaaatgggaaaga

SEQ ID NO: 148556 - DNA, 601 bp, Human
gtgaaccaagaacacgccactgcagtccagcctgggcgacagggcaatactccgtcacagaaaaaaaaaaagaaagaaaaagaaaaaaacatacatacaaggccaggtgaggtggctcacgcctgtaatcccagcactttaggaggccgagatgggcggatcacttgaggtcaggagttccagaccagcctggacgacatggaaaaaccctgtctctactaaaaaacccacaaaaagtagccaggcgtggtggcgtacgcctgtaatcccagctactcaggaggctgaggcaggagaattrcttgaacccaggagacggaggttgtagtgagccgagatcacatcactgcactccaacctgcgggacagactgagattccgtcaaaaaaaaaaaaaaaaaaaaaagtatgtctgactaggcacggtggctcacacctgtaatcccagcactctggaaggccgaggtgcgtggataggggagcccaggaattcaagagcagcctgggcaacatagtgtgaccccgtctgttttttttagatagaattaaaaaaaaaatttttaaaaggaacatacgtagacaatgctgctttctgaaacaag

SEQ ID NO: 148557 - DNA, 601 bp, Human
ttcaggtcaggatttcaagaccggcctggccaacatggtgaaaccctgtcttcactaaaaatacagaaattagccaggtatggtggcgcgtgcctataatcccagctactcaggagcatgaggcaggagaatggcttgaacccaggaggcagaggttgcagtgaaccaagaacacgccactgcagtccagcctgggcgacagggcaatactccgtcacagaaaaaaaaaaagaaagaaaaagaaaaaaacatacatacaaggccaggtgaggtggctcacgcctgtaatcccagcactttrggaggccgagatgggcggatcacttgaggtcaggagttccagaccagcctggacgacatggaaaaaccctgtctctactaaaaaacccacaaaaagtagccaggcgtggtggcgtacgcctgtaatcccagctactcaggaggctgaggcaggagaattacttgaacccaggagacggaggttgtagtgagccgagatcacatcactgcactccaacctgcgggacagactgagattccgtcaaaaaaaaaaaaaaaaaaaaaagtatgtctgactaggcacggtggctcacacctgtaa

SEQ ID NO: 148558 - DNA, 601 bp, Human
gaaaaagttctcaactgctgttctgaaagtgtacgttaagaacatatgtctgggccgggtgcggtggctcacgcctgtaatctcagcactttgggaagccgaggcgggcagctctcttcaggtcaggatttcaagaccggcctggccaacatggtgaaaccctgtcttcactaaaaatacagaaattagccaggtatggtggcgcgtgcctataatcccagctactcaggagcatgaggcaggagaatggcttgaacccaggaggcagaggttgcagtgaaccaagaacacgccactgcastccagcctgggcgacagggcaatactccgtcacagaaaaaaaaaaagaaagaaaaagaaaaaaacatacatacaaggccaggtgaggtggctcacgcctgtaatcccagcactttaggaggccgagatgggcggatcacttgaggtcaggagttccagaccagcctggacgacatggaaaaaccctgtctctactaaaaaacccacaaaaagtagccaggcgtggtggcgtacgcctgtaatcccagctactcaggaggctgaggcaggagaattacttgaacccaggagacggaggttg

SEQ ID NO: 148559 - DNA, 601 bp, Human
ccgtcattgagcacgtgctcacgcagctgcagcctcactggcctttttgcactcacatgaccaacttggatgttcccctcaaggctagctgagcactgctgcctctgctgaacactcttccccaagacagtctcatgctgcgttcctgttcctccttcaagtctccactgaaacatcaaccccatcagtgaagccttctctagccaccatacatgaattagcaactccctgccacccctcccagaccctttactccttctcaataggccctgtaactcctggcatactgcatgggtacctygccaaataagtaggcaaaataaaatagtcttttctatgccttcaagaagctacagactaaatgaactattaatattagaaaaaaatggaaatcctcttgtttaataaatattttgtgcatattatccacaagataccaagagaagcaaagtaaaggacacagagacccactgagagctttgctctcaaggagcttacattttggaaaaagttctcaactgctgttctgaaagtgtacgttaagaacatatgtctgggccgggtgcggtggctcacgcctgtaatctcagcactttgggaa

SEQ ID NO: 148560 - DNA, 601 bp, Human
gtaacttaggccaggcacggtggctcatgcctgtaatcccagcactttgggaggccaaggtgggcagatcatgaggtcaggagttcaagaccagcctggccaacatggtgaatgaaacctcatctctactaaaaatgcaaaaattagccaggcgtggtggcgggcgcctgtaatcccagctacttgggaggctgaggcaggagaatcacttgaacccaggaagcggaggttgcagtgagccaagactgcgccactgtactccagcctgggcaacaagagcaaaactcttgtctcaaaaaawcaacaacaaaaaaaacaaaaaacaagtataaggtaacttcagtaaatcaacaatcgattcctactgtgcacaaaatgtagataagggtgcaccaatatataccaacctttgggttctccaccaccgttagggctgaggtttgtccagaaaatgctatgattgatatgaccaccaccattgaacttcagtgcaggctgaagagctatctgggctgtaacatctcctgaaaagttaaaatgcaaacacatttttttgtaactcctactttttcaaccactgtatacattatatttttttctt

SEQ ID NO: 148561 - DNA, 601 bp, Human
gtgtccccgttccttattgaaaccaagccaaccccaacctgagccttggacaccaacagatgcagccgtcagcttctccttaaacttgtcaaaggaaccaaagtcacgtttgatggcttccagcaactcccctattaaaaaaaaaatccaaaaacacccacaaatgaacagatttcaataattacagtaacatgttatattacatgtattaaaatatttttgtcatagggcccaagaaattagacaacatcagaatgcgacacctggatctaagtttcacaattttaattcacgtttttgwtttttataacttcaactttttttttttttttttttttttttcattttttaccttttgagacggagtttcactcttgttgcccaggctggagtgcaatgccatgatctcgggtcactgcaacctctgcctcccaggttcaagcaattctcctgccttagcctcccgagcagctgcgattacaggcacgtgccatcacgcccggctaattttgtgtttttagtagagacagggtttctccatgttggtcaggctggtctcaaactcccaacctcaggtgatccacccgccttggcctcccaa

SEQ ID NO: 148562 - DNA, 601 bp, Human
tatagctctctctacaaaaacaattcttaaccagtatgtcttgatcagttgtgagggaggtcactagtaatttattattaataatttcaagtagcaaaatttattaatgatttttataaacaaaaggccatgacattccctcattttccttctaatgtgctttccacagggagaggaaggagtgtagctgggactcacttacaaatatcagcctttctggtcatgcagctctacaaataacctgactctacagatcggtgcttacaaattttttgtggcttttacaaattgttatgccatktcactgtcccaaaagagctgttcagattctgccaaaatctgggtctatcctgtgaagtgagccacagatcaagagtattccaatgtcaggggtagaagaaggggcagagaatgactgttgttgatgtgaaggtatcactttaagttcaaagtcccaaccctctgccagacaactcatggctctatttcccatactcttcagtgacattttttaaatccaattaggctcaacagcaaagtatttggtgagcccagcctggcacttccaagccgaatattttcatatactctaccaaagagc

SEQ ID NO: 148563 - DNA, 601 bp, Human
ataaattatagctctctctacaaaaacaattcttaaccagtatgtcttgatcagttgtgagggaggtcactagtaatttattattaataatttcaagtagcaaaatttattaatgatttttataaacaaaaggccatgacattccctcattttccttctaatgtgctttccacagggagaggaaggagtgtagctgggactcacttacaaatatcagcctttctggtcatgcagctctacaaataacctgactctacagatcggtgcttacaaattttttgtggcttttacaaattgttaygccatgtcactgtcccaaaagagctgttcagattctgccaaaatctgggtctatcctgtgaagtgagccacagatcaagagtattccaatgtcaggggtagaagaaggggcagagaatgactgttgttgatgtgaaggtatcactttaagttcaaagtcccaaccctctgccagacaactcatggctctatttcccatactcttcagtgacattttttaaatccaattaggctcaacagcaaagtatttggtgagcccagcctggcacttccaagccgaatattttcatatactctacca

SEQ ID NO: 148564 - DNA, 601 bp, Human
aggtggtgactttcagatttgtttacgaaaaaaattaggaatctatcaagaaacagtaagctctgtaggtatccaaaggcctgacagcaaacgctctgctaagttagcgctgccgtctcctggggtcaatgcactcgagtggcgtttcctgggctaactctactgtaagaagctgtcaacccggatacggctggacgccggacgcccgacctcgactgcagctgcgggcggacagggcaccgggctcatccgagggcgcgcggatggacctactctttttctggtaaatggtcctaaaatraaacctggcgtttaacatggacactcagggggtcgccctgaaacaaaagggggtgcgaggcgtggcccgcacgtgcgagcccgggaggcccgctttcccgcggagggcgcgtttccaacgccgccccggacaccacatccacgcgttgccggtctcaaaaccctgccgcgcgcggcggggctcctcctcgctgtgggaaaagtggggccacagcgccctgccccagagaacggcgggtgggctgggtccggctgcggggccccgaggccctttctgcggaggtaaaggagagaaacgagg

SEQ ID NO: 148565 - DNA, 601 bp, Human
gtgtaaatggggccagacactgtggctcacaggtgtaatcccaacactgcgaggccgaggcaggaggatcgcttgatgccaggagtttgagacccctttgggcaacatagcgaaacccatttctacaaaaaataaaaacaaagccggatgcggcggcgcggacctgtgcttggagaatgcagtgagctatgatggcactctcgtctgggcgacaggtgggaccctgtccctaaacaaagcgagcctatttggcacagctttgatgcggggtggaatctgatggcggggaaaaaaaaaaaaagtaataaccaccaatttcatgctctgccacttcgtacagctataccagccttttccttcagattctgcaagttttttgctcattaaaactctctttatctgtgaggagagaaatcggtagtcaacggggaaggtggtgactttcagatttgtttacgaaaaaaattaggaatctatcaagaaacagtaagctctgtaggtatccaaaggcctgacagcaaacgctctgctaagttagcgctgccgtctcctggggtcaatgcactcgagtggcgtttcctgggctaactctactgtaaga

SEQ ID NO: 148566 - DNA, 601 bp, Human
gtgactattcatatgacctatattaggctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccrgcatgctggatgatctatgaagagtttatactgtgtatcacatttactgactcggtaagatcacactgtcatatcatgatgtatttattaatttctcacactcccattttgaattcctgagattacctgtcaggatttaaaaaatagaacaggctgagtgcagctcatgcgtgtaatcccagcactacagaggccgagaagggaggatcacttgaggccaggagttcaagaccagcctgggcaacatagcgagaccctgtctcttaaaaaaaaaaaaaagaggtttttaattagttgctt

SEQ ID NO: 148567 - DNA, 601 bp, Human
tcaaatacagttgtttattgtaacgctgatggggggaggaaaacttgtttttttatacatcatctttcctcttaaagtcagtttccatgaagccactgtggatgttcagtgaggtcttattgtattataaatgcaaatggccaaaactgggtaggagccagaaaaatgttctaagaaactagttcagcaataagaaactagttcatcaatacaaccgtaaaagacaacacatctattacctttagaaaaaatgctcaacagaagctaaaccgagtgtgactattcatatgacctatattargctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccagcatgctggatgatctatgaagagt

SEQ ID NO: 148568 - DNA, 601 bp, Human
acattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatacccgttcagccatttcatataggaggaggacatgaaaaaaccctccctcttcagatcatggcaagtttaatctatcccataagcayagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttacttgcaagcaagtcgatagccactaataactgatgtgggatgaattttctgtttgactaattcatctgcattttttaggagttctg

SEQ ID NO: 148569 - DNA, 601 bp, Human
ctgggactacaggcacataccaccatgcccatctcaaagtcttatgctttaaaaagtctaaattttatctgacaaccacaaggatacattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcatagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttac

SEQ ID NO: 148570 - DNA, 601 bp, Human
tgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattagctcttctggcatgccaaccactaatatcacctgcacctccagtatctagcaaacagtaggttacagtcaatactatactgc

SEQ ID NO: 148571 - DNA, 601 bp, Human
gtgtagtaaaccactcatgacatctgcctgtaaagatgtacgatagggagtacctatagcacaaggatgtacgaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaatacccgtgcagactgatttaaaagatgacarcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattag

SEQ ID NO: 148572 - DNA, 601 bp, Human
ggatgagaagaaaagcaccagagaagttttgtgtagtaaaccactcatgacatctgcctgtaaagatgtacgatagggagtacctatagcacaaggatgtacgaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaayacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatcta

SEQ ID NO: 148573 - DNA, 601 bp, Human
aggggctatcctggagagtattatgacatggtccagacaaagcagcatcacaaagccttccatccccgaaagcatttcaagaaggacataatcaaagggttgctaaaggtcaagtaagaggaaggctgaaaatgtcttccgaatttcacgctagagaccttaacatgcagtccctcaaatggagaacagggctgaaaagggatgagaagaaaagcaccagagaagttttgtgtagtaaaccactcatgacatctgcctgtaaagatgtacgatagggagtacctatagcacaaggatgtaygaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaatacccgtgcagactgatttaaaagatgacagcacatttcttactcttggcaaagctttcttgtaggtctggtttaactactgtttaaactattttttttttt

SEQ ID NO: 148574 - DNA, 601 bp, Human
gtaaatttaatttggaggtagaaatcaagcggtcttggtgacagattaggagaaaaagtgttggtaaaaaggaggagttaaggacatttcctagttttctgcctgtgtgaaggactccccatcactaaaatggtcaaaagcagatttgcggtattatcacaagttcagttttagacatgttcactttgagatgcttgaaaagcattctactagatagaggtatgtgtgtttggagcttagagaaacagctgaaagagtctctggcatagagagataatacatgaagtcatgggaacaaagrggctatcctggagagtattatgacatggtccagacaaagcagcatcacaaagccttccatccccgaaagcatttcaagaaggacataatcaaagggttgctaaaggtcaagtaagaggaaggctgaaaatgtcttccgaatttcacgctagagaccttaacatgcagtccctcaaatggagaacagggctgaaaagggatgagaagaaaagcaccagagaagttttgtgtagtaaaccactcatgacatctgcctgtaaagatgtacgatagggagtacctatagcacaaggatgtacga

SEQ ID NO: 148575 - DNA, 601 bp, Human
tttgggaggctgaggcgggcagatcacctgaggtcaggagttcgagaccaacctggccaacacggtgaaaccgcctctactaaaaatacaaaaaattagttgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggyagaaccagaaaagtgaaaaaccttgcaggttacaccaaacaatctagatactaagcttaatatctctaagcaagactagtatatcatctgtgttttcaaaaggattccctgattatcaatgtggaaactgcactgaatggctgaagacaagaagataataacatgagatataagctgaaagacaacctaaacagaaaagtcaaattttatggcttgggtgactcctggagtaaaataaataacaagagttttgggggcaggatgggaaatgagagtttagttgaggacaagattaagttt

SEQ ID NO: 148576 - DNA, 601 bp, Human
actatggttaaacagggaacacaggtcctgccttcaaggatctagtggggagagggattaccaatcacactccagggcaagtgtcactaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatacaaaaaattagytgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggcagaaccagaaaagtgaaaaaccttgcaggttacaccaaacaatctagatactaagcttaatatctctaagcaagactagtatatcatctgtgttttcaa

SEQ ID NO: 148577 - DNA, 601 bp, Human
actaattgagaactatggttaaacagggaacacaggtcctgccttcaaggatctagtggggagagggattaccaatcacactccagggcaagtgtcactaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatasaaaaaattagttgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggcagaaccagaaaagtgaaaaaccttgcaggttacaccaaacaatctagatactaagcttaatatctctaagcaagactagtatatcatc

SEQ ID NO: 148578 - DNA, 601 bp, Human
gcaaagtatttttgtaacctgagttaccttctgtgatttttaaaaataatttaacttccattaagtatttatcacaagataatcatagatcaaattgtattatcctttgttatctctgaccagaatttaaattagtccaattcatggaaaatttgaaggaattaaaaattaccacttagctctccccaacccaaatttgaattactaattgagaactatggttaaacagggaacacaggtcctgccttcaaggatctagtggggagagggattaccaatcacactccagggcaagtgtcaytaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatacaaaaaattagttgggcctggtggtgggcgcctgtaatcccagatactcaggagactgaggcaggagtatcacttaaacccggaaggcggaggtcgca

SEQ ID NO: 148579 - DNA, 601 bp, Human
caatgcgtttaaggtccctttttaaaactcttctaactgccatagcaccagcctccacaaaatacttcagacacatatcatcaattccaccagtggttagaataacattggcaccagttgccaggatcttctgaattctctccttggtgatatctgattctctgcaaagtatttttgtaacctgagttaccttctgtgatttttaaaaataatttaacttccattaagtatttatcacaagataatcatagatcaaattgtattatcctttgttatctctgaccagaatttaaattagtcsaattcatggaaaatttgaaggaattaaaaattaccacttagctctccccaacccaaatttgaattactaattgagaactatggttaaacagggaacacaggtcctgccttcaaggatctagtggggagagggattaccaatcacactccagggcaagtgtcactaaagtggtatgcagagattacaagcacataaaagacataaatttagcctaggaggtggacaatgaagatgagtccaggccaagtgcagtggctcacgcctgtaatcccagcactttgggaggctgaggcgggcaga

SEQ ID NO: 148580 - DNA, 601 bp, Human; identical to SEQ ID NO: 148564

SEQ ID NO: 148581 - DNA, 601 bp, Human; identical to SEQ ID NO: 148565

SEQ ID NO: 148582 - DNA, 601 bp, Human; identical to SEQ ID NO: 148566

SEQ ID NO: 148583 - DNA, 601 bp, Human; identical to SEQ ID NO: 148567

SEQ ID NO: 148584 - DNA, 601 bp, Human; identical to SEQ ID NO: 148568

SEQ ID NO: 148585 - DNA, 601 bp, Human; identical to SEQ ID NO: 148569

SEQ ID NO: 148586 - DNA, 601 bp, Human; identical to SEQ ID NO: 148570

SEQ ID NO: 148587 - DNA, 601 bp, Human; identical to SEQ ID NO: 148571

SEQ ID NO: 148588 - DNA, 601 bp, Human; identical to SEQ ID NO: 148572

SEQ ID NO: 148589 - DNA, 601 bp, Human; identical to SEQ ID NO: 148573

SEQ ID NO: 148590 - DNA, 601 bp, Human; identical to SEQ ID NO: 148574

SEQ ID NO: 148591 - DNA, 601 bp, Human; identical to SEQ ID NO: 148575

SEQ ID NO: 148592 - DNA, 601 bp, Human; identical to SEQ ID NO: 148576

SEQ ID NO: 148593 - DNA, 601 bp, Human; identical to SEQ ID NO: 148577

SEQ ID NO: 148594 - DNA, 601 bp, Human; identical to SEQ ID NO: 148578

SEQ ID NO: 148595 - DNA, 601 bp, Human; identical to SEQ ID NO: 148579

SEQ ID NO: 148596 - DNA, 601 bp, Human; identical to SEQ ID NO: 23909

SEQ ID NO: 148597 - DNA, 601 bp, Human; identical to SEQ ID NO: 23910

SEQ ID NO: 148598 - DNA, 601 bp, Human; identical to SEQ ID NO: 23911

SEQ ID NO: 148599 - DNA, 601 bp, Human; identical to SEQ ID NO: 23912

SEQ ID NO: 148600 - DNA, 601 bp, Human; identical to SEQ ID NO: 23913

SEQ ID NO: 148601 - DNA, 601 bp, Human; identical to SEQ ID NO: 23914

SEQ ID NO: 148602 - DNA, 601 bp, Human; identical to SEQ ID NO: 23915

SEQ ID NO: 148603 - DNA, 601 bp, Human; identical to SEQ ID NO: 23916

SEQ ID NO: 148604 - DNA, 601 bp, Human; identical to SEQ ID NO: 23917

SEQ ID NO: 148605 - DNA, 601 bp, Human; identical to SEQ ID NO: 23918

SEQ ID NO: 148606 - DNA, 601 bp, Human; identical to SEQ ID NO: 23919

SEQ ID NO: 148607 - DNA, 601 bp, Human; identical to SEQ ID NO: 23920

SEQ ID NO: 148608 - DNA, 601 bp, Human; identical to SEQ ID NO: 23921

SEQ ID NO: 148609 - DNA, 601 bp, Human; identical to SEQ ID NO: 23922

SEQ ID NO: 148610 - DNA, 601 bp, Human; identical to SEQ ID NO: 23923

SEQ ID NO: 148611 - DNA, 601 bp, Human; identical to SEQ ID NO: 23924

SEQ ID NO: 148612 - DNA, 601 bp, Human; identical to SEQ ID NO: 23925

SEQ ID NO: 148613 - DNA, 601 bp, Human; identical to SEQ ID NO: 23926

SEQ ID NO: 148614 - DNA, 601 bp, Human; identical to SEQ ID NO: 23927

SEQ ID NO: 148615 - DNA, 601 bp, Human; identical to SEQ ID NO: 23928

SEQ ID NO: 148616 - DNA, 601 bp, Human; identical to SEQ ID NO: 23929

SEQ ID NO: 148617 - DNA, 601 bp, Human; identical to SEQ ID NO: 23930

SEQ ID NO: 148618 - DNA, 601 bp, Human; identical to SEQ ID NO: 23931

SEQ ID NO: 148619 - DNA, 601 bp, Human; identical to SEQ ID NO: 23932

SEQ ID NO: 148620 - DNA, 601 bp, Human; identical to SEQ ID NO: 23933

SEQ ID NO: 148621 - DNA, 601 bp, Human; identical to SEQ ID NO: 23934

SEQ ID NO: 148622 - DNA, 601 bp, Human; identical to SEQ ID NO: 23935

SEQ ID NO: 148623 - DNA, 601 bp, Human; identical to SEQ ID NO: 23936

SEQ ID NO: 148624 - DNA, 601 bp, Human; identical to SEQ ID NO: 23937

SEQ ID NO: 148625 - DNA, 601 bp, Human; identical to SEQ ID NO: 23938

SEQ ID NO: 148626 - DNA, 601 bp, Human; identical to SEQ ID NO: 23939

SEQ ID NO: 148627 - DNA, 601 bp, Human; identical to SEQ ID NO: 23940

SEQ ID NO: 148628 - DNA, 601 bp, Human; identical to SEQ ID NO: 23941

SEQ ID NO: 148629 - DNA, 601 bp, Human; identical to SEQ ID NO: 23942

SEQ ID NO: 148630 - DNA, 601 bp, Human; identical to SEQ ID NO: 23943

SEQ ID NO: 148631 - DNA, 601 bp, Human; identical to SEQ ID NO: 23944

SEQ ID NO: 148632 - DNA, 601 bp, Human; identical to SEQ ID NO: 23945

SEQ ID NO: 148633 - DNA, 601 bp, Human; identical to SEQ ID NO: 23946

SEQ ID NO: 148634 - DNA, 601 bp, Human; identical to SEQ ID NO: 23947

SEQ ID NO: 148635 - DNA, 601 bp, Human; identical to SEQ ID NO: 23948

SEQ ID NO: 148636 - DNA, 601 bp, Human; identical to SEQ ID NO: 23949

SEQ ID NO: 148637 - DNA, 601 bp, Human; identical to SEQ ID NO: 23950

SEQ ID NO: 148638 - DNA, 601 bp, Human; identical to SEQ ID NO: 23951

SEQ ID NO: 148639 - DNA, 601 bp, Human; identical to SEQ ID NO: 23952

SEQ ID NO: 148640 - DNA, 601 bp, Human; identical to SEQ ID NO: 23953

SEQ ID NO: 148641 - DNA, 601 bp, Human; identical to SEQ ID NO: 23954

SEQ ID NO: 148642 - DNA, 601 bp, Human; identical to SEQ ID NO: 23955

SEQ ID NO: 148643 - DNA, 601 bp, Human; identical to SEQ ID NO: 23956

SEQ ID NO: 148644 - DNA, 601 bp, Human; identical to SEQ ID NO: 23957

SEQ ID NO: 148645 - DNA, 601 bp, Human; identical to SEQ ID NO: 23958

SEQ ID NO: 148646 - DNA, 601 bp, Human; identical to SEQ ID NO: 23959

SEQ ID NO: 148647 - DNA, 601 bp, Human; identical to SEQ ID NO: 33795

SEQ ID NO: 148648 - DNA, 601 bp, Human; identical to SEQ ID NO: 33796

SEQ ID NO: 148649 - DNA, 601 bp, Human; identical to SEQ ID NO: 33797

SEQ ID NO: 148650 - DNA, 601 bp, Human; identical to SEQ ID NO: 33798

SEQ ID NO: 148651 - DNA, 601 bp, Human; identical to SEQ ID NO: 33799

SEQ ID NO: 148652 - DNA, 601 bp, Human; identical to SEQ ID NO: 33800

SEQ ID NO: 148653 - DNA, 601 bp, Human; identical to SEQ ID NO: 33801

SEQ ID NO: 148654 - DNA, 601 bp, Human; identical to SEQ ID NO: 33802

SEQ ID NO: 148655 - DNA, 601 bp, Human; identical to SEQ ID NO: 33803

SEQ ID NO: 148656 - DNA, 601 bp, Human; identical to SEQ ID NO: 33804

SEQ ID NO: 148657 - DNA, 601 bp, Human; identical to SEQ ID NO: 33805

SEQ ID NO: 148658 - DNA, 601 bp, Human; identical to SEQ ID NO: 33806

SEQ ID NO: 148659 - DNA, 601 bp, Human; identical to SEQ ID NO: 33807

SEQ ID NO: 148660 - DNA, 601 bp, Human; identical to SEQ ID NO: 33808

SEQ ID NO: 148661 - DNA, 601 bp, Human; identical to SEQ ID NO: 33809

SEQ ID NO: 148662 - DNA, 601 bp, Human; identical to SEQ ID NO: 33810

SEQ ID NO: 148663 - DNA, 601 bp, Human; identical to SEQ ID NO: 33811

SEQ ID NO: 148664 - DNA, 601 bp, Human; identical to SEQ ID NO: 33812

SEQ ID NO: 148665 - DNA, 601 bp, Human; identical to SEQ ID NO: 33813

SEQ ID NO: 148666 - DNA, 601 bp, Human; identical to SEQ ID NO: 33814

SEQ ID NO: 148667 - DNA, 601 bp, Human; identical to SEQ ID NO: 33815

SEQ ID NO: 148668 - DNA, 601 bp, Human; identical to SEQ ID NO: 33816

SEQ ID NO: 148669 - DNA, 601 bp, Human; identical to SEQ ID NO: 33817

SEQ ID NO: 148670 - DNA, 601 bp, Human; identical to SEQ ID NO: 33818

SEQ ID NO: 148671 - DNA, 601 bp, Human; identical to SEQ ID NO: 33819

SEQ ID NO: 148672 - DNA, 601 bp, Human; identical to SEQ ID NO: 33820

SEQ ID NO: 148673 - DNA, 601 bp, Human
gatggaggctgagtgagtgtatcatgtttgcatagctgtccagtgcctgtcagtaggggtacttaggaactatgaagtgataaaagaggtaagaaggatagcattttaacaaaaagaggaagcccttggttacttacatttgtcagatactgtgtcagggagaaggatgatgactatctcacaggttcccttacctcgggcattaaagtagaaatgaacaatcagatgtggttaagaggggaaaaggttacatttcctttaattcagattaagcttgcactgcacccatgattgaacaagtgagttctctcagttcctcttgtcttggggagacctctaaggacgccagggcttacctggtaaggcctatctatcacttatttcgttatacacagcacacatctgcttttcccatgggtcagggtgtaatcaaattaggcagacttgagtttctgtagtggttcccataatttcacaagtgtgggggatactgtgttaagatttctgctgctgctgctgctgcagaagataattcttcaagagtccgagtcttctttcatgtaagaatgtgtattgttatggcttcttgccaagataaaaa

SEQ ID NO: 148674 - DNA, 601 bp, Human
tttgcatcacatcccatttcatgtattcaacaaatgtttatcaaaggcatgctgcttgcagagcatttgccaggacttagggatatagtggtagcagaaggcagataaagttccagttcactcacaggagttcatattctgatggaggagacagaaaataagctatagcatatctgtgctttgtgaatttgtcattgctgcctattcccgttgccttttttttacatctgtatttctgctttctctagtacttcaactctgctaagaagttgctgggaagtggcaaatttgatgtggggcrtggcttggagctggcctttaactctctgcagatcattttgagcttgctttggagatgcaaaaccaccgtaccatggctcctgtggattgggtctgtttgggagaagctttggttttccaagctccacctggattagatagagcacatctttggccctggactgatgtgggatccccagttctgtctcccagggcctgatgtagatctggccttcctctggagtggatgtggagccttgatgccactgactcatctgtattacttgttgcctaaaactcagaactaaaagagatcttaaag

SEQ ID NO: 148675 - DNA, 601 bp, Human
agcatatctgtgctttgtgaatttgtcattgctgcctattcccgttgccttttttttacatctgtatttctgctttctctagtacttcaactctgctaagaagttgctgggaagtggcaaatttgatgtggggcatggcttggagctggcctttaactctctgcagatcattttgagcttgctttggagatgcaaaaccaccgtaccatggctcctgtggattgggtctgtttgggagaagctttggttttccaagctccacctggattagatagagcacatctttggccctggactgatstgggatccccagttctgtctcccagggcctgatgtagatctggccttcctctggagtggatgtggagccttgatgccactgactcatctgtattacttgttgcctaaaactcagaactaaaagagatcttaaagatcatctaactaccttattttgcaggtgagaaacatgctaggactatgtgagtgactgggttcagggttccacagctagtaggggtggagtaacgggtgtgtccagtcagtgcagtggttcatgcctataattttaacactttgggaggccaaggcaggaggattg

SEQ ID NO: 148676 - DNA, 601 bp, Human
ctagtatactttcctgtctcctggagtgtgggtgggactttgggtggggtacaagaaattaaagagcttttggccggcgcggtggctcacgcctgtaatcccagcactttgggagactgaggtgggcggatcacgaggtcaggagatcgagaccatcctggctaacacggtgaaaccccatctctactaaaaatacaaaaaaattagctgggtgtggtggcgggcacctgtagtaccagctactcgggaggctgaggcagtagaatggcgtgaacccaggaggcggagcttgcagtgagcygagatcatgccactgcactccagcctgggtgacagagagagactctgtctcaaaaataaataaataagtaagtaagtaagtaaataaagagctgccatttaaaaagtttctactctatgctgcattctttacctctatccccaggaatccccaccttaatccttctgactccatcttgaatgctcatcttcagagttgtgctgactctgagtaacagcacctctctgtgtgctggtgggaggtgaacttggctccgttatttaggctccttcccttgatttttgcatgagctaaataact

SEQ ID NO: 148677 - DNA, 601 bp, Human
aggtaaaaatatgtatgaataagacctaaaatggtggttttaattggccacaggaaggcagtgccgtaagataaaatgtagttaacagaatagaatgctaattatcccattttgttctgtgtatgttggaaaaaaattacagaactctcagtttcatagtaaagataggtaagtagtgtctggataatgtccagaggatagactgaaactctgtgataaacgtgagcaggcagcaggatgctacctgataactgagtataacagcatgcaggggaggactgtgtggctggaggcagctgcrgtagaagttggcagtgccactgtggacttttaaagggacaactctgggtacaagcctgaagtgtaaggaggacataaaattaaatacaattgagcttgtctccttgaaaactggttctctctttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctg

SEQ ID NO: 148678 - DNA, 601 bp, Human
aagcttcagggatcttgattttgtaatactgagacctcactggcttgttcttttctatcatatttcccattttggtttaaaagaagagaaagggagtttgcatgatccgttagaattgtagatgtgttctacgtagctgtcattgtttgagaacccatagaaagaacagagttgagtgttaggttgtagacaagcattcacattgaacacaaaaggcttttcagacttgtactcttgtgaagtgtggttattcttagggatgggacacttcaaactgccttttttctccaggctctagagyagatgtgatattccagcaagggtgacccagctcatctttcacagattcagaaatgagacacatagatgagtttactctaaactgcacttaaactttcctgtagtcattgctttctctccctgcccctgccccttctgtggaagttgaagcagactaattgtatatcatcttttgttgaacagcgacatcgtgcttggaagccagtgggtcatttgggtctagttttcattcttttctttggatctgcttcacagtttaaattaggcccaggacattgtatatggtggtttaagaaggtga

SEQ ID NO: 148679 - DNA, 601 bp, Human
ggaagcaggcccagcaggcttgggctgaatagaagtaagagttcccagccttgtgttgttgttgtcccaggaggcagattttcatctgtgaagtcatctgggaatccagttgtaagttatatccagttgtaagaactcagtaacatccctttgctcagtccagaccaataacattttaaacagttgctggactttttaaaataaaaattttgtgtttcctgccatgtaaacagagatgttcctaaaagaaaataaatgaaccatttgtcagataatgcatttattctggttaccttaatcsctttgttaggtttttgtcatggagatagtagatgacagctttgaagggatgttaagcagtggggttatttttttttttccccaaggagacagtttttagggcagactttgagtattttttctcttgtttttgagtgtgtagctgtatattaagatgggaaagctgactctgacccaggaaaaacaggacggtaggccagtccacctgctgggtctgttattcacattcttgttgggtgtaactgccttccatgtgactctcggtacccccttctcagcagccctgctttatgtccctaat

SEQ ID NO: 148680 - DNA, 601 bp, Human
gtatagtgggtgatagggatatgcaaacagaaagttgtttttcttgggagatggcactaatccaccttgcctagaaagaagggaagtcttgctgaactgtgcatcctggcatgtatctctgccatcattcattattttcacctttgataatgaaatttctgacaatacagggtgttgttggagttcatttttttgttgataaaagtattactgtaatcaaagaattccttgcagaagttttgcaaccctcaaggaaaagtgataaaaaaacagaccctgcatgatggattgcaggtttcarggaggtgggagttgtccatcctttcgcgttggctttgcttttgtttgtgtaaccatgaaaggatactgagtctgctttttgtaaaggagataacttggttcatccgtaacatgcagagtgttgggtgaattaacgagtggaaggcacgtaatgatgtgtggcacttatgtagtattttgatgatttcacctagaatcttgccatctggaaacttgcatttactaggatgtagagccaattttggatgatactgagtccaatgtttatttaaaatggtttagattttcatttggctaaaat

SEQ ID NO: 148681 - DNA, 601 bp, Human
cccaaagatgttaattccaaacttgtttatgttcctccttggaatgacagcttataaaaatatgtgcagtattaagagatgaagcctgagggtgaaggacaacatagtacttgacaggcaccagaattaggtgacacatttcactcttgagtttcatagcagctggagcaaaaagggacataagattagcttccaaacttatgttatgcctttaaatgaaaacagaagtagcgtggctttttctgttacttagaaactttttctcttgggacatcataaagagaacactgatctaataaaygacattctcctgcttgaaacttggttctctgaggtaatgagccagtccattagtttcagtgtaccttcctcagtgatgtatctatgttcatctatctggccttgtgaatatttttttgacgtaacatgagctagactgagtatgaatggctccaaacttaggagtgactaggatttacagatgaagcagtatggatcagtttctttgggaaggttcttggaggaccctatgggaggaaaccctggacaggtaggaaaactgaggaagcagaagagaagggcagaagacaaaaaccctggc

SEQ ID NO: 148682 - DNA, 601 bp, Human
cctcagggtttcctaagacaaaatagagtgtgtttggtccagtgtgatggagaagtttgatgcaaatccgtcttaaggaggagaatggaggctgtcatggagtcctgtggactgtttcgcaagtagttgttttccatgttccagttttacttaacttcagaaaattattgtttttgaaaataaagaaaaaatctaagtggtagagagaaatataggctgtatttaaactggcctttataatttttcctgggcacacgcagcccacattttggagctctgtgacataagcaccccctgccccggagctgggagtcttgaccgggccaggccttggctgccctgggctacacagacacaagcacaacccgaatctttgtttacttcctctccaagtgctggggacattcagtactaagaaggactgtgtgcttgcacaaacactcctgccagcattctctcagccctgccattcctgactgtcttggaaagttcttcgtttaaggcaggcttttgttcttagagtgcatgcattattccccagtcaggcagccttttccgggtttccagtgcagacttgcaggtccactcccctgcagcctag

SEQ ID NO: 148683 - DNA, 601 bp, Human
tactcctaaggtttggaagccaaataaagaaaacaaaactgtgaagttaacatagtagttttggtttcttatttgtagaataaaggtatgatccagccccatggaccaaggcagcaggaggagagttcccagggtttttctaaggtcagaggcatgcagcattttcttccctccttccctgcctcagccacctctccctcccacctttacctcccgctaatgcttcttttgggcttgcttgggccatgttgttttgttttgctgctttttgaactctaaaaatataggtggcaaatctcargtctgccttgcagggagtggccctggtctttccggaccccttgtgccccatggccctgtgggtctggtgtgtctcagtgacccagtaggtgtagggcagaatggctaggcactggcatgcccattcatccccaaatcgggccttgttgaatgtggcacagctccagctctttccaaacatgactcctgccagtccctatgctgtgagataagaatgggctacacctaagcaaagttttgtaggcagctctcccttcctttatgtgcttatgcaaccttttcagcacgttggtacctacgt

SEQ ID NO: 148684 - DNA, 601 bp, Human
tgaagaacaagttgaggatctccaggtattaaatataacctgatttccagaggaacttgatataaagaggataggactctgctaatggggagaggagggaatcattgttggggttttgggtagagcatcttctttgaactaatcctggacagcctttcccaaactgagggtgtgccatcatttccttgagggcagtagaaggccctgagaatctatctgacagcattattgaagctcaagagtttagttctattttttaaataaaaatttcccagcatggtacattagacaatttttttttatttaaaaagaagtatttttgtaatgatcttggaaatatctataggtccaggaattcctagaataatttttttactatgaaattgcctaggaatggtgacttaagctactctgaaataatatggtattgaggatgatcacatcctgcaaacaactgcagcctcagactactttgactaaaaggattctaatgtgagtggttggaaggaaaggaggcagcatcaggcacaatttattgaagaggtcagaagtagctagaggagaaaccaactttttactcttaaataatcaagatttttat

SEQ ID NO: 148685 - DNA, 601 bp, Human
tatggatacattcttttcagtctctaaagtctgagggagtccctgtatcctaatttttctgccagctgacatgtagtagaatataagcatccttctgcctttagggacttgcagattatattctttggatggcttacttcagatgctaaggacaaaatttattcattcactcaataaatatttattgatgcttactgtgtgccagctcctgttagagggttggggaataaatacatcagtgaacaaaagataaaatccccctgcctaaaggagatcccatcctaatagaaatgtatgttcyttaacagtagattattatcctggaagaactaatctttataattaccagattcttacttcagagcagtggcatttggggagttggtggcaggtctaaccttcagtcctgccctatttactgccatttccaaggaccttgggatcatataatggtagagttgaaagacaggtggaaattctagtccagttccctcattttattcatcagaagtaatgtgcaaattcatatgcatactcccagtgggccttaagatcacctcaagtttctctctgtttcaaactgaagtgtctgttctatact

SEQ ID NO: 148686 - DNA, 601 bp, Human
ttaaatttatttttctttactagaagtaccactgggtttatttcttttgtatcttccaatttcctgccttttttccctctaccttcttactacatagagtatatttataatttttttttttcctttgagaatgagtctcactctgtcacccaggctggagtgcaatggcgcaatcttggctcattgcaacctctgtctccccagttcaagcgattctcccacctcagcctcttgagtagctgggactacaggtatgtgccatcacgcccaactaaggtttttttttttttttttttttttytgagatagagtctcattctgtcgcccaggcttgagtgcagtggcgcagtctcggctcactgcaagctccgcctcgtgggttcacaccattctcctacctcagcctcccgagtagctgggactacaggcacccaccaccacgcctggctaatttttttattttttagagacggggtttcaccatgttagccaagatggtctcgatctcctgaccttgtgatccacccgcctctgcctcccaaaagtgctgggattacaggcgtgagccaccacacccggccaatgtttgtattttttagta

SEQ ID NO: 148687 - DNA, 601 bp, Human
cacctcccatctgctgttggaacacgtcaatcgtatcttcattctccatttccaactgtacaggtgtgtctttttcattgatttggttgccggtcaaatcagagtctgatctgcctcatggacaatccctgtcattcacaataggctttcattagtttactaagtggtgtatgcctcttaatcttaaactgcaccacagaaccaccctgccccaccaccttcaaattaatatgattgttcttagtcttgactccttcctggggctttttgtcagccatgatgagcaccggtttctcctcakctgccgcttcacaaaagagatatcaggtccacactgaacgagcacatgagcagcaccaggagccacagaagaaggaggcagcagcagcagatgaaggagagggaattttacttcattgagtgctagattttgttgtattcttttcaaaagcgctagactttgttctggcatgcagttaagttacttggaatcagtggtatcgttttgaagctagcatgtaaactttgttaggctggctccagagcacccattaggaatgatgtagcccgagtacttatctgccgtaaggcagtattcttc

SEQ ID NO: 148688 - DNA, 601 bp, Human
ggcccgtgtgaggaactcttactggacgcccccttccctgttgctgtgctgatcttacacatcagtttccacggatcccatgtgaatcagttgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttagaaaaaaaaaaaaaaaaaagctggaagagttycccttcctgagcttcagtggaagcaacaggagggtgggccacgtccaggacagtgggagagcaaggatggaccctctgtgtccacctccagtgtgtggcactgttttccatctcatcttggacatatcatggggctacagcatgcctcagaagcctgccagaacctagtgatggtttccagcatctgggtttggggaggactgtggtgatgcgctagggatagccatctggaaggggtggggcagagacagcaggagccgtagtcgtctcaggagcctactctgattagcttataagttg

SEQ ID NO: 148689 - DNA, 601 bp, Human
acaaagccacatgggaaggcaaaggaatacacccctttgtataaatgacagtcataacaaatgaagtatataccagtttgtgctgtctgtcaaggagtaattcatctcagctagtaaaataaaggggaagggaaggaaattcaggtctttagctatgcattcataaactggacttaagaagagccttcctcctcttataatgctaactgctcttaatatttccttcttaatgaacagttgatataagagttttctcctttcatctaagaaatacagaacaatctgcaagttttcttagttrtttgttaaatggacttcgaaatgattgagaaattcgtatttctcagcgaaaataagtattaagttaatggacaagtagcagtccttgttgccaccaagattttgcatctgaattgtatatataaactgtgtcaggaatatcataaaatcatgttgaggctgcagggacaaggaaatttcatctcatgaatctgtttgatgttttcgggatgtcctgagagaaaaattctttgacctgcctagtgagcaaggtctaagtttgtccacccaggtcacattgtaccctgggctttccaaagat

SEQ ID NO: 148690 - DNA, 601 bp, Human
aagatctggtggataaggaaggttttagatgacacaagtaatactggggacaactgtggaacaaagagtgagaaaggtatgaagaggagggtacaaggaaggcagaaacagggaagagcaggccggaagagagagaagggaagaaggcagaatgttgaaaatggggaataaggagcaatcttgagaggacagagagggtgttaggtaggagtagagggggataagtggtaaagagagactgcgttagactggtgagtgaggaggcagtgcctgaggtatgtctttgtggctgtgagacttycaagggaatttgaacatttgaggtggctagggtagtattgcggacctggctgctcaagggagctgttgaacatttgtatgtagtgatatcacctgaacttttgtgctttggagtgggaggaagtagtagaaggaagctttgcctatccttttatgttaactttcttgtgatcttgtgaggaggcctgtccttgttgagtcatttagttctaccagtctacctcctttctctaagttgtctcaactcgtgcataagtcttaccacttctctctataactaactctttgcaacatgttttgc

SEQ ID NO: 148691 - DNA, 601 bp, Human
agctttttgacttttggggaaagcttttatttccaggtacctaaagtgtgtggcattgtaaataaagtcagaagctcagtttgttggtcacaaatacattggacagaaatgaaagaaagccaataagaccatgttctttctgtgctttgccctcagaacgcattccctgggatgaaaaaccctgctcaagcctgggtacagtgacccaaggtgacagcaatgacagtggcccttcagaaaggagcaagtggaggtggaccctgcctcaaacaggtttggtttgctcctggttgagcttagsccaaacctccccctgctgaaaataaataaataaaatccagatactgcaactacttacgcaccttccttttctatttaatttcaataaattgtggactaattcttcctaaaagtacatatcaattaagaagacaaaacttgaatgatcaatacattgtggttttggctggtcctatagcataacactgtagattttactttctaaatatttattgaacacaatactctgtgaatcaaactgaatcaattactgtgaggttcagaaagaacatagaactcactccttggtctttgattttac

SEQ ID NO: 148692 - DNA, 601 bp, Human
gggacagtcttggacaggggaatttttcagttgtcgtaattggggcaacagtacatacaggctgaattgaaatggggatccccacacccactcattagccatgtgatcccccatgtagtttactaacgtcaggtcactgaatgctttaacagcagtatacaatttggatcagagttgatgaactaaacttttactaagcacatacttgtattaaataaattcacaaagatctacatcatcattgacaaaaatgtgagcatttcatataaatacatgtgcattatcttgatgtttaaagtgkttttttaatgcatcgttttcatttgtgtgaacattttagcatttgttttatagcttgtttaggacatttagtcaatttgaggtttttgatacttcacaatttcatatgtacaattaatagatagaaaatttgggtgattaatcatacagcttattatagtaatgccttctgggcatcctgactttgtactgctttgatcttgcccttttatgttgggttttcttaaaaagttaatggatcctattcattcatagttcattcaacaaatatatattttgccctactatgtgctgggcacaa

SEQ ID NO: 148693 - DNA, 601 bp, Human
caaattgttctccaaatggagatttgttaatcttataagtagctgatatccctagttcaccaccaccctcagcttttttttttttttttttttttttttgagatgggggtctcactgtgttgcccaagctggaatgcagtgacatgatcttggctcatggcaacctccacttcccaggctcaagccgtttgtctgcctctgcctcctaaagtgctgggattacaggtgtgagccctgtgcctggcccctacttccctttctatccacaaattaatatcaggactcagctgtctttcttcaraaaactccttagtttatagctgtttgaaaggatctgatgagcttgtgtctagagaaacagctaacattccacataatgcctcagagagttgtgtgttacttgacgtttgttgtgtgttactttgaacctgaaaatggctcagaaacatctgtttcttcatatttgtcctcccttgtcttgatgtgaagggattactctcaatggcccccatatatttaatgatttgttaatccttagggaaagacctagtacctgatcgtattatgagcccacacatcgttcccattagcaaatgaaaaa

SEQ ID NO: 148694 - DNA, 601 bp, Human
caccaccacccactagacaaattgcttaacctttctgcacctcagtttcctcctgacaggcttgtttagaaaataaaatgagatcaaatttgtcaagcacagagcattggccctggtaggcaccacatacatgaatttccttcagattgtaggtgaagtagacttgatttgggatttctcttgttacctaggtgcttgtgtagaggagactttagaaccagaatgtgttatttgtggttttgagtgtgcctgggactctgagccaactgaattaccaagtaatgggggccccatggcatcycatgacaggtggagagccggctcttcaccctggatggacctgaaatgcctgctaaggccttgctccaccgagtagcacacaccctatcagtttgcccttctttccatctcttattctagagaccttaaagcctacttgttggtatatattttcaggtttttggaaattgggctgtttaattgaagttaataccagtgatgagacttttcaacctgagaacaacctagatgctacttcacattttgcagtggaagcttacttccatcttcactcatgtaggacattctttggtctcaatgt

SEQ ID NO: 148695 - DNA, 601 bp, Human
cctgcccccttcccattaattcaatggttaaacagatacaattttttgaccccctactatgtaccaggccctctgccgggtgctaaagctatagtaaaacatggtatctggtttaaagagccagactgcaccctgcattttatctttgctattagtgtgctaatccagacattggtactaatgttctctttctgggtggtgggttacacctcaaggccaggtggtgtgagtctgtctctgctctgttgacacttaggagctgattggattcaggtgtggcactgtgcctctttggtcctcmgggtctgcgactgtgaagttggggctgcctgtttcatagaaagagggtttcctggccctctccatgttccccagctattgctatttttactgagcttcctgccctggttgcttgtcatatgtcatgaaagtgatgctaaattcttggatgtgctcctgagttctggatgcatgtttcctatgcccttttattcgatttccacacacagtaagttttcaaactggaaaaaggtgcagccttattttgtttaagctaagtgaatattaataataaaactatttctgttccacttcatggctt

SEQ ID NO: 148696 - DNA, 601 bp, Human
gttgtctttaaagaaaaaaaaaaagcaggggcttttaagagttaaattacacaactcgctttttatttttaaagtgagcagatttcttgttgtcgttgctgagaaagataaattgataccacatgttgcttccagacaaaaacctctctgtgttccaggggaagcacatgcagctggtgtctgggtgagtggacagtctccacaaggtaaacatggtttggaagggctgaagcggacgtagggtacaaaatttaagaaattaccagttacttctgactggcacggcacctctgaaatactyttttaaagtttgaaatcctttcctggaaggggccgccctggaaccttttggcttaaagtatatgatgctcggaaaacagtaagttaacatttatgatgtcactgcttccgtgtgggatctaacagttgttgggagctgcttttgtacttggcacttcactgagtagtttgcatgcagagctttatttaatcttcccaaagagccaagagatagtcaaagaatgtttttatcctgcctgtgggaattatcccctttgtaaattattggtggaatacttttcatttcaggaagcttctctct

SEQ ID NO: 148697 - DNA, 601 bp, Human
ttactttcttcagatttctttcattttcacttaatgtttttttttgttccaggattccatccagcataccatattacctttagccgtcatatctccttaggctcttctaggctgtgactattttgagaagtactgactaggcattttgtaaatgtcccttaattgaaatgtgtctgatgtctttctcatgcttagactgaggttatgggctttggaaggcagaccacagaaggtgccattctcatcatgtcatatcaagggtacatattatcagctcatcttatccttgtagatattgacyccgatcacctactgaaatagtgtttgtcagtttctccactctaaagttgctcttttccccccttttcatactgtactctttctaaggaagttactatgctcagcccacactaacttgacaggcaagtgtctatataaattatttgaattcttctgaatgggagacttgcctacttctctaatcaacctggcaaatcctgctctacacttcttatgtctgcaagagttacatggtaaggtgtaaaatctggcaggatgagatggagtcatagaaaggttaggtaaaaattctcatcggttc

SEQ ID NO: 148698 - DNA, 601 bp, Human
tcacagttacctgttggtgtgagaacttttatttccagagtcaatgtcccttagaagttctgcctgccagtttgggggtgctcattaaaggggctgttaaacgaaactaatgctacaaatggtgttgaggagagctgtttgtggtatccaaagtgctccattagcatctttaaaggatcgcctgagaagtcccagctgtctggcttcagctctgcttagcatgggtacccatcggtgtccacaggggctagcagcaagtcctgctgaaggagatgccccaccctgctcttttcagctgccktagagcctcaagcctgagcctctcctgctgttgggaggaacctggcaatgccatctttgtcttcccaatgccggtcatcccaagccactcagagagataaagagccattgcagtccctcttagggctgtcttggagcagaaagactggcacatgatagcatggtgttggcagtagtctggccttgggtctccccagagctggtggtttatcgcttattagttactgtgatacaatttgaggttcagaaaagacagtcactgtacccttaacatctcttcgaattctaagttgagtgaaaa

SEQ ID NO: 148699 - DNA, 601 bp, Human
ctgtaattgacagtcttggtttgattgaaggtttggatgtcagtacgtctcctctctctccctccctctccctctccctgtctcttcctctctcatcctctttcttcttctttctctccgtctcccttccctcttcttttcctgctttgtctctgatgcaagaagtctgagccataaggttgtgggatttttttgtttcctttttttttaaatgtgtttctgtttgtgtggagtgtttgacttgattcttcaggggaaatcagtgactaagaagagaaggccagaggtagaagtccaagarttctgaggtcgaaattttcagttaatttccagtaggccttcatttctgtatatgccactgtaattaattggggctttcattggtcatttgtatgttcaaaaaagatcagacagcaataccgcccaacgtagttataagtaatcagaaagtgtcttgactgatagacctgttggaaggtgaccctaatgtttacctgaaaatgctgcctgcccaccgagtaacaaaagccaaagcactccctgccccactcgtcaggttctactcagactgccctgctggctggagtggggtgccccatgg

SEQ ID NO: 148700 - DNA, 601 bp, Human
agagaaggccagaggtagaagtccaagaattctgaggtcgaaattttcagttaatttccagtaggccttcatttctgtatatgccactgtaattaattggggctttcattggtcatttgtatgttcaaaaaagatcagacagcaataccgcccaacgtagttataagtaatcagaaagtgtcttgactgatagacctgttggaaggtgaccctaatgtttacctgaaaatgctgcctgcccaccgagtaacaaaagccaaagcactccctgccccactcgtcaggttctactcagactgcyctgctggctggagtggggtgccccatgggaggcagccccagccggcacttacaccaaggtgcaggtgcaggccaagctgtaagaagagggccaccggggccacacacgcagattcccctcactaccggaatctgcacacctggccagggcactcctttgtctccctcagttgtggagccaccctggagttcctctcagttcctctgtggcactggtgtgatggttgttacatggccaccatctgtgtcacctgtgtgtcctggtcataccttacaggtggtttggactatttgtagaact

SEQ ID NO: 148701 - DNA, 601 bp, Human
gcaaggcagcctttacacaagtcaagcttgtgttttacaccctgtcttcctggagtccatgtgagacttccttgtcagattgcatgaatatcaattccttatctctcctaagtgttccatatttagtccccagcttgctctaggggttgaaagtttggctaaaattatctttctttttaaagagtgaggaaagtggtgtttcactttatttttgcttgtggggcaaactttcctcaaatcatctagttctgtctaactaggaaaacagttgataaccttcatggatttgtgaatgtgaagktttcaacttatgatctctttttccttccatgtcctatttagtattagggtcctgttctgttcttctctgcccagaagataaaaacactactgaaaaatgtttcacagtggattaagttgtgggaggacagcagtaggaacatttatgttttattcccagattaaagttgattggggttgttatgttttgtgtagtttttggaggcatttccctttcttagagtatcatgtgatttatggtgataattaggcagaaacttgtcttccctacagatgccaagattatagagggacttgctct

SEQ ID NO: 148702 - DNA, 601 bp, Human
gtccttgattgaatcagataagcatgtacaaacattgagccacaggagagccattaaaaatctaagacagatgagctgctgctttccttttgattatttttattaccccagttttcattgtaaatggtgattctggtgttcctctgagaaggttaattgtatttctgttcaacatttatcttctatattttcagtgttttacaatctgttttccttctgtcacagaggaaaccaaaggcctttctgttctctggagtgggagtttctgtattaaatttgtcctctgcaagagttgcctctrtacctgggccaaatcctctaccaattcagcctataagcaccaaggtggtttcctgagcaggcctccctgggagggcattgcctgggggacctcagcggaagctgtagaacatagcttcacaggtgaccccaaccccaatctgcagaaagggaaagtggtgattcacacatctcgtttttaataatggagttctctgaagattggggccttttgatgaaggaatggatattaagcctggggactgtggttggttagtgctttagactgtcccacatgggcctcctactcctggctttgggg

SEQ ID NO: 148703 - DNA, 601 bp, Human
agttagaatagcactgactttagcaagctacggtcttcacagatgctgagatctagtatttacttcagcttttactccctctagaatcaacaagccattattttatagtccaagataatattatctagtagctttacaaagcaaagaatgccccaaaaaaccatcagccagggaaactaaaacctagggatagacaggaagaagaaaggggcttctttttatactttattgtccctacctccagtaaaacaacctaaattcttcaatttggagctttaacaaggataagtaaatatgaccrtgggcatgtaacattgtaaatactaagtcctgctgtgtttgcaaacattgagagtgaaaggtaagattgccagcaagtgcagagtcacagaagagattgaagttacagtacactcatgagaattcctgatgaccctacggtacaacctctaaaggtgggagaagcagatgtatataatgtgattttgtgtgtgagttttttgatgcttttttcattacttatttaccttgtctggagagaaaagcacgagttcatgttgtttcactaccacttttctatccatttcttggcctagagccg

SEQ ID NO: 148704 - DNA, 601 bp, Human
tgtcatgtcaaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtastgagttgagaaataacattacttaatcttttaaattttttaatacaaaagaaatacactgtacattattgttcataaaatttaaaacagtggagaagtatattaaggaaaaagtcatctttgccactcagccattcttgtagcttctcttcccagtcctgtgaagagtcttgggcacagcttttcttatatttttctatgcatttatatatctaatgcattttttgtaaatacgtaatttatgttcttgttttataataaattatattacatgtgctagtctgcattttgcatttttact

SEQ ID NO: 148705 - DNA, 601 bp, Human
gggatacctctgaccagaaaagagaaggaaatcctaacttttctctagtagtgagttgagaaataacattacttaatcttttaaattttttaatacaaaagaaatacactgtacattattgttcataaaatttaaaacagtggagaagtatattaaggaaaaagtcatctttgccactcagccattcttgtagcttctcttcccagtcctgtgaagagtcttgggcacagcttttcttatatttttctatgcatttatatatctaatgcattttttgtaaatacgtaatttatgttcttgwtttataataaattatattacatgtgctagtctgcattttgcatttttacttattttaatagtggaaaacttagagatcttttaaccttaatacatatagatctgcctcattctttttatacatgctattccatagaattgatatatgataattatttattctccaattgaaggacatttagattgtttttaaattgttcacatttaccaataagctatcataacaatgattatatatttctttttgggtttttacatctaaacaaatatttatcttgtctctaaaccttaaaaatgtaat

SEQ ID NO: 148706 - DNA, 601 bp, Human
aaaaatgtaattattgaggcaaagggtccagttatttacttggtcctgccaaattgtctttctaggaggctgaatgaatgtatttcaccagtagcaaatgagatgaaccatcttcctgcacacagccacgatttgcaaaggtgatgaatgaagagttatgtcttgttttaatttgtattttccttacgatgggaaaattgatcagcttttcatgtttcttggccatttaaattccctcttctataaattgcttgtttgttttttgccaatatgattccgttgaggtgtttgtcctttttttcgtgatatgggagaattcactaaatattctgtaagtataaatatacttttcttgtccattacctttgtctatggtgacttttatcttattaaagcttaaaacttaacatataggcctcttgtgatacagatttttttaagatagatgcacccttgttataaacgaggtgatgctgacaccctctgtgagcactcttagtttttacaattatttctgtgttaaggtggcagattcgctgctaccgctattccaggaagagttcctcctctaatatctctgaaaattttttaaatttttaaa

SEQ ID NO: 148707 - DNA, 601 bp, Human
ggcttcctttaggtgaaaatgtgaaatttcctgaaagaaaaaaataatatgctgaggttgttaatatctacagtatgatgttttgagagacaaaaagagaccacatttacataatttttattacactacattgttatagttgatctactttattattagatattgttattcatcttttattgtgcctaatttatgtacagattggggaaaacatagtatatgcagagtttggtactatctgcggtttcaagcatccactggggttcttggaagcatcccctgtggatagaagggaactagygtgctaaattttacatatgaatttgcgttggtgacccatgatctgatccatggttctattttcattcttgtttcaatactgaaatgttttagttactatgattttataggtagtgttctgtaacctaccttactgggattgaattgagagacactaaatgaacagataaatttaggaagaatttatgttttaaaaaaatcctgaatggccccagtgagaaacatagtaaatctctccatttattcatgattgtttgaacttgggaccttgttgggtcgctttagttctaggcattttaaa

SEQ ID NO: 148708 - DNA, 601 bp, Human
aaaatgaacattttagttttattcctgatttcaaggggaatacttataatgtttaaattgaggctttcttatagacaccttttttcaagttaaggacatttcctgctggctctggtttactaaaagttatttattttaatcaggcctgtgtataggatatttatcaaaatgcctactaaagaatctttgagaattgtatcatttttctcttttaatctgatttatccacagtaaattatattgaaacattttattaattcggttattaatttcaccaaagtaaaacatatatatatatatagcttaaagtatcagtcaataagacctttaaaaacacaagtagtactttctgccatcttcccagcccatgtccagtttccctaatggattaactttttggctcttacttttgtatttacttctgtattttgaaatgatgtgctgatacagctctttgtaatttttcaagtttcagacattaatctgttcacataataggacagaagatgaagactttttccataacactccttttcattccctgtccattctcataatacatcacagttggaggttcatcagtaatcagtgttaccattat

SEQ ID NO: 148709 - DNA, 601 bp, Human
ctggctctggtttactaaaagttatttattttaatcaggcctgtgtataggatatttatcaaaatgcctactaaagaatctttgagaattgtatcatttttctcttttaatctgatttatccacagtaaattatattgaaacattttattaattcggttattaatttcaccaaagtaaaacatatatatatatatagcttaaagtatcagtcaataagacctttaaaaacacaagtagtactttctgccatcttcccagcccatgtccagtttccctaatggattaactttttggctcttmcttttgtatttacttctgtattttgaaatgatgtgctgatacagctctttgtaatttttcaagtttcagacattaatctgttcacataataggacagaagatgaagactttttccataacactccttttcattccctgtccattctcataatacatcacagttggaggttcatcagtaatcagtgttaccattatgatgactatttacatgttgttcataaccaagtcatctactatattatgattacatttcctttcctgtgcaacatcctcccgcccctccccgccgaccccacaaat

SEQ ID NO: 148710 - DNA, 601 bp, Human
agtactttctgccatcttcccagcccatgtccagtttccctaatggattaactttttggctcttacttttgtatttacttctgtattttgaaatgatgtgctgatacagctctttgtaatttttcaagtttcagacattaatctgttcacataataggacagaagatgaagactttttccataacactccttttcattccctgtccattctcataatacatcacagttggaggttcatcagtaatcagtgttaccattatgatgactatttacatgttgttcataaccaagtcatctactrtattatgattacatttcctttcctgtgcaacatcctcccgcccctccccgccgaccccacaaataactattgccctcttatatatttgcttggattttgtgtgtcctcattatgaattcttcccaagcactctgcagaattctaaaattcttttcagtacagtgaggcacattgggtaatttatcaagtccattttactttcttggggaaaccctcctggaattatccattcccctgattccatcagttctggttagtttcagcttccaaggctgaccttgaagcttgacatctctcctg

SEQ ID NO: 148711 - DNA, 601 bp, Human
aatagtttctcccttctgctttatctctctcttttatcttttggaattcctgttagttggatgttagctttcctagattgatcctctagagactccctggttttttttcttgaaaatcttatatgtcttcttttcttgaatctaacttctatgacattttctgaggaacttcattccttctagtgattaaaaaacttctgccattatatttttaatttccaaaagctcttttgaaaagttgtttctcttttatagcatcttgtttcaagaaatccgaaattttctctctactaatgaggakgaaaattttttttaaattttacgtttcttccaaggttgttttaagtgttagttccttccaggtttctttcccagctcctcctccattatttgcttgttctggaagaattcatcaagtgtccactgggtgtccattcacatttcggaatgagacactaaaaatctgattaggagctctgtgcaaggaatgcctctcattgactgtgcctcattttgatttttcattttccaactcgccttctaaaggaatggtgcctctaattcctgacaacttccagagttcaaaagtgtacactggctt

SEQ ID NO: 148712 - DNA, 601 bp, Human
tctggaagaattcatcaagtgtccactgggtgtccattcacatttcggaatgagacactaaaaatctgattaggagctctgtgcaaggaatgcctctcattgactgtgcctcattttgatttttcattttccaactcgccttctaaaggaatggtgcctctaattcctgacaacttccagagttcaaaagtgtacactggcttactccttgtcagcttcccctaagcaagtaatcaagatttttgttttttcattctgtgaaattagctaccatatatgcccctatcttccaaaatgtttsattatctcttatttgatgcccttttctattccctgatctttgcttcttttctgcctctaactctctcttataggtggtttcatgggatttcagaaggaacacagatgaatgcaggtgtgttcaacctgccaggcttaaccaaatgcatagattggttctctaatgtgacctttcctggaatccctgagataacacctacatggtcatgccatatgactctttcatccactcctgggttggatttatttatattttgttgtgggattttacctcacgtgtttataagcaactttgtgacct

SEQ ID NO: 148713 - DNA, 601 bp, Human
aatttaaaagtctcctaaggttaaaatatttagttgtgattacctttcttttggtgttattgaggtataattgtataaattgaaggtgtaaaacatgatgatttcatatatgtttatattgtgaaatgattaccacaatgaagttagttaacatatccatcatgtcacatagttaccattgcgtgtgtgtgatgagaatatttaagatctactctctcagcaaatttcaaatatgtaatacattattgttaactatagtttccatactacacattaaatacccagaacttatccatcttayaactgaaagtctgtgccctttaaccaacatttccccattcctccgacttccaagcttttggcaactgctatttgaccctctgtttctatgattcaacttttttagattcctcggtctgaatctaatctaccaatgggcttgtcatacatggcctttatggtatatttcatttatacccaatttgttaaatgttttttatcatgaaaggatgctgaagttttcaaatcctttttctgtgtctattaaaatgttcatatgatttttgtccttcattctgttaacgttgcacaacaccattat

SEQ ID NO: 148714 - DNA, 601 bp, Human
ttcatatgatttttgtccttcattctgttaacgttgcacaacaccattattgatttacatgttgcatcatccttgcatcccagggataaatcccacttgatcatagtaagtgatcattttagtgtactgttgaatttggtttggtttggtagtattttgttgagaattgttgcatctatgtatatctggagaaatggcctgtaattttttttttcttgtagtatactaatctggcttaggtatcaaggtaatgctcataaaattagtttggaactgttccttgctcttaatttttttttttggaagagttttagaaggattggtattagtttcttcttaaatgcttggtagaattcactagcatagccaactggtttttctttaatggaaagttgtttacttattcaatctttttactcattattggtctgttcagattatctgctttttcaggattcagttttgatagattgtgtatttctaggactttatctattttttctaggctatacaatttgttgatgtataattgttcatagtaatctcacgattctttgcattatcatgttatcagttgtaatgtttcctctgtcatttataa

SEQ ID NO: 148715 - DNA, 601 bp, Human
ttcatcccttcaccttcagcctacctgtgttcttagagctaaaaggagtctctctctctctttttttttcctttggcagagtctcactctgtcacccaggttggagtgcagtggtgctatctcggcttattgcaacctctgcctcccgggttcaagcaattctcctgcctcagcctcccgagtagctgggattacaggtacctgccaccacacccggctaatttttatatttttagtagagacggggtttcactatgttggccaggctggtctcgagctcccgacctcaagtgatcatcckcctgggccttccaaagtgctgggattacaggtgtgagccactgcgcccaacctaaaatgagactcttctatgcagcagattgtttgatattgtggggttttttttaatccattcagtcactctatttcttttgattagagaatttaattcatttattgataggtaagaacttactattgccactttgctaattgtgttctgacagctttgtagtactttttttctttctttttttcttgttgccttcctttgtgatttgatcacttttgaaatgatatactttgattcctttctcttaat

SEQ ID NO: 148716 - DNA, 601 bp, Human
cactggggattacaattcaacatgagatttcagtggggacatggagccaactatattaattgctatagatataattatttttaatagtttgttttttaacttttataccagaattgaaagtgacttatgcacaatcattacaatattagagatttctgactttgactgtatatttacctttactggtaagattttgtatatttatatattgttatgctgtgaattagtaccatctcatttcagcttgaagaacccctctagcatttcttgcaagacaggtctagtgatgatggattccttyagcttttgtttgtttggaaaggtttttatctctccttcacttctgaaggacagctttaccaggtataacattcttggtcagtagagtttctattctttcagcattttgaacatatcaccctaatctctcctgggctgagaggaggaggtttctgccgagaaatttgctgctagtcttatgagagctctcttatatgtaatgagttatattttccttgctgctttcaaaatattgtctttatcttttgataatttaattataatatttcttgatgtcaaattttattgttcagtctgcttg

SEQ ID NO: 148717 - DNA, 601 bp, Human
ttgttcagtctgcttgggcacctttcagcccagtgaatctagatgttcatttctctccccaaatgtggaaagtttccagccattacttctctaaatgtactttctgttcattttctctctcttttctccttcagtaattcccataatttgtatgttgttttacttgatggtgtcccataaatcccataggctttttttaattcatttttattctttgctatttttgctcctctgagtaaataatatcaaatgacctatctttgagttcacttagtctttcttctgcttgattgagtcatcygttaaagctctctattaaattcttccatccagtcattgtatttttcagatctaggatttctggctttttaaaaatggttcctgttcctttttggcattataattttgtttatatattgttttctaattttgttgagttgtctatctgtgtttacttatagttcactgaactttttaaagagaattattctgaattatatgtcagtaagttcacagattattatttctttagagtcagttattagagcatattcgtttattttagtgatattattttttcctgattctttatgatccatgc

SEQ ID NO: 148718 - DNA, 601 bp, Human
tcagctggtagcatccatggacaggcagagcttgctgttgagatctccagctgggtcagatcattgcctgtgctctgaggttgggtaaggccactgctgctctctatggttgtttggatgttttgactggacccttttgttgggcagcggctaacggccaggctctaagatgggacaaggccttaagctactgttaggtatggtcacaggctgggctctgtgattaggcagggttgaagactgtgttccacagttgggtgttgccactggattagttattctccagagtagggccactggytgtgcttcaaactttatcagagttgctaccaggtgcccaggttcagtgggaccacagaatatgcccctcccttaggtccttgctacaagctgggctcatcaggaaggtagcataaatttctggaatccctgttcaggcaaagctgcaagttgtgccccacagttcagaagtgtcactggctgggctgagtgattgggtaggaccacaggctacgttctacatttggacagggtgacttgttctactccctgcctgggcatggccataggctgggatctctggttgcttggggccccaaag

SEQ ID NO: 148719 - DNA, 601 bp, Human
atccatggacaggcagagcttgctgttgagatctccagctgggtcagatcattgcctgtgctctgaggttgggtaaggccactgctgctctctatggttgtttggatgttttgactggacccttttgttgggcagcggctaacggccaggctctaagatgggacaaggccttaagctactgttaggtatggtcacaggctgggctctgtgattaggcagggttgaagactgtgttccacagttgggtgttgccactggattagttattctccagagtagggccactggctgtgcttcaaastttatcagagttgctaccaggtgcccaggttcagtgggaccacagaatatgcccctcccttaggtccttgctacaagctgggctcatcaggaaggtagcataaatttctggaatccctgttcaggcaaagctgcaagttgtgccccacagttcagaagtgtcactggctgggctgagtgattgggtaggaccacaggctacgttctacatttggacagggtgacttgttctactccctgcctgggcatggccataggctgggatctctggttgcttggggccccaaagctgtgcccacca

SEQ ID NO: 148720 - DNA, 601 bp, Human
tgatttccctattctctttctttctattctcttctggaattccccttggcagaatgttgaaacatcctatgcagtttaaccttcttttttcacattttccatatctttccctgcctatattccagaaagaaaaatgtggctcactaagttactcttcaactgagtctattctgcacacccacctttattttttaacagctttaatgaggtataatttacatactgtaaaattctcctgttttaagtgtgtatctcaatgatttttaacagaattacagagttgtgcaaccatcatcacaakccaagtgtagaatattttcactacccttaaaagcttcttcatgactatttgggatcaattcctgctcctattctccagccctaggcaaccatcaatatactttctatctctgtagttttccctttcctggccatttcatgtaaatggaccatatattatacggtcttttacatctgggttatttcatcgaacgtaatattttgaagttcatccatgttttagcatgtgtttatattttgttcctttttcttgctgaattgtattccattatatggctctatcaatggtattttttcattt

SEQ ID NO: 148721 - DNA, 601 bp, Human
ggctctatcaatggtattttttcatttgccagtcaatggaaatttggattgtttttattttttgactattatgaataatgctgtcctgggtatttgcatacaagcctttgtgtggatatacatgttcgtttctaggtagatatttaggagtgaaactattgggttctatagtagcattatgtttcacttttttcaaatctgtcttacagtgtttccgaaagaccattttacagcaatgtataagggttcaagttttgctaaaatttgttattttatgtctttgtagtcattccagtgaatrtattttggtattttgttgtggtttgatttgcttttctctaataatgaatgctactgaacatcttttcacatgtttttatttttcatatgtcttttggagaaatatctgttcaaatcatttgtccatttttaattggcttgtcttcttattgagttgtcagaattctttacatatctgaatacaagtagtttattaaaaatatgattggctaatattttctcccagactgtgactaatcttttctttctctttatggtatatttgaggcacaaaagatttaaattttgttaaattttaaca

SEQ ID NO: 148722 - DNA, 601 bp, Human
aatgtggtacatatacactatgaaatactatgcagccataaaaaaggaatgagatcatgtcctttgcagggacatggatgaagctggaggccattatccttagcaaactaatgcaggaatattttatccagtttcaatggggttccaggttgcaagtgcactatacttacataataatttcagaataatggatgttttaaaactactaccttttttgtaattggaggcctttcataatctctgtttatttagatcttatttaattttcttcaataagatttttatagttttcttcatacargtctcatacctttcagatgtttataaatacatacatttgtatttgctattgagtctgagtatttttttcaatgtatgtcgttccaaataaaagctataagttttatatatctattttctattcatactctcatatggttttgctgtgtccccacccaaaatctcatcttgaattgtaatccccgtaatctccaggtgttaagggagagaccagatggaggtaattgaatcatagggcaatttcacccattctgttctcatgataatgagtgagttctcatgagatctgatggtataaggg

SEQ ID NO: 148723 - DNA, 601 bp, Human
ataatctctgtttatttagatcttatttaattttcttcaataagatttttatagttttcttcatacaagtctcatacctttcagatgtttataaatacatacatttgtatttgctattgagtctgagtatttttttcaatgtatgtcgttccaaataaaagctataagttttatatatctattttctattcatactctcatatggttttgctgtgtccccacccaaaatctcatcttgaattgtaatccccgtaatctccaggtgttaagggagagaccagatggaggtaattgaatcatrgggcaatttcacccattctgttctcatgataatgagtgagttctcatgagatctgatggtataagggcctcttccgccttcacctggcacttctccttcctgctgccttgtgaagaaggtgccttggttccccttcgccttccaccatgattgtaagtttcttgaggcctatccagccacactgaactgtaagtcaattaaacctctttcctttataaattacccagtctcgagcagttctttatagcagtgtgaaaatggactaatatatactccttggtaaattctttttctagttct

SEQ ID NO: 148724 - DNA, 601 bp, Human
tgtaagtcaattaaacctctttcctttataaattacccagtctcgagcagttctttatagcagtgtgaaaatggactaatatatactccttggtaaattctttttctagttcttatgaattttattaggtctataggtttcctacatatataattatagaacatattgtacactattttagtattcctaccaattattttattttcatgtcctattgcattagctaaagcttctaaaatatgtatatgtgaacacatatgtatatgtgtatacacacacatatatgtgtatacacacacgyatatatgtgtatacacacaagtgtatacacacacgcatatatgtgtatacacacacatatatatgtgtatacacacacatatatatgtgtatacacacacacacatatatatgtaaaagaccgtggtaatggtagacatccccatattgttttctatttaaatgacttcaccattaatgtttactacaacatttgctgattttagagacttcattttgtgttagtttttatttcatagttttaatttttaaaaaataactgctaggacttatcaaattcccttttaaacccattcatgaa

SEQ ID NO: 148725 - DNA, 601 bp, Human
gtcaattaaacctctttcctttataaattacccagtctcgagcagttctttatagcagtgtgaaaatggactaatatatactccttggtaaattctttttctagttcttatgaattttattaggtctataggtttcctacatatataattatagaacatattgtacactattttagtattcctaccaattattttattttcatgtcctattgcattagctaaagcttctaaaatatgtatatgtgaacacatatgtatatgtgtatacacacacatatatgtgtatacacacacgcatatrtgtgtatacacacaagtgtatacacacacgcatatatgtgtatacacacacatatatatgtgtatacacacacatatatatgtgtatacacacacacacatatatatgtaaaagaccgtggtaatggtagacatccccatattgttttctatttaaatgacttcaccattaatgtttactacaacatttgctgattttagagacttcattttgtgttagtttttatttcatagttttaatttttaaaaaataactgctaggacttatcaaattcccttttaaacccattcatgaataggt

SEQ ID NO: 148726 - DNA, 601 bp, Human
ttataactttttgtgacttcttttgtggctaagattatgctgaatattgatatatatttcaagggtattgagaaatatgtgttctctgttttttctttgttttttttgttttgttttgttttgttgttgttgttgtttgggacagagtcttgctctgtcacccaggctggagtgcagaggctcactgcatcctccacctcccaggttcaagcaattctcctgcctcagcctcccgagtagctgggattacaggcatgcaccaccatgcctggctaatttttgtatttttagtgagatgggrtttcactatgttggtcaggctggtcttgaactcctgacctcgtgatccgcccgcctcagcctcctaaagctctgggattacaggcatgagccactgcgcccagccgtgttctctgtttttaagtcacaagattaaatattaaatcactcattaatttatccagagcctgtatactttgtccatttttgtatatgtaaagaatcaaaaaacaggggtgaattgtttttcaatgcctgtaaaacatttgtctcatgatttgtttcttgaattttgatttgacattaaatgggaacagtcttg

SEQ ID NO: 148727 - DNA, 601 bp, Human
agtggtgatttctgagattttggtgcatctgtcacccaagcagtgtacactgaactcaatgtgtattcttttatctgtcactcccctcccaccctttcccctgagtccccaaggtccattgtatcattcttatgcctttgcattctcatagcttaactcccactaataagtgagaacataacgatacttggttccattcctgagttgcttcacttagaataatggtctccaactccatccaggatgctgagaacgccattattgcattcctttttatggctgagtagtactccatggtgtrtatatatatatacacacacacacacacacacacacacacacacacacacacacatatgggatatatatatgtgtatacatgtatatgtgtatatatacatatatatatcacatttctttatctactcattgattagtgggcatttaggcttgttccacattttctcaattgctaattgtgctgctataaacgcgtgtgcaaatgtctttttcatatcatgacttattttcctctaggtagagacccagtagtgggattgctggatcaaatgatagttctttaaggaatctttatactgtt

SEQ ID NO: 148728 - DNA, 601 bp, Human
gagattttggtgcatctgtcacccaagcagtgtacactgaactcaatgtgtattcttttatctgtcactcccctcccaccctttcccctgagtccccaaggtccattgtatcattcttatgcctttgcattctcatagcttaactcccactaataagtgagaacataacgatacttggttccattcctgagttgcttcacttagaataatggtctccaactccatccaggatgctgagaacgccattattgcattcctttttatggctgagtagtactccatggtgtatatatatatatayacacacacacacacacacacacacacacacacacacacacatatgggatatatatatgtgtatacatgtatatgtgtatatatacatatatatatcacatttctttatctactcattgattagtgggcatttaggcttgttccacattttctcaattgctaattgtgctgctataaacgcgtgtgcaaatgtctttttcatatcatgacttattttcctctaggtagagacccagtagtgggattgctggatcaaatgatagttctttaaggaatctttatactgttttccacagcagtt

SEQ ID NO: 148729 - DNA, 601 bp, Human
ctcaatgtgtattcttttatctgtcactcccctcccaccctttcccctgagtccccaaggtccattgtatcattcttatgcctttgcattctcatagcttaactcccactaataagtgagaacataacgatacttggttccattcctgagttgcttcacttagaataatggtctccaactccatccaggatgctgagaacgccattattgcattcctttttatggctgagtagtactccatggtgtatatatatatatacacacacacacacacacacacacacacacacacacacacacatatgggatatatatatgtgtatacatgtatatgtgtatatatacatatatatatcacatttctttatctactcattgattagtgggcatttaggcttgttccacattttctcaattgctaattgtgctgctataaacgcgtgtgcaaatgtctttttcatatcatgacttattttcctctaggtagagacccagtagtgggattgctggatcaaatgatagttctttaaggaatctttatactgttttccacagcagttgtaatagtttacattcccaccagcagtgtaaaagtgttccc

SEQ ID NO: 148730 - DNA, 601 bp, Human
ttcaccatacataaatcagacaaaacacttctatccataatatatttaaaaaatgcctacccatcaataagtaaaattgaataatataaatgggccaaagacttgaacagacactttacaaaaaataaattgccaattaacacatgaaaatgtgcttgacatcattttatcattaaagaaatacaaattaaaacgaaaatgacatatcacatcacacacactggaatggctaaaactagaaaggctatctctgatagtctttgaaaaacagtttggcaggttcttaaatggttaaatgtaytcttacacaatgaccaagcaattccactgctacatatttatgcaagataagtgaaaacatcttgccacaaaaagacttgtacaagagcagcaattttatttatactagtctcaaagtggaatcaactccaatgaccatgaacagaaaactgaataagcagattgtggtatattcacacaatggaatgccactcaacaacaaaaatgaacaaactactgttcaacacatcaacatgaatgataagcaaaagaaggcagacacaaaagcatatataccttttatcccatttatacaaaatcc

SEQ ID NO: 148731 - DNA, 601 bp, Human
aaaacaataatgtaacattattgtttcctgcctcatgttagatactggacagtgccaataattctcttctagttgggaaggaagggctcataaattttcataatattaagaaatactgagatgttgactaaaacattatcagagcaataaagtaatcaactaagaaccagaattagagattcaactttaaaattactttcataggaaacggcaacaatttctgaaattcagatgcctaaaatgattcaccatatatagcaataatacagagagattgatattaatacaaagtagaatcagrcattctaggagatatcattcatattctcatgaaattctcaataatgtggtctcattattattattaaactgcattgtattatttgtgaattaatgatgtaggattatatttctttcttaacagctacagattagagaaggacatgttattttcatctttctcagatttgttttctctcagttgattaagatgcatattcaaggttagattttatttttattccattgtttttcatttctctgtggatgacctgtttattccacctagattctgtaggaatttaatttttatttcaaaaaa

SEQ ID NO: 148732 - DNA, 601 bp, Human
ttttttcaataagtatatactgatctcctaccatgagtgacatgttgtgttgggcagtgggcatagagtagttaacaaaatagacatgccatgagtcttctcttagctcatggcgtatggctatggtaaaacaagtacccggaggtctgcttcactggccacttagactcacaggacaaccagagccacactggcatcagatttacttagaagagtataggataagaaacagaatcccaacagggcagcttcttatcttcagtgggagcccttgcagtggtctacatagcatccaccaaaktgactactacctgccctgagtgacagcttagctgtgggtgcaggatccaccttggctcagcaccacatgcctgtgggagtgtatgtctcttgtaacaactccacagtcacagctttcaggatgccctaagaggcaagctgagttacaagagttatcaattgaaggaagaccacaactatggcttccccacaggtatttattgtccatatatagtcccagtcaacctgtcatgggtcatttctaacctcagtgtttgcctagtaacactgcaaaaaaggctacctttattaggtttccaga

SEQ ID NO: 148733 - DNA, 601 bp, Human
aggatccaccttggctcagcaccacatgcctgtgggagtgtatgtctcttgtaacaactccacagtcacagctttcaggatgccctaagaggcaagctgagttacaagagttatcaattgaaggaagaccacaactatggcttccccacaggtatttattgtccatatatagtcccagtcaacctgtcatgggtcatttctaacctcagtgtttgcctagtaacactgcaaaaaaggctacctttattaggtttccagaatatgagcaagaaagttaaccctgggtcaagtttgccttcartgaagcagaagtggttttgctaaccctttatccacaaggggtgaaacaaagattgacaaaactgattactctgccagggactatttttggtgctataccaaactaaaggtttcattcttgacctttttcctgagaatgcataatttatactattaaaatggtacacgttaaagacgtcctccaattttttttacttgcctggaaaactttttattcccacacagtttaatctcaacccagttctccaaataagagatagagacatcacaagaaaaatgggcacatgctctgaagatggtg

SEQ ID NO: 148734 - DNA, 601 bp, Human
agcaaaaattcaagtcagaaaaggaataaaaggaaatcaaatacctgggcacaaattttgagtcaatgttatgtttgtaagcaggatggtccaggctgcggggatgaagggaatggtgctacctttactgcccacattctcaggggctctgttcctctccatggactgcagggatcccccttcctagctccagtgcccacaactcacgtcttagtttctggcgctccttgtgcttgggtgacctgccctgaggctcactgtcactgacctgggacagcaccgcccaccgccccacccagcrcagcaagcccacccaccatcagggagatgctgctgactctcggaccctgaagtccacacaagctgcccctgtgtcctctgttatgtttatttgagaactgttcatcctccctgacccaattaagacaacattctcctgtttctagcctcatctttaaagatgttgaggtttttctcatttattttttatttatttatgttttttgagacagttccaatctgttgcccaggctggagtgcagtggcataatctcagctcactgcagccccagcctcctgggctctagtgatcctcccccct

SEQ ID NO: 148735 - DNA, 601 bp, Human
ggacagcaccgcccaccgccccacccagcacagcaagcccacccaccatcagggagatgctgctgactctcggaccctgaagtccacacaagctgcccctgtgtcctctgttatgtttatttgagaactgttcatcctccctgacccaattaagacaacattctcctgtttctagcctcatctttaaagatgttgaggtttttctcatttattttttatttatttatgttttttgagacagttccaatctgttgcccaggctggagtgcagtggcataatctcagctcactgcagccccarcctcctgggctctagtgatcctcccccctcagcctcttgagtagctgggaccataggtgtgcaacaccacatccagctaattttatttttcttttcaaagatgaggtccagctatgtggcccaggctggtctcaaaatcctgggctcaagcaatcctcctgcatcggcctcccaaagtgctgtgattacaggtgtgagccactgcacgtggctgattttctgtgattacaggtgtgagccactgcacctggctgattataaaaaagtggaatctctctaggacttgagaccttctcccca

SEQ ID NO: 148736 - DNA, 601 bp, Human
agcacagcaagcccacccaccatcagggagatgctgctgactctcggaccctgaagtccacacaagctgcccctgtgtcctctgttatgtttatttgagaactgttcatcctccctgacccaattaagacaacattctcctgtttctagcctcatctttaaagatgttgaggtttttctcatttattttttatttatttatgttttttgagacagttccaatctgttgcccaggctggagtgcagtggcataatctcagctcactgcagccccagcctcctgggctctagtgatcctcccmcctcagcctcttgagtagctgggaccataggtgtgcaacaccacatccagctaattttatttttcttttcaaagatgaggtccagctatgtggcccaggctggtctcaaaatcctgggctcaagcaatcctcctgcatcggcctcccaaagtgctgtgattacaggtgtgagccactgcacgtggctgattttctgtgattacaggtgtgagccactgcacctggctgattataaaaaagtggaatctctctaggacttgagaccttctccccagggaattccccagtttcttccttaca

SEQ ID NO: 148737 - DNA, 601 bp, Human
tgaataacagaaagtgctcttttcacttgttatgacttaagatgttttagggttttaggagctctggccaggagcagggaattaagactgaaatgtatatttcttatatcacgggagaaacttggtgatggcagaagaggggacaaatttaaatgtgaggatgttgttcaagagcaggaatattcaaagagaaaggcggtcatgtagagagactcagaaaggaagtgatgcacatgggaagaggatgtaagtacctagaggacaaaggaagggaaatgaaaccgtgaaaaggggtaaaagmcaacaaaaataaccttgtcattaacagctcactttgattgaacatctactctgtggcggttggtttaatgctcatgacagccattggagattaatattacttatatgcctattttgcagataaggtaactgaaatccagagataccacaaatggagtttacatagggtcagatgaataaggaaaaacccagatgttctaccccagagcctgcattcctaaccctgtgctatccaggcaatctaaaaaaataaaaacagaaaaatgaaacaaaaatgaggaaatatttgcagacaaaaaga

SEQ ID NO: 148738 - DNA, 601 bp, Human
cttgtcattaacagctcactttgattgaacatctactctgtggcggttggtttaatgctcatgacagccattggagattaatattacttatatgcctattttgcagataaggtaactgaaatccagagataccacaaatggagtttacatagggtcagatgaataaggaaaaacccagatgttctaccccagagcctgcattcctaaccctgtgctatccaggcaatctaaaaaaataaaaacagaaaaatgaaacaaaaatgaggaaatatttgcagacaaaaagatccagaaaaaaagwataccaagagctggaggaagtagaggctactcagacactgagtcctcatggaaaagccaatgagaaagcatgaacagatgtggagagggagggtgttgtgtgaaagggggtgggcatgaggcaaccaggacttcaaagaaactgagctaagggccctgggcagggtagctctggggacaaaggcaggatcactctgccatcatcacttaccagagtgtctcacagaggacacgcagcagagttgtctggccaaggcccctgtcatccaggggtgcagctgacccagtcccctactctcaa

SEQ ID NO: 148739 - DNA, 601 bp, Human
cttttcaaaggctagatagtatttcagtgtgtagatgtatttcattgtgtatatattttctttatccattcacccactgatgggtacttaggttgtttctgtatcttggctattgtgaatactgctgcaatgaacatgggagagcagatatctcttccatatacagatggtccctgatttatgatggttagacatatgattttcaactttacaatgggtttattgaagtattaaatgcatttttgacttatgatgtgttcaatttatggtaggtttatggaaatgtagtcccatcgtaackctaggagcatctgtactgatttcatatccttcgaatatatattcagtagcgaaattcatggattgtatgggtagttctactttttatttatttgaggacactccatactgtttttcttagtgattgtagcaatttacattcccaccaacagtgtacaaaggttcccttttctgcacatcctcaccaacatttgttatctttagtctttttgataataaccattctaaccagtatgtggtgatgttcattgtggttttagtttgcattttcttgatgatatctgaggcagggcattttttc

SEQ ID NO: 148740 - DNA, 601 bp, Human
atgtagtcccatcgtaacgctaggagcatctgtactgatttcatatccttcgaatatatattcagtagcgaaattcatggattgtatgggtagttctactttttatttatttgaggacactccatactgtttttcttagtgattgtagcaatttacattcccaccaacagtgtacaaaggttcccttttctgcacatcctcaccaacatttgttatctttagtctttttgataataaccattctaaccagtatgtggtgatgttcattgtggttttagtttgcattttcttgatgatatcygaggcagggcattttttcacatacctgttagccatttgcatgtgttcccttaagaaatgtttattcaggtcctttgcccatttaaaaatctgtttgtttgtttgtttgtatttaatattgagttgtttgagctccttatgtattttggataataatccttatcagacacatggtttgcaaatattttttcccattctgtaggttgtctcttcactctgttgattgtttccttgcctatgcagaagctttttagtttgatgtaatcccagttctttttgcttttgtgattgtgcttctggt

SEQ ID NO: 148741 - DNA, 601 bp, Human
gcactgaatctttagaggacttcgagttgtctggacattttaacaatattaattcctccaatccatgaacatggggtatcttttcatttctttcttcttcagtttctttcatcaatgccttagcattttcagtgtgtgcatatttcacctccttagttaaatttattcttaagtattttgttgcagttattgtaaattggattgttttcttgatatgtttttcagagagtttattgttagtgcatagaaatgcaactgatttttgtatgttgcgtttgtatcctgccactttactgaatttgtttattagttctagcagtttttttttttttttttttggtggagtcttcgggattttgtatatataagatcaggtcatctgcaaataaggacaatttaaaacttcttcctttccaatttgaatgccttttatttcttttgcctgcctaattgttctggctaggacttgcagtaacatgttgaatagaagtgagaatgggcaatctgtattggtccatcctcacactgctaataaaagactggataatttataaaggaaaggggtttaattgactcaagagttcagcatggctggagaggc

SEQ ID NO: 148742 - DNA, 601 bp, Human
tagaggacttcgagttgtctggacattttaacaatattaattcctccaatccatgaacatggggtatcttttcatttctttcttcttcagtttctttcatcaatgccttagcattttcagtgtgtgcatatttcacctccttagttaaatttattcttaagtattttgttgcagttattgtaaattggattgttttcttgatatgtttttcagagagtttattgttagtgcatagaaatgcaactgatttttgtatgttgcgtttgtatcctgccactttactgaatttgtttattagttstagcagtttttttttttttttttttggtggagtcttcgggattttgtatatataagatcaggtcatctgcaaataaggacaatttaaaacttcttcctttccaatttgaatgccttttatttcttttgcctgcctaattgttctggctaggacttgcagtaacatgttgaatagaagtgagaatgggcaatctgtattggtccatcctcacactgctaataaaagactggataatttataaaggaaaggggtttaattgactcaagagttcagcatggctggagaggcctcaggaaactt

SEQ ID NO: 148743 - DNA, 601 bp, Human
ttcatttgagtgttttctcttttttcttagtctagctaaagctttctcaattttgtttattttttcaaaaagccagtgctttgttttgttgatctcatttttttctagttttgaactcatttatttctgatctgatatttattgtttccttctttctgctaatttttgccttagtttttcttctttgtctggtttcttgaggtgtaacattaggttgtttgagatctttcttctttctttatgtattcttgtgtttattgctataaacttcccctcttgtaactgcttttgctatatcccrtaagttttgatatgttacatttctatcttcatttgtctcaagatttaaaaaattttttccctttaatttcttcattgacccattggttatttgggagtgtacttaatttccatgtatttgcaaatttttcaaaattcctcgttattgatttctaatttcatatcattgtggtcagaaagtatatctgatataacttcagccttctttactttgttaaaacttgttttgtagcctaacatatgatgtatcctgtagaatgtctcatgtacaattgagaagaatggtacttttctgcttgta

SEQ ID NO: 148744 - DNA, 601 bp, Human
tattaatatttgttttatatatttagttgctcaaatattgggtgcatatgtttacaattgttatatcatcttgataagttgactccttcatcattacataatgaccttcttattttctttctttctttttgtttcttttgttttttgttttagtttttgttttggagacagggtcttgctctgtcacccagactggagtgcactagtgcaatcatggctcgctgcagcctcaacctcctgggctcaggcaatccccccaagtagctgagatgacaggcatgtaccatcacatctgactaawtttttttagttatttatagagacaggattgccttatgttgcccaggcaggtctcaaacttctgggctcaagcaatactttcacctcagcctcccaaagtgttgggattacagatgtaagccaccatgcctggttttatcatgaccttttttgccttgttttatattatttgattcaaactgtatctcatctgacgtaagtacacctgtgctttctttctttcatttccatttgcatgaaatatctttttctatcttttcactttcagtctatgtgtttccttaaaagtgaagtgagtgtc

SEQ ID NO: 148745 - DNA, 601 bp, Human
agtgaaattgcagagagggggagttattaatgatagtgaaggaggttcactggggacacaaatgaaaattcttcatttattacaattaggcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataataggtaaggctgactgggagagtttgtaactgtgagtcacaggttaccaggtaaggggctcrgggacttcatcacggaccatcggggcagtgcaggtagcctgggatggaggcaggaagggaaaggggctggcacctgatgcagtgagtcttcagcttgacagaagaaagtccttaggagttgggaaaataccagaagacagaaatggaggtaatcagtaagaatgtcagagaggctatttctgaagtcagagagggctgggcctgatggctcatgcctgtaaccccagaactttgtgaggctaaggcagggggatcgcttgagtccaggagctcaagatcagcctgggcaacatggcgaaa

SEQ ID NO: 148746 - DNA, 601 bp, Human
agagggggagttattaatgatagtgaaggaggttcactggggacacaaatgaaaattcttcatttattacaattaggcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataataggtaaggctgactgggagagtttgtaactgtgagtcacaggttaccaggtaaggggctcagggacttcatcasggaccatcggggcagtgcaggtagcctgggatggaggcaggaagggaaaggggctggcacctgatgcagtgagtcttcagcttgacagaagaaagtccttaggagttgggaaaataccagaagacagaaatggaggtaatcagtaagaatgtcagagaggctatttctgaagtcagagagggctgggcctgatggctcatgcctgtaaccccagaactttgtgaggctaaggcagggggatcgcttgagtccaggagctcaagatcagcctgggcaacatggcgaaaccccatctctaca

SEQ ID NO: 148747 - DNA, 601 bp, Human
tacaaaaaccacaacaaaaccataaagggacaagtaaagaaagaaagataatgtggtgtaagaagacagagggccaagacaaagcagagatgcccactggggctaaaattttctcagcctcaggctcaggtgacagtgagggataaaatactaaccttgagccacacaaatctgaatgaaaaggcagatcatgggggtttgagggcacggacattcttgccctgaagtttcagagcatcacaaattttcctagtttccttttcatagaatattattctgacttggttcccttatcatacaytgagagctccaaaggacatttgctcctttctgcagtgataggacaagaccacgacttttcagaatccagtgaggaggaggcgcccgcagaagcctcaagcggggcactgagaagcaagcatggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaa

SEQ ID NO: 148748 - DNA, 601 bp, Human
tggggctaaaattttctcagcctcaggctcaggtgacagtgagggataaaatactaaccttgagccacacaaatctgaatgaaaaggcagatcatgggggtttgagggcacggacattcttgccctgaagtttcagagcatcacaaattttcctagtttccttttcatagaatattattctgacttggttcccttatcatacactgagagctccaaaggacatttgctcctttctgcagtgataggacaagaccacgacttttcagaatccagtgaggaggaggcgcccgcagaagcctcragcggggcactgagaagcaagcatggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactggg

SEQ ID NO: 148749 - DNA, 601 bp, Human
caagcggggcactgagaagcaagcatggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactgrgtaatttacaaaagaaagaggtgtaatggacttacagttccacatggctggggaggcctcacaatcatggcagaaggtgaaaggcacgtctcacatggcggcagacaagagaagagagcttgtgctgggaaactcccccttatataatcattcagatcttgtaagacttattcactatcacaagaacagcacaggaaagatctctccccatgattcaattacgtgccaccaggcccctcccacaacacatgggaattcaagatgagatttgggtgaggacacagccaaaccatatcactg

SEQ ID NO: 148750 - DNA, 601 bp, Human
catggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactgggtaatttacaaaagaaagaggtrtaatggacttacagttccacatggctggggaggcctcacaatcatggcagaaggtgaaaggcacgtctcacatggcggcagacaagagaagagagcttgtgctgggaaactcccccttatataatcattcagatcttgtaagacttattcactatcacaagaacagcacaggaaagatctctccccatgattcaattacgtgccaccaggcccctcccacaacacatgggaattcaagatgagatttgggtgaggacacagccaaaccatatcactgccagacctattaactccaaagta

SEQ ID NO: 148751 - DNA, 601 bp, Human
tcagaaaagattgaacattatgtatgttccttttatttgattatgcatgaatgagataggagaaaacgatggaaggatccacactgatctgttgacttcactagctgggagaccagagacagaatagggtaggaaaagagagctttggggttatatacatttgcattcattggtcttcttatgacaagcatatattgctttcttaatttgaaaccacccaatgaaatggatgatttataataaatacatatttttcccaaagttaaaaaaaaaaaagaagaagaaacaatgtcatccccarccccagcctcagagagggctcctggagcaatcttgaccaacaggtcagatgatcaaagccaaagggtggcctagtggtgggactatttctccccctcctccacaagcttctcttgttcagttttgcttttaaagaattccctgctgattcctaagactcagactaagactgttaaggaattttatttttttctgcaggtttcagcagtagtgacttttcagacctgagtaatggagaagagcttcaggaaacctgcagctcatccctaagaagagggtcaggtaaagaagattaggatgc

SEQ ID NO: 148752 - DNA, 601 bp, Human
cactgatctgttgacttcactagctgggagaccagagacagaatagggtaggaaaagagagctttggggttatatacatttgcattcattggtcttcttatgacaagcatatattgctttcttaatttgaaaccacccaatgaaatggatgatttataataaatacatatttttcccaaagttaaaaaaaaaaaagaagaagaaacaatgtcatccccagccccagcctcagagagggctcctggagcaatcttgaccaacaggtcagatgatcaaagccaaagggtggcctagtggtggractatttctccccctcctccacaagcttctcttgttcagttttgcttttaaagaattccctgctgattcctaagactcagactaagactgttaaggaattttatttttttctgcaggtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcact

SEQ ID NO: 148753 - DNA, 601 bp, Human
tgtacatgcgcacagacaagagcgtgggcgtgtccgtgcttgcgtgtgaatgcaggtgtgggcgtgtgctctgcctgcatatgtgtgtgcatgagcgtgtgtatgtgcgtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacsgcgatccctgaccactgtgctctgtgggccttctggaagccactgtccctcccccagtccctgtgctgaagccagacacctgcagccgtcctgcccccaaccccagctacccaggcctgaggctggcatgctcctcagctgtgtggccccctccagcccgaagggctgaggtccacccttcatctgagttaagtctctcaaaactctgggtgccctggagggtttcgtcagccagcccaggaccctcagccatggtgctcccaccgcaggccagcaggaagaccaagaagaaggaagggg

SEQ ID NO: 148754 - DNA, 601 bp, Human
ttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaaccccagctacccaggcctgaggctggcatgctcctcagctgtstggccccctccagcccgaagggctgaggtccacccttcatctgagttaagtctctcaaaactctgggtgccctggagggtttcgtcagccagcccaggaccctcagccatggtgctcccaccgcaggccagcaggaagaccaagaagaaggaagggggtgccctccgggcccagagagcctcatccaatgtcttctccaactttgagcagactcagatccaggagttcaaggaggtgagactttcctgcttcactgggagcccccacccccaggagcctgtgctgggaagaccccatgtg

SEQ ID NO: 148755 - DNA, 601 bp, Human
gtttggggtgaggtggacacagccagccagatgcacccactgccccacgtgcctgggccaagcgtctccttcccgctccctccccacccttcccatctgcctgcctggccctgtgctggggtcacctgctggtggcacagggcaggcaacaagccctgccctgtgatgcccccatgtctgtaacaggcaagaccaacgtcaaggacgacgagctggacgccatgctcaaagaggcctcggggcccatcaacttcaccatgtttctgaacctgtttggggagaagctgagcggtgagcaccrgtggggcaggcctggccctcctagctaattcctaacagttagagatccggacatttcacgtaaaaatctctcttttccaatctctggagaagccctagggcctggcactctgggagccaacaactgtggggccccgtcagccaccccagagccatgtgctcaggcccgccctcctgccccacgtgctgtgtgacccgccgtcgacacctctgtccctcactcatgcagcactcacccccagctccaggcctgggctgaccctgggcaccccaaaactcactacaccccagggcaggagtg

SEQ ID NO: 148756 - DNA, 601 bp, Human
gcgcctgccctctgtacacccttgtccctggcccctcgaacccggccagctcccccactgcagaaatgctcccaggaggcctgactcactccaaggtgtgaatggcatcaggtgagggtgctcccccgtggaggccacccaagcaagacgtctctagtggtagaatcgggcaccggccacaggttcccctcacaggagttctgggcactggtgctgggggaacacaggatggacggctctgggcaaaactgagactcgccacgacagccccgaggcctgagttgacccatcagctctgccrggacacgtctgtaccagcatggcccaggccctgcccacctcctggtctaggaacccagccactgctcttgacatggtctctggccacaatgacagccttgggtcaagtggggacgaggttcctttcaaatagcagacagcaggttggaagggggcctggccccaccccagtacacacaaaaaaggctgcacgtcccgcctgggaggcagtcgagacacacaagctgtttcgggccttttccttcgctcccgtaaccagcaagccctggtccctgaggatggcgctgcctcacccaagtga

SEQ ID NO: 148757 - DNA, 601 bp, Human
taagatatttcagtttcttacaagcccacctcagggcctgaattagccaactaattaattatccgtaacagcctgggactccctgggtggaacgtgcgtccctcccagcgcagatgcaggcttgtccctgaatcacagcccggtgacgcagccattataattagactcaacctgactcttacccttgaccacgaaatctcagggatgtggccccaggacaggctcaatatcttttcatttaatttgtgttgagtggaagcacagccaccctccgggagacagccaggcaggcagctcctgycctgggggaagcggcgcctgccctctgtacacccttgtccctggcccctcgaacccggccagctcccccactgcagaaatgctcccaggaggcctgactcactccaaggtgtgaatggcatcaggtgagggtgctcccccgtggaggccacccaagcaagacgtctctagtggtagaatcgggcaccggccacaggttcccctcacaggagttctgggcactggtgctgggggaacacaggatggacggctctgggcaaaactgagactcgccacgacagccccgaggcctgagttgacc

SEQ ID NO: 148758 - DNA, 601 bp, Human
ccatgctcccttcccttggtggccccaacaggggcccctccttgagacccagcgttgggtcagatgagcaggccctgggccactcactcctcagcaagactcacacctgcggcccagcctgccgcggacagcccccgaatggtcttgatttaaccaggcctgtccccctgcccagagccctgggcaggtcctcacctcttcctcctctctgctgcaccctctgacgggcgtgcacgtgtgcatgtgccatgctgcctgcgctcctggccctgactcctcttagcagttcatttctaatgcrtctctctccccactgtctctccctctgtctctgtctctccctctgtctctgtctctccctctcaccactgtctctccctctgtttctgattctccgtctctccccatctctgtctctccctctgtctctgtctccatctctatctctctaactctctctgtctctctctctccttctgcctccacctctccctctgcctctctctgccctcttcctttgtctgtctgtctctctgtatccctctgtctctccctctgctcccatctctccctgtctctgtttctccctgtctctgtctcc

SEQ ID NO: 148759 - DNA, 601 bp, Human
tttgctgcagaggagcctcccgctcccccacgagcgatcaccccggcagccaccatgctcccttcccttggtggccccaacaggggcccctccttgagacccagcgttgggtcagatgagcaggccctgggccactcactcctcagcaagactcacacctgcggcccagcctgccgcggacagcccccgaatggtcttgatttaaccaggcctgtccccctgcccagagccctgggcaggtcctcacctcttcctcctctctgctgcaccctctgacgggcgtgcacgtgtgcatgtgccrtgctgcctgcgctcctggccctgactcctcttagcagttcatttctaatgcgtctctctccccactgtctctccctctgtctctgtctctccctctgtctctgtctctccctctcaccactgtctctccctctgtttctgattctccgtctctccccatctctgtctctccctctgtctctgtctccatctctatctctctaactctctctgtctctctctctccttctgcctccacctctccctctgcctctctctgccctcttcctttgtctgtctgtctctctgtatccctctgtct

SEQ ID NO: 148760 - DNA, 601 bp, Human
gagtcactggacctgcccgctagacctccccacacgtggcagagccgagcatgggtgagtcctgccttgggctctgtcgctggggcagtcagaggctctcctgagtgtccggctgcctcccactctgcaccccagcctctccgcacatgcatcctccaagccgtgtcccacctgaagccccggcccgcctgccccacacattcccgaggacctgagcgtgtttaaacagggcgtgtgtcacatcaaggcggaggatgggagagcgggtggctgctcgcttctgccacatttagccccatgrgggtctgcagtgaccacggcacccacacgtgccacgttcctccacgctgtccacagagctcccaggccgtgtttgcaactttctggcctgaggaaaccagtttctttaaattactcccttgaggaccctggatccggacccacgtgttgtggggggaggcccggccccagttcaaggccacttttgctgcagaggagcctcccgctcccccacgagcgatcaccccggcagccaccatgctcccttcccttggtggccccaacaggggcccctccttgagacccagcgttgggtcagatg

SEQ ID NO: 148761 - DNA, 601 bp, Human
acccaggaccgcacccctacggtgtgttctccccagatgttcacctgcttccctccccatgtaggactggacacagaacccaacagcgtaccactctccggggacaaggacagcttctccactgaacccaggccaggctgtcgccccccaggttgggcctggctgggtgaggggcattcactgccggacactgtccatcgtgactgaaccaccggagtcactggacctgcccgctagacctccccacacgtggcagagccgagcatgggtgagtcctgccttgggctctgtcgctggggcwgtcagaggctctcctgagtgtccggctgcctcccactctgcaccccagcctctccgcacatgcatcctccaagccgtgtcccacctgaagccccggcccgcctgccccacacattcccgaggacctgagcgtgtttaaacagggcgtgtgtcacatcaaggcggaggatgggagagcgggtggctgctcgcttctgccacatttagccccatgagggtctgcagtgaccacggcacccacacgtgccacgttcctccacgctgtccacagagctcccaggccgtgtttgcaactttctgg

SEQ ID NO: 148762 - DNA, 601 bp, Human
cacttctcgtccaccccggcttggatgaccacaatcctccccctcacgccaaacccaggaccgcacccctacggtgtgttctccccagatgttcacctgcttccctccccatgtaggactggacacagaacccaacagcgtaccactctccggggacaaggacagcttctccactgaacccaggccaggctgtcgccccccaggttgggcctggctgggtgaggggcattcactgccggacactgtccatcgtgactgaaccaccggagtcactggacctgcccgctagacctccccacaygtggcagagccgagcatgggtgagtcctgccttgggctctgtcgctggggcagtcagaggctctcctgagtgtccggctgcctcccactctgcaccccagcctctccgcacatgcatcctccaagccgtgtcccacctgaagccccggcccgcctgccccacacattcccgaggacctgagcgtgtttaaacagggcgtgtgtcacatcaaggcggaggatgggagagcgggtggctgctcgcttctgccacatttagccccatgagggtctgcagtgaccacggcacccacacgtgcca

SEQ ID NO: 148763 - DNA, 601 bp, Human
tcctcttcctctgattgttacttgcagccaaaagaatcttccccatgtggaattcaagagcttcacctccggatctgctgctgtccctgcagctcagcccagcctgcagctccaccgtcctcccaggtccagctcagcccagcctgcagctccaccgtcctcccggacccagctcagcccagcctgcagctccaccgtcctcccggacccagctcagcccagcctgcagctccaccgtcctcccggacccagctcagcccagcctgcagctccatcgtcctcccaggtccagagagcctgrtcagtggcccaatggggcaggaactggcagaatcccccattgcctcaaccaccaggagcctgtggggtccctaataaacagagaaggctgagcttcaaactgggcaagaagagagaggcaggagagccagagggacctctgtctgggacagggtggacacccaaccttgcccatggtgtaagtctcaggggtggacactgggaatcagggcaggattgcccagatcccagttgcctccatggccctgcctgaggtcccagatggtgagtgctgagccccactttggtgccgggaaggagg

SEQ ID NO: 148764 - DNA, 601 bp, Human
tgcattaaggctccaattagataaaaaatgaaatccaactacatgtatttctgaatggcaacccacataaagtgacagaaacgttaagcaaggctcagcaggggcacactgggtgaatgtaaaaaaaaaaaaaaaaaaaaattcaggccgggcgcagtggctcacgcctgtaatcccagcactttgggaggccggggcaggtggattgcctgggttcaggagttcgagaccagcctgggcaacacagtgaaaccccgtctctactaaaaaaaaaaaaaaaaattagccaggcgtggtggcrggcacctgtaatcccagctactcaggaggctgaggcaggagaatcgcttgaacccaggaggcggaggttatatgagctgagattgcgccactgcactccagcctgggcaatagagcgagactctgtctcaaaaagaaaaaaaaaatcagtccaaggagactcctaggcaaaaattaaaacaagacccagcataatcaggataatttaatattaattaagagaaaaattttaagtaaggatggagcatcaggaatccctacccactgatgactgcagtgaccgcccccttccctcacgccc

SEQ ID NO: 148765 - DNA, 601 bp, Human
cacgcacattccaaagcactgcagaggttttaaagagaaaatgtggtccctacattaagttaaaataaatgaaacagcaagaaagcgtttaaaaaggcaacaacaaagatgacagaggttagatcacatatgttggtcaaaacagtgcacattaaacagatgcattaaggctccaattagataaaaaatgaaatccaactacatgtatttctgaatggcaacccacataaagtgacagaaacgttaagcaaggctcagcaggggcacactgggtgaatgtaaaaaaaaaaaaaaaaaaaaattcaggccgggcgcagtggctcacgcctgtaatcccagcactttgggaggccggggcaggtggattgcctgggttcaggagttcgagaccagcctgggcaacacagtgaaaccccgtctctactaaaaaaaaaaaaaaaaattagccaggcgtggtggcaggcacctgtaatcccagctactcaggaggctgaggcaggagaatcgcttgaacccaggaggcggaggttatatgagctgagattgcgccactgcactccagcctgggcaatagagcgagactctgtctcaaaaagaaaaa

SEQ ID NO: 148766 - DNA, 601 bp, Human
aatataaacgcctgttaagggaaattatatttgttacaatgtttatgttgagctatttaagttatattcaccttggaggctggtttttctcaccagcctgagacctcagctcactgactgcactcactagtcctaataaatcaacagcactagcaactttgcagtgtctcttaaatttacaagtggatctgaaggcattctccgtgaaatttttttttttttttttttttttgagacagagtctcactctgtcacccaggctggagtgcagtggtgcagtctcggctcactgcaacttccrcctcccgggttcaagcaattctcctgcctcagtctccagagtagctgggattacaggcgcccaccaccacacccggctaacttttgtgtttttagtagagaacagggtttcaccatgttggccaggctggtcttgaactcctgacctcgtgatccacctgcctcagcctcccaaagtgctgggattacaggcataagccactgcgcccggccaaaaatattcataaatgaagtgatgaatgatttcaaaacaatgcagtatctcaattttcccagtgattttctcatatcacttctttat

SEQ ID NO: 148767 - DNA, 601 bp, Human
acaaattatttaatttcatgtatgtacatttgggtgcaaactaatctacagtgacagaaagaaaatgtagattgcctggggccaggcagacttaaccacggtgatggtgaaactcattggagtgtacccttaagagggcaatggttattgaaaataaattgcaccactatcaaattgatcagaagccctaacaaattaaaagctagagatattacaggccattttccctgatcataatctaatcaagttacaaatactaaaaacatgaccaaatcactaagtatggaagcccaaatattakaaacaaggacgtaagtaacccttcaactgaagaggaaataaaaactgaaagtgtaaaaattccagaaagcagctgggcgtggtggctcacacctgtaatcccagcactttgggaggccaaggtgggaggatcaaaaggtcaggagtttgagaccagcctggccaacatcgtgaaaccccatctctactaaaaaagatacaaaaattagctgggcttgatggcacatgtctgtaattccagctactcaggaggctgaggcaggagaattgcttgaactcgggaggcagatgttgcggtgag

SEQ ID NO: 148768 - DNA, 601 bp, Human
ccaaaaccagaaagcaactcaaatgtccatcaacaggtgaatagacaaactgtggtatgtccacacaggtagcatcacttagcaacagagacagatgaattgctgatacaccaaacaacacgggagaatctcaaagtctttatgctgagtgtaaaaggccagatacaaattatttaatttcatgtatgtacatttgggtgcaaactaatctacagtgacagaaagaaaatgtagattgcctggggccaggcagacttaaccacggtgatggtgaaactcattggagtgtacccttaagagrgcaatggttattgaaaataaattgcaccactatcaaattgatcagaagccctaacaaattaaaagctagagatattacaggccattttccctgatcataatctaatcaagttacaaatactaaaaacatgaccaaatcactaagtatggaagcccaaatattagaaacaaggacgtaagtaacccttcaactgaagaggaaataaaaactgaaagtgtaaaaattccagaaagcagctgggcgtggtggctcacacctgtaatcccagcactttgggaggccaaggtgggaggatcaaaa

SEQ ID NO: 148769 - DNA, 601 bp, Human
agttgatcgacgtgtcagtcataagggaattcaaacttaaatcacacagagataccaccacattcctactcaaatgtctgaaattaaaaagactgactgtgctaagtgttggcaaggaacactggtggaggaactggaacactcatgcatacttgtgggaaggtaaatgctacaaccactttgccaacagttgagcattttcctgtacaactgaacatgccaccaaatgacccagaaattccactcctaggtgtttacccaagagaaacaaacacttaagttcacacaatggcaggaacargaatgttcatggtagtttcatttgtaacagccaaaaccagaaagcaactcaaatgtccatcaacaggtgaatagacaaactgtggtatgtccacacaggtagcatcacttagcaacagagacagatgaattgctgatacaccaaacaacacgggagaatctcaaagtctttatgctgagtgtaaaaggccagatacaaattatttaatttcatgtatgtacatttgggtgcaaactaatctacagtgacagaaagaaaatgtagattgcctggggccaggcagacttaaccacggtgatg

SEQ ID NO: 148770 - DNA, 601 bp, Human
acatgatgtcgcagccattgtaaggtgtaccacgtggtaccttttctatgtttagatgtgcttaggtacgcaaatactcaccactgtgttacaacttccgtgccattcaggcagtcacgtgctgtgcagggttgtgcccgggagcaccaggctacccccaacagcctgggcgtgcagggttgctccatctgggtgtgcaacagtgcactctttgatgttcgcacagcaacaaagtcacctaatgacacagtcctcagaacttgtccctttcgttacatgatgcatgactgcacgaaaagayacacgtggctgttacaaataaagttgatcgacgtgtcagtcataagggaattcaaacttaaatcacacagagataccaccacattcctactcaaatgtctgaaattaaaaagactgactgtgctaagtgttggcaaggaacactggtggaggaactggaacactcatgcatacttgtgggaaggtaaatgctacaaccactttgccaacagttgagcattttcctgtacaactgaacatgccaccaaatgacccagaaattccactcctaggtgtttacccaagagaaacaaacacttaa

SEQ ID NO: 148771 - DNA, 601 bp, Human
tatataaatatatgtgtgtgtgtgtgtatatatatgtatatatatatatattagccagacatggtgacgggcaaccgtaatcccagcactttgggaggccaaggcgggcagatgacttgaggtcaggagttcgagaccagcctgggcaaaatggggaaaccccgtctctactaaaaaaaaaaatatatatatatatatatatacacacacatatacacacacagacacatatatgtgtatatacatacacacacgtatgtatatataaatatatgtgtgtgtgtgtgtatatatatgtatrtatatatatatatattagccagacatggtgacgggcacccgtaatcccagctacttgagaggctgaggcaggagaattatttgaaccctggaggtggaggttgcagtgagccaagatcgtgccactgcactctagcctgggcgacaaggcaagactctgtctcaaaaaaacaaaaggttggccggacgcagtggctcacacctgtaatcccagcactttgggaagtcgaggcgggcagatcacgaggtcaggagattgagaatagcctggctaacatggtgaaaccccatctctactaaa

SEQ ID NO: 148772 - DNA, 601 bp, Human
gcttggtgggtggggaaaaccttcatacatttggtcacagacatcttctgtgttgattatccttgtggagtgagggcaaagggaaaaacagtttgagtttttcttaacatcttcaaaagacactgtcttaaaaaatgaaaaggtacaccacaggctgagagaatatatttgcaaaccacacatctgataaagatcttaggccgggcgcagtggctcacgcctgtaatcccagcactttgggaggccaaggcgggcagatgaattgaggtcaggagttcgagaccagcctgggcaaaatggrgaaatcccatctctactaaaaaatatatatatatatacacacacatatacacacacagacacatatatgtgtatatacatacacacacatgtatgtatatataaatatatgtgtgtgtgtgtgtatatatatgtatatatatatatattagccagacatggtgacgggcaaccgtaatcccagcactttgggaggccaaggcgggcagatgacttgaggtcaggagttcgagaccagcctgggcaaaatggggaaaccccgtctctactaaaaaaaaaaatatatatatatatatatata

SEQ ID NO: 148773 - DNA, 601 bp, Human
caacatggtgaaaccccgtctctactaaaaatacaaaaattatccaggcatggtggcatgtgcctgtaatcccagctactcagtaggctgaggcacaagaattgcttgaacccaggaggcagaggttgcagtgagccgagattgcaccattgtactttagcctgagcgacagaggcaggctccgtctcaaaaaataaaaaataaaaagatcctctgtaataaaccataggcatatgtttccctgaattctgtgagttgctctaggaattaaacccaagaggggtcgcatgaaccccaactygaagccggtcgttcagacattctagggtcctggacttgcgactggtgggatggagggggcagccttgtgggactgagccctcaacgtggggtttctgaggctgtctccaggtagacagcatcagaatggaattgaattggagaacaccctgctgttgtccactgccggactgactgcttgcttggtgggtggggaaaaccttcatacatttggtcacagacatcttctgtgttgattatccttgtggagtgagggcaaagggaaaaacagtttgagtttttcttaacatcttcaaaagac

SEQ ID NO: 148774 - DNA, 601 bp, Human
cgatggagtctcctcaagaggcggggttcaggagcttccagagagctgggcacatggaggctggaaggaaggcgaagaactcatccacgtgccaggagggtagcaccccagctccacggggtggaagctcctcagaagggtggcaccccaactccacagggtggaagctcctatccttgggacccttcaggcctggccatgtgtctcttcatctggctatgtgtatccttgaaaatatcctctgtaggctgggcatggtggctcacacctgtaatcccagcactttgggaggccgagatgrgcggatcacctgaggtctggagttcgagaccagcccagtcaacatggtgaaaccccgtctctactaaaaatacaaaaattatccaggcatggtggcatgtgcctgtaatcccagctactcagtaggctgaggcacaagaattgcttgaacccaggaggcagaggttgcagtgagccgagattgcaccattgtactttagcctgagcgacagaggcaggctccgtctcaaaaaataaaaaataaaaagatcctctgtaataaaccataggcatatgtttccctgaattctgtgagttgctc

SEQ ID NO: 148775 - DNA, 601 bp, Human
ggcgcctgtagtcccagctactcgggaggctgaggcagaatggtgtgaacccgggaggcggagcttgcagtgagccaagatcgcgccactggactccagcctgggcaacagagcgagactccgtctcaaaaaaacaaaaagacttactataatcaaggcactatggtataaacaaaagaacagacatataggccaggcacagtggctcacgcctgtaattccagtactttgggaggccgaggtgggtggatcacctgagctcaggagttcaagacaagcctgatggacatggtgaaacccygtttctactaaaaatgcaaaaattagctgggtgtggtggcgtgtgcctgtaatcccagctacttgagaggctgagtcaggagaatcacttgaacccaagaggtggaggttgcagtgagccgagatggcaccactgaactccagcctgggtgacagtgagactccgtctcaaaaaaaaaaaaaaaaaaaaaagaacagacatctagatcaatggaaagtatagaaagtccagaaatagacccatacatatattgtcaatcgatttttgacagagctgcagagggaattcaatgagggtgag

SEQ ID NO: 148776 - DNA, 601 bp, Human
caatatctaaataaagaaagacacttgttatttttctggccagggtaactccacacgtaaagacgtccatcctccccaaactccgaagaattaagaagaaaattctgtgaaatctgacaagctgagtgttgcatacagacctgcaaaaggcccatttgccaggacagacacctgaaggaaaaagaggagagtgaggtccaccagataccaagacagaatgatgatggtgcagtgggaggaagacagacaacgggcccagagtggggagcccatccccagacccccacagacacaggacccmcacgtgggaccagagacagaggtggaggctcaggaccctggagaaagaatgcagtatccccagatgggacaggatacttaatgggaaagaataaaactggacccctgcacaacacacagacacattcttattgattgtagaactaaacatgaatcccaaataaatgtaggcaaagaaaaacacagtccttgccactctctggcccgtcaccagctgtatttccctttgtagttgtccattacctgaaatggtgccatctgttgtttgtttgcttctgattgccagtctgctaacagaaag

SEQ ID NO: 148777 - DNA, 601 bp, Human
gttcccttacacggtaagtacaatgacaatggctgcattcaatttagtatacgttatacataatgtatatgtaaatactacatccattaaagttgatttttaaagcttcattttgaaataattgtagatttacggaagagtcacaaagattgtataagagggctccctagacgctgacattgcagccaccgagtgttcgtcaaagctgagacctggacatggtaccagcgaccaccccactgaagacttcatgtgggcctcaccacttttccagatccgcctcccgggttcacgcaattcycttgcctccgcctcctgagtacctgggactacaggcacgcgccaccacgcctggctaatttttgtattttcagtagagacgggtttcaccgtattggccagggtggtctcgaactcctgactgcctgatccgcctgcctcggcctcctaaagtgctgggattacaggcatgagccactgcacccagcccaatgttaatttttaagaatggaaaaatgctttttaacttgaaataaaactacggggaaaattatagaattgaatgaaaaattaaacaatatctaaataaagaaagacactt

SEQ ID NO: 148778 - DNA, 601 bp, Human
tacttttctcatgagctgctgattcacaggccccacaaacacctccctaaacagctctgcaactcagcccacaggacagatatgcataattacgggctctgaatacagcaggcactgcggggagccctggccctcggcagctccagagagcagagcaagctggctggacccagcacacaggtgtcactgagggaggtgacttggcagagcggccaggctcctccatggccacttatagccctcagcgttgcaggggtgctcctggaccagcctcgtgtgtgtgaggggactccggccacaygttgcccctgcaaatgccgctctccccccgcggccacccggccccctctcgaggtgctcctcagtggtgaggcactggctctgccccctccttgaaggtcttgcctctgggctctgccccctggatgccagacctcctaaggactgcccccgaccagctgagcccatgcctcgggtagagatgtcaggtgaaattgtgggttagactaacaccacccagccactttccacctgggtccaggtgtgccccccacctcgtttctgtggattcagcagctccatgtccctggcgctctgggtt

SEQ ID NO: 148779 - DNA, 601 bp, Human
ctagtcactacttttctcatgagctgctgattcacaggccccacaaacacctccctaaacagctctgcaactcagcccacaggacagatatgcataattacgggctctgaatacagcaggcactgcggggagccctggccctcggcagctccagagagcagagcaagctggctggacccagcacacaggtgtcactgagggaggtgacttggcagagcggccaggctcctccatggccacttatagccctcagcgttgcaggggtgctcctggaccagcctcgtgtgtgtgaggggactcyggccacacgttgcccctgcaaatgccgctctccccccgcggccacccggccccctctcgaggtgctcctcagtggtgaggcactggctctgccccctccttgaaggtcttgcctctgggctctgccccctggatgccagacctcctaaggactgcccccgaccagctgagcccatgcctcgggtagagatgtcaggtgaaattgtgggttagactaacaccacccagccactttccacctgggtccaggtgtgccccccacctcgtttctgtggattcagcagctccatgtccctggcgc

SEQ ID NO: 148780 - DNA, 601 bp, Human
ggccgctgaggggaccgggctgagtgggagtgaccttgcgtggctgtcctggtgctggcagccactctgggccgcctcgtgaatcccagtgggtgcccccctccctgagtcctcactccaggccgggctcacctgagagcgcaccccccatgccaggtggccgccccacgacccctcggcccagggccccaggcagccagccaggctccacgcagggctgcgcatcggaatgcgggcctaggaagcccgccagggctggcgctgtggtcaggagcaggaggggctgggccccacagagggwgcccaacccggagcccccacccctcacccctccgccactctgaagcccccaaagggtaggaggcccagggggacgcccgcccctcttccgggcagccccttccacccaggcgggatctgggtccccgctggactcagggccgccttcccgcaggcggggccggcccggcgcgcaccttgtctcggatgccctggcgcacggcctcgcgctccgcctccatcttggcgtacttggccttgcgctcctcctccgcctggcgcagcgcctcctgccgctcctcctccttcttggcggcgtctg

SEQ ID NO: 148781 - DNA, 601 bp, Human
gggctggaggcttgagccagcacagcaaagtcgatcaacaggagatccctggaaacgtccagtgaccctgggtgggatgccagggcgcccggcccccactccccatcagcggcttctctgcaccctccagggtgcatggcggtgggcggggggctgcgagggaccggagggtgtggggagaatccgtgggtggggaggagctggccttttgggtacagcggctgcatgtgccccacctgccccgcccctgccctcccagctccacctctgtccacttcaggagctccagcttccccacaasaccccgtgaagcccacccttccctgggtgcggctgacacaaggccaggaaacggcttctccacctgctccaggtgccgccggcagcagggaggggtcccgggagtctgaaccttcccaccccgaagccaggccatcttggcccatccagggcaggggactgaggccaccttctgggaaacacagcttccggcctgctgggcctgctgcggcccctaccctcggggccagggcacggggtgagcactgcgccccaggcagcaccccaggccccttctacgtgggatgtgaacatctcccac

SEQ ID NO: 148782 - DNA, 601 bp, Human
tcctgacttcctcctgaagccctgggtcagctgcggggcggggggcggggagcggggggcggaggggtgggctggaggcttgagccagcacagcaaagtcgatcaacaggagatccctggaaacgtccagtgaccctgggtgggatgccagggcgcccggcccccactccccatcagcggcttctctgcaccctccagggtgcatggcggtgggcggggggctgcgagggaccggagggtgtggggagaatccgtgggtggggaggagctggccttttgggtacagcggctgcatgtgccscacctgccccgcccctgccctcccagctccacctctgtccacttcaggagctccagcttccccacaagaccccgtgaagcccacccttccctgggtgcggctgacacaaggccaggaaacggcttctccacctgctccaggtgccgccggcagcagggaggggtcccgggagtctgaaccttcccaccccgaagccaggccatcttggcccatccagggcaggggactgaggccaccttctgggaaacacagcttccggcctgctgggcctgctgcggcccctaccctcggggccagggc

SEQ ID NO: 148783 - DNA, 601 bp, Human
tgtccccgtctcccgctcctgatacccacagtctcccgagcacatcccagtggactgtggctgcctggctgagatggtgcattttctcctgacttcctcctgaagccctgggtcagctgcggggcggggggcggggagcggggggcggaggggtgggctggaggcttgagccagcacagcaaagtcgatcaacaggagatccctggaaacgtccagtgaccctgggtgggatgccagggcgcccggcccccactccccatcagcggcttctctgcaccctccagggtgcatggcggtgggyggggggctgcgagggaccggagggtgtggggagaatccgtgggtggggaggagctggccttttgggtacagcggctgcatgtgccccacctgccccgcccctgccctcccagctccacctctgtccacttcaggagctccagcttccccacaagaccccgtgaagcccacccttccctgggtgcggctgacacaaggccaggaaacggcttctccacctgctccaggtgccgccggcagcagggaggggtcccgggagtctgaaccttcccaccccgaagccaggccatcttggcccatc

SEQ ID NO: 148784 - DNA, 601 bp, Human
cctcctgtccccgtctcccgctcctgatacccacagtctcccgagcacatcccagtggactgtggctgcctggctgagatggtgcattttctcctgacttcctcctgaagccctgggtcagctgcggggcggggggcggggagcggggggcggaggggtgggctggaggcttgagccagcacagcaaagtcgatcaacaggagatccctggaaacgtccagtgaccctgggtgggatgccagggcgcccggcccccactccccatcagcggcttctctgcaccctccagggtgcatggcgktgggcggggggctgcgagggaccggagggtgtggggagaatccgtgggtggggaggagctggccttttgggtacagcggctgcatgtgccccacctgccccgcccctgccctcccagctccacctctgtccacttcaggagctccagcttccccacaagaccccgtgaagcccacccttccctgggtgcggctgacacaaggccaggaaacggcttctccacctgctccaggtgccgccggcagcagggaggggtcccgggagtctgaaccttcccaccccgaagccaggccatcttggc

SEQ ID NO: 148785 - DNA, 601 bp, Human
tccctctctgtgtctctgtctctccctctgtcttctctctgtctctttatctctgtgtctctgttcctctctgttctctgactcccccttccttctcctcctgtccccgtctcccgctcctgatacccacagtctcccgagcacatcccagtggactgtggctgcctggctgagatggtgcattttctcctgacttcctcctgaagccctgggtcagctgcggggcggggggcggggagcggggggcggaggggtgggctggaggcttgagccagcacagcaaagtcgatcaacaggagayccctggaaacgtccagtgaccctgggtgggatgccagggcgcccggcccccactccccatcagcggcttctctgcaccctccagggtgcatggcggtgggcggggggctgcgagggaccggagggtgtggggagaatccgtgggtggggaggagctggccttttgggtacagcggctgcatgtgccccacctgccccgcccctgccctcccagctccacctctgtccacttcaggagctccagcttccccacaagaccccgtgaagcccacccttccctgggtgcggctgacacaaggcc

SEQ ID NO: 148786 - DNA, 601 bp, Human
gcctcactctccctggcatctcccagtctctggagggtgcagctgctgcatcctgcccgggccactcggtccctgacgctgctggccctgtccccacctccttggggtcccctcagcctgccctatcctgcctctggggaccctgaggaatgacatggcctggaacagccagcgtccctgtaggatcatgccagcagaggccggagcccaggggaccagacccactccagagacacctccctggatacacggacccacacatagccctcccagaccccagcccaccatcgctttgtgtccytccctcagctgctacccactgccacctccacttctacccagcgtcagctctctctagctctgcctggggctctctcctctctgttccctgtgtctcggccttgattgctgtctctccctctctctgtgcctgtctctcctctctttgtctctctcccctctctctttccctctttttgtctttttctctgtctctccctctctgtgtctctgtctctccctctgtcttctctctgtctctttatctctgtgtctctgttcctctctgttctctgactcccccttccttctcctcctgtcc

SEQ ID NO: 148787 - DNA, 601 bp, Human
cacatggaagctgaggaggtgcttacgcttccccctctcctgggcctcactctccctggcatctcccagtctctggagggtgcagctgctgcatcctgcccgggccactcggtccctgacgctgctggccctgtccccacctccttggggtcccctcagcctgccctatcctgcctctggggaccctgaggaatgacatggcctggaacagccagcgtccctgtaggatcatgccagcagaggccggagcccaggggaccagacccactccagagacacctccctggatacacggacccasacatagccctcccagaccccagcccaccatcgctttgtgtccttccctcagctgctacccactgccacctccacttctacccagcgtcagctctctctagctctgcctggggctctctcctctctgttccctgtgtctcggccttgattgctgtctctccctctctctgtgcctgtctctcctctctttgtctctctcccctctctctttccctctttttgtctttttctctgtctctccctctctgtgtctctgtctctccctctgtcttctctctgtctctttatctctgtgtctctg

SEQ ID NO: 148788 - DNA, 601 bp, Human
tgcctggcagcaaggtcgggccagctccccataggcctgaccggcgagccctgcaccccagctgccagctctgggccccacatggaagctgaggaggtgcttacgcttccccctctcctgggcctcactctccctggcatctcccagtctctggagggtgcagctgctgcatcctgcccgggccactcggtccctgacgctgctggccctgtccccacctccttggggtcccctcagcctgccctatcctgcctctggggaccctgaggaatgacatggcctggaacagccagcgtccctstaggatcatgccagcagaggccggagcccaggggaccagacccactccagagacacctccctggatacacggacccacacatagccctcccagaccccagcccaccatcgctttgtgtccttccctcagctgctacccactgccacctccacttctacccagcgtcagctctctctagctctgcctggggctctctcctctctgttccctgtgtctcggccttgattgctgtctctccctctctctgtgcctgtctctcctctctttgtctctctcccctctctctttccctctttttgt

SEQ ID NO: 148789 - DNA, 601 bp, Human
gtgggttgcggagggggctgttcttgtgggcaagtgtgtggcctcaatccctgccacctgctgttctctgagggccttagaccaaggcaggatcacaggttggtgcctggcagcaaggtcgggccagctccccataggcctgaccggcgagccctgcaccccagctgccagctctgggccccacatggaagctgaggaggtgcttacgcttccccctctcctgggcctcactctccctggcatctcccagtctctggagggtgcagctgctgcatcctgcccgggccactcggtccctgaygctgctggccctgtccccacctccttggggtcccctcagcctgccctatcctgcctctggggaccctgaggaatgacatggcctggaacagccagcgtccctgtaggatcatgccagcagaggccggagcccaggggaccagacccactccagagacacctccctggatacacggacccacacatagccctcccagaccccagcccaccatcgctttgtgtccttccctcagctgctacccactgccacctccacttctacccagcgtcagctctctctagctctgcctggggctctctc

SEQ ID NO: 148790 - DNA, 601 bp, Human
gaggggccagtgggttgcggagggggctgttcttgtgggcaagtgtgtggcctcaatccctgccacctgctgttctctgagggccttagaccaaggcaggatcacaggttggtgcctggcagcaaggtcgggccagctccccataggcctgaccggcgagccctgcaccccagctgccagctctgggccccacatggaagctgaggaggtgcttacgcttccccctctcctgggcctcactctccctggcatctcccagtctctggagggtgcagctgctgcatcctgcccgggccactcrgtccctgacgctgctggccctgtccccacctccttggggtcccctcagcctgccctatcctgcctctggggaccctgaggaatgacatggcctggaacagccagcgtccctgtaggatcatgccagcagaggccggagcccaggggaccagacccactccagagacacctccctggatacacggacccacacatagccctcccagaccccagcccaccatcgctttgtgtccttccctcagctgctacccactgccacctccacttctacccagcgtcagctctctctagctctgcctgg

SEQ ID NO: 148791 - DNA, 601 bp, Human
cctgaaggcagggttcccccaccccaacaggtggccacgcctgagggcggggttcccccaccccaaaggctctgtggaggaggactctgtggggaaggtgtggacgtggggtccgggggggtccactgtggcagggcctccagagcagagaggctggtgcttccaaggcctgaggggccagtgggttgcggagggggctgttcttgtgggcaagtgtgtggcctcaatccctgccacctgctgttctctgagggccttagaccaaggcaggatcacaggttggtgcctggcagcaaggtcsggccagctccccataggcctgaccggcgagccctgcaccccagctgccagctctgggccccacatggaagctgaggaggtgcttacgcttccccctctcctgggcctcactctccctggcatctcccagtctctggagggtgcagctgctgcatcctgcccgggccactcggtccctgacgctgctggccctgtccccacctccttggggtcccctcagcctgccctatcctgcctctggggaccctgaggaatgacatggcctggaacagccagcgtccctgtaggatcatgccagcag

SEQ ID NO: 148792 - DNA, 601 bp, Human
cccagaggaggctggaggcagcaggtgttctgatcaggtggccacgcctgaaggcagggttcccccaccccaacaggtggccacgcctgagggcggggttcccccaccccaaaggctctgtggaggaggactctgtggggaaggtgtggacgtggggtccgggggggtccactgtggcagggcctccagagcagagaggctggtgcttccaaggcctgaggggccagtgggttgcggagggggctgttcttgtgggcaagtgtgtggcctcaatccctgccacctgctgttctctgagggscttagaccaaggcaggatcacaggttggtgcctggcagcaaggtcgggccagctccccataggcctgaccggcgagccctgcaccccagctgccagctctgggccccacatggaagctgaggaggtgcttacgcttccccctctcctgggcctcactctccctggcatctcccagtctctggagggtgcagctgctgcatcctgcccgggccactcggtccctgacgctgctggccctgtccccacctccttggggtcccctcagcctgccctatcctgcctctggggaccctgaggaat

SEQ ID NO: 148793 - DNA, 601 bp, Human
ccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcacactcttgacagagccgggactccaggggtctcctcagtraaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcctgtggggccaggggtgtgctggggagagcgatgccactggaagctaggtccggccagagagagcctccctccagccaggggtgtgggggtctgtgcatgtggcggcaacatg

SEQ ID NO: 148794 - DNA, 601 bp, Human
cccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcrcactcttgacagagccgggactccaggggtctcctcagtaaaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcctgtggggccaggggtgtgctggggagagcgatgccactggaagctaggtccggccagagagagcctccctcc

SEQ ID NO: 148795 - DNA, 601 bp, Human
cagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgyggccagaccaccacctggccactgaggagagaggggccgtgggctcgccctagtcctcagcagcccctgcacactcttgacagagccgggactccaggggtctcctcagtaaaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcct

SEQ ID NO: 148796 - DNA, 601 bp, Human
ctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgcyccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcacactcttgacagagccgggactccaggggtctcctcagtaaaacgaagagcacagggtaggaacgttctccgcacaacaggggcgacacccagagggccc

SEQ ID NO: 148797 - DNA, 601 bp, Human
aggacccccgggccaggtccaaggtcctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccmaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcacactcttgacagagccgggactccaggggtctcctcagtaaaacgaagagcacagggtaggaacgttctccgca

SEQ ID NO: 148798 - DNA, 601 bp, Human
tttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggtgggaaccagtggggttgggctggcctggaaggattgggggcctggtgttgtacggagctggacttccatcccctgaacaggacccccgggccaggtccaaggtcctggatctgagattacrggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgag

SEQ ID NO: 148799 - DNA, 601 bp, Human
acgcaggaaggggcagggaagggccctcccccagagcctccagagggagtgtgggattttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggtgggaaccagtggggttgggctggcctggaaggattgggggcctggtgttgtacggagctggacytccatcccctgaacaggacccccgggccaggtccaaggtcctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggc

SEQ ID NO: 148800 - DNA, 601 bp, Human
atggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagtgtgggattttgttcttctgccctccaggcctctaagtttttgtcaggccccggggttttggtttctagatcaatacgcctccccacsccacactcctccagccctcccgtgagccaccagcccaggaagcctgtggtcatggtcaggccacggaactacggaacagcctcctgctgcccaggaaggtgggaaccagtggggttgggctggcctggaaggattgggggcctggtgttgtacggagctggacttccatcccctgaacaggacccccgggccaggtccaaggtcctggatctgagattacaggtgctctggagtagtgaaggcgtcagcagctgcgtccaggagaaaacttaggaggggagtgggcaccagcactctaca

SEQ ID NO: 148801 - DNA, 601 bp, Human
atctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagtgtgggattttgttcttctgccctccaggcctctaagtttttgtcaggccccsgggttttggtttctagatcaatacgcctccccacgccacactcctccagccctcccgtgagccaccagcccaggaagcctgtggtcatggtcaggccacggaactacggaacagcctcctgctgcccaggaaggtgggaaccagtggggttgggctggcctggaaggattgggggcctggtgttgtacggagctggacttccatcccctgaacaggacccccgggccaggtccaaggtcctggatctgagattacaggtgctctggagtagtgaaggcgtcagcagctgcgtccaggaga

SEQ ID NO: 148802 - DNA, 601 bp, Human
gtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagygtgggattttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggtgggaaccagtggggttgggctggcctggaaggattgggggcctggtgttgtacggagctggacttccatcccctgaacaggacccccgggccaggtccaaggtcctggatctg

SEQ ID NO: 148803 - DNA, 601 bp, Human
gcatcctgccttccaggaagcctccggcccggggcagggaggggtgggcaggatgctgcgtggcagaggtggggagaaacagtcaccccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctgggctgcggtcacttccaggcactgggtgtcctggaatcccgcctagtcgtgccctcagccagyatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaaca

SEQ ID NO: 148804 - DNA, 601 bp, Human
tcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaccccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctsggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaag

SEQ ID NO: 148805 - DNA, 601 bp, Human
gacatgtgggggagcaaggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaccccgcagctgaccctcctgcccagtgcctggtccacgacctgcattcacactcccgggcctggccaaggctgcctggatgcggccgcggccccagcagggccactccctggcaggccrctgcagctccgtgggcagccggcagagggtcctgggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaa

SEQ ID NO: 148806 - DNA, 601 bp, Human
cgtgggtgcggccccctaccccaccaggcacacaaggaccccagaaggagaagagaccccaccccggggggtccctggaggaatgggaagcccccacggagaatgggggccaggagctgacatgtgggggagcaaggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcamcccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctgggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgt

SEQ ID NO: 148807 - DNA, 601 bp, Human
tcccctcggagttggcctccatggcggcctgggcctcggcctcgcgctcctccttcttcttgatgccgtactgcgggggaggcgggggtcagggcgggggtcccggcggctcccgggcgggccgcagcctccttgcgccagggactggcccaggaacccccgaaggcgtgggtgcggccccctaccccaccaggcacacaaggaccccagaaggagaagagaccccaccccggggggtccctggaggaatgggaagcccccacggagaatgggggccaggagctgacatgtgggggagcarggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaccccgcagctgaccctcctgcccagtgcctggtccacgacctgcattcacactcccgggcctggccaaggctgcctggatgcggccgcggccccagcagggccactccctggcaggccgctgcagctccgtgggc

SEQ ID NO: 148808 - DNA, 601 bp, Human
cgcgtcaagctcccctcggagttggcctccatggcggcctgggcctcggcctcgcgctcctccttcttcttgatgccgtactgcgggggaggcgggggtcagggcgggggtcccggcggctcccgggcgggccgcagcctccttgcgccagggactggcccaggaacccccgaaggcgtgggtgcggccccctaccccaccaggcacacaaggaccccagaaggagaagagaccccaccccggggggtccctggaggaatgggaagcccccacggagaatgggggccaggagctgacatgkgggggagcaaggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaccccgcagctgaccctcctgcccagtgcctggtccacgacctgcattcacactcccgggcctggccaaggctgcctggatgcggccgcggccccagcagggccactccctggcaggccgctgcag

SEQ ID NO: 148809 - DNA, 601 bp, Human
ctgcccttcggcggccctggcctcgggcgctgctgggtgggcggtaaacagcaagagaaaggggcgtcccaggcgatggggctccagccacccgcgggcagaggagcacggggcggactgggggggtcctgggggcgcgcgccccttgccgggtgagggaggcggcgggcgcgggcagggcgggcctggggctatggcttatatcggcgtgggggctgcgctctgctcgtccctcaggggcctccgcggaggatctgtagggggaggggcgggggctccgcggggccgctgtcccgcgcgsggctacttcttgagcatgtcctgcagcggcccgggcaggtacttgatgacggtgtccaggatgctctcgtcctcctcctccacctcgtccccgcagcccggcgggatggccttcttgggccgcgtcaagctcccctcggagttggcctccatggcggcctgggcctcggcctcgcgctcctccttcttcttgatgccgtactgcgggggaggcgggggtcagggcgggggtcccggcggctcccgggcgggccgcagcctccttgcgccagggactggcccaggaacccccgaaggcgtg

SEQ ID NO: 148810 - DNA, 601 bp, Human
ggaccggggagggcggtatctcccagttccacgtgttagtgacggcgcccccaatgtccccaggtccggacaggccgagatgacgccgagccccctgttgctgctcctgctgccgccgctgctgctgggggccttcccaccggccgccgccgcccgaggtgagttctggcgcccagcccggccagcctggcctccgccagcgccgcccccttcccgcccggccctgaaccctgccacagtgcccgcctggcacgcgccatgccccgcccctgccgccccgctcgccaggcccccttccttscagggccccctcacccatgggctgtccacagcacccaccggggctcccctagctggctggaggggttcccctcatgcgtgcttgctggccaggtgggctttagtcctggctccccaggacatgctcctggtcttgcaaacactttcatactcgtacctgcagtccagggcagctaatcacctgtggattcttggggagtgggcggtttgtggccacagtggacccgataaggactctgggaacctgcagagacccccacggaaggcaggatgggctgtgggagatattggtaatatactt

SEQ ID NO: 148811 - DNA, 601 bp, Human
ggtcttgcaaacactttcatactcgtacctgcagtccagggcagctaatcacctgtggattcttggggagtgggcggtttgtggccacagtggacccgataaggactctgggaacctgcagagacccccacggaaggcaggatgggctgtgggagatattggtaatatacttggtgtctgggactgaaactgacccccagacccccagtcccccagccgacctagccgtgtgccctgggcctgcccagctctaggcaggcagtgccgggcggttgtgtggacaagtccccagagccgtgaygcaccccaggactgcgtgcctctgggcacacgctgtgctggcctggtacgtgctcatggcaccgacatctaagtggcagccatgccctgggacccagccccagcaaggacatccggagccgatgggtgacgtgtgcccgcagactcatgcccgccatgttccaggatccgggcacagcgctggctgcccccatggctaggcgggacctgtggccaggccggccctttgggcgtgttgaccactcaggattgtccgcgctgtgtccaccagtcctgaggcttcgcacccctcccctgccgc

SEQ ID NO: 148812 - DNA, 601 bp, Human
cagcaaggacatccggagccgatgggtgacgtgtgcccgcagactcatgcccgccatgttccaggatccgggcacagcgctggctgcccccatggctaggcgggacctgtggccaggccggccctttgggcgtgttgaccactcaggattgtccgcgctgtgtccaccagtcctgaggcttcgcacccctcccctgccgcccagcaagcgcgccgcatccaacctggccttatatgggcacgttcgggtgctgggtggcgggcggtgaccaggtgggccttatgccacagcacccccccctaccccccgcctgcccacatgggcctggctgagcggctgctctgagggcccggcagcgtcctgggctgtgtgggcactcaggccatactgggcgagcccctaccatggccagcggcctggacttgcattctctttgatctgtttggcctccccaatccctacacctgcctgtcctctggccactcggccagggaggctctggaggcctctgtcctgccatgtttcctggctggggctgaagctgactggtggatggccacggtcagccatggcagtgggcggcagagcccgcctcttcgtg

SEQ ID NO: 148813 - DNA, 601 bp, Human
tttctcacagtgggaacttgagaggttctgcatgaaatgtctttcacaaataactctgaaggaagtcgtttcagggctttctgagaagtgccacctttgaacttttgcaagcatggccttgggggccagctctgagtggcctgcctaggaggccactcccctgtcctctgcacccggccagctgcggtgggcaagctgagccctgacccaggtgggcagggtgcctgtccaggggtgccccatgcctggggggtagcggggtcagtgtcggctccctgtgggggcaagagtctgaagggtggtgattcggggaagcaatagccgtgggtgtacggtgctgacctcggcccccagccaggcctcagggccttcctccctcgccccaggcccttccgggcagtggctggcccgtgtgcagcgggctgaggtggacgtgtgggagctgggcccagcccctgcaaggtggggaatcgggccagccgccccgtttccatctcggggccccactcctggaagggaaaataaatcactgtccccttggggggagggagggagccgtgaacaaagtcgcctttggctgggcctggaaacgccgaccgca

SEQ ID NO: 148814 - DNA, 601 bp, Human
gggctgaggtggacgtgtgggagctgggcccagcccctgcaaggtggggaatcgggccagccgccccgtttccatctcggggccccactcctggaagggaaaataaatcactgtccccttggggggagggagggagccgtgaacaaagtcgcctttggctgggcctggaaacgccgaccgcagactcctttatccattgtgcgggaatcaatgggcctccgggctccctttcagccgcaggccccgcgctgcggccctgtcaggggaaatgttggtttttccccagtcgtggcctccagcgcctggcttgcccagccctggctcaggaactgcggccgtgctgggagaggcgggctgtgcccgcagactggaccccggctgctgcatgctggccctctgtgcggcccgggcttgctgctcggcccagggtggactcctttgccccatcagggcctccgccagtgactccaggcctggtgtgtccaggtgacagcctcagcgggtcagcacaggagggagagggatacccacacccctctccccagaggccccctccagggctgcactccctgcctgcctgccactctccctggcggccatc

SEQ ID NO: 148815 - DNA, 601 bp, Human
cctgcctgcctgccactctccctggcggccatccctggagctgctggtcaagccccagggtgcctggctgccctctgcaggcggctccaaggtgggccgcagccccagagccatgatccaggatggctggggcaggggtgaagcaggggatgggagaggaggggcttcacgggccaaggcatacctagcaggagaggtgggtaccagtccccttggagcaagtcagcgtgggtgggggtctccttccaggtcattgcccctgtgtggggcaggggggtgctgcccatcttggcagaaggcycaattacttcttgcctggtgctgttaaggggctgaggggtgaacattggctgagcagtgacaggaaagagggagccgggctgttgcccttgtgtgtggcgtggggcccgctgggcacggtgacaccctctgggcttctaagactgagccccaggacagcctggtggccccgtggagagcttgggttccttgtccaggcccaccagccagtggcttcaaggccctctacactccctgtagccttcctgccctgttcccagtggtgactgcagggcttggtgtggagcgcagtaccatgcac

SEQ ID NO: 148816 - DNA, 601 bp, Human
ttgggttccttgtccaggcccaccagccagtggcttcaaggccctctacactccctgtagccttcctgccctgttcccagtggtgactgcagggcttggtgtggagcgcagtaccatgcaccagggtgcctgacgcaggcatcactgtgtgtcctggagggtctgggcggctgtgccctgtggcctgcaggggcctggggagctgcagcggacaggcccggtgccctcctgtccccagctctgtccttgagaagtccgccatgtgagtgggagcaagggcccctgacctggtggtgcccgstgtgcctgggctgctccgtggttggggcagccccacctgggggccaagagccctggcaggggacagagcatcagctcacccctgatctctggcctcaggggttctgggctcaggaaatgttcttgttgatgcttctgaagtggggaagggctgccaaggtctgcaggcagagcccctctggggagttccgggcaggggaggcctggggactgcagcccggcaggctggggttttgaggtgggggtgggggccacgtgaagctgggtgggcctggtgaggtctggactgggatgggtacgg

SEQ ID NO: 148817 - DNA, 601 bp, Human
ctgtggcctgcaggggcctggggagctgcagcggacaggcccggtgccctcctgtccccagctctgtccttgagaagtccgccatgtgagtgggagcaagggcccctgacctggtggtgcccggtgtgcctgggctgctccgtggttggggcagccccacctgggggccaagagccctggcaggggacagagcatcagctcacccctgatctctggcctcaggggttctgggctcaggaaatgttcttgttgatgcttctgaagtggggaagggctgccaaggtctgcaggcagagccccyctggggagttccgggcaggggaggcctggggactgcagcccggcaggctggggttttgaggtgggggtgggggccacgtgaagctgggtgggcctggtgaggtctggactgggatgggtacggaggaatctttgcctgttttagtgctgtacaaggttctctccagggcgtgggactgcctgatgatgctctggtgcccgctgtgtgccctggtgtgtcgaggagggggagcagtgccctggggctggggttgcagaaggttcccccgaatgcttccagggctgggcagcatggtgggcc

SEQ ID NO: 148818 - DNA, 601 bp, Human
ccctggcaggggacagagcatcagctcacccctgatctctggcctcaggggttctgggctcaggaaatgttcttgttgatgcttctgaagtggggaagggctgccaaggtctgcaggcagagcccctctggggagttccgggcaggggaggcctggggactgcagcccggcaggctggggttttgaggtgggggtgggggccacgtgaagctgggtgggcctggtgaggtctggactgggatgggtacggaggaatctttgcctgttttagtgctgtacaaggttctctccagggcgtggsactgcctgatgatgctctggtgcccgctgtgtgccctggtgtgtcgaggagggggagcagtgccctggggctggggttgcagaaggttcccccgaatgcttccagggctgggcagcatggtgggccacatgctgcatgcagcttgctggggcacagcctgtggggtagccacctgtgctgcaggcccccagttcccccgcacgtcctgtgggtctgctccccgagggccgcctcgctagctggtgactgtgtgtgccctgggtctgtgtatgcaggtgcacatgtatgtgcctgagcgtc

SEQ ID NO: 148819 - DNA, 601 bp, Human
gccgcctcgctagctggtgactgtgtgtgccctgggtctgtgtatgcaggtgcacatgtatgtgcctgagcgtcccggggctggggcagagcctggccctggcacctgatgggcagcaggctgcgtggcggtcacctgttctctggctcctgggggcggccactcttgcacttggcttcctgaggaggggactgggccctggcactgactctggggtttcccactcactcctgccctgggtgcccctgggggcctggcacagccacatagcggccatctgtgatgggggcactgtgtctcytctcggtaaccgggtggggggaccaccggctgcagaaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgcca

SEQ ID NO: 148820 - DNA, 601 bp, Human
cctcgctagctggtgactgtgtgtgccctgggtctgtgtatgcaggtgcacatgtatgtgcctgagcgtcccggggctggggcagagcctggccctggcacctgatgggcagcaggctgcgtggcggtcacctgttctctggctcctgggggcggccactcttgcacttggcttcctgaggaggggactgggccctggcactgactctggggtttcccactcactcctgccctgggtgcccctgggggcctggcacagccacatagcggccatctgtgatgggggcactgtgtctcttctyggtaaccgggtggggggaccaccggctgcagaaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgccaggac

SEQ ID NO: 148821 - DNA, 601 bp, Human
ggtaaccgggtggggggaccaccggctgcagaaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgccaggacrctcttggtccagctcctccatgcgggaacttgggtagccggtcagggttggggttgagggggccacacagccagctcctcagcggtcagctccacctgcccctccctccccagcgcacactggctccgtctgtccccacagacgccccaccctgctgtgttgttgaccagcatcagcccctgccgcagtgagtgctccttccttgggaagcccccgttgtccctactgggtcaggagtcccgtccgacctgggcaggtgctgcctcgggctctgtagaggggtggataccactggcctgg

SEQ ID NO: 148822 - DNA, 601 bp, Human
aaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgccaggacgctcttggtccagctcctccatgcgggaactygggtagccggtcagggttggggttgagggggccacacagccagctcctcagcggtcagctccacctgcccctccctccccagcgcacactggctccgtctgtccccacagacgccccaccctgctgtgttgttgaccagcatcagcccctgccgcagtgagtgctccttccttgggaagcccccgttgtccctactgggtcaggagtcccgtccgacctgggcaggtgctgcctcgggctctgtagaggggtggataccactggcctgggctgtagaggcgtcctgggaggtgcagggtg

SEQ ID NO: 148823 - DNA, 601 bp, Human
tcagagaggccaaggactgggatgggccgggtgagccagggctgagaagaatccctccctccagagcctcagcccaccctttgtgtttctgggcacagcagggaggcgccgtgtctccactcccagccccagcggccaatgatgcctgtgggctcagaacctagaggccctgggcaacgccccctgtgctatcagcactgattgggaggcctccagagaggtgatagggattctctgtgagggtccctgtccccagacttgggggtcagaatgggagctgctccctgagtgtctgaagacrccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcgggatggacactgtcacccatgggctggcgagagatgccctgggaactgtggggtgcctgcggccgcctctccgacatggagagcagtgagtgggctgtggtcgccgctgcaggacttgggagcagcacgtggggagtggggcacgcagggcc

SEQ ID NO: 148824 - DNA, 601 bp, Human
tgggctcagaacctagaggccctgggcaacgccccctgtgctatcagcactgattgggaggcctccagagaggtgatagggattctctgtgagggtccctgtccccagacttgggggtcagaatgggagctgctccctgagtgtctgaagacgccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcrggatggacactgtcacccatgggctggcgagagatgccctgggaactgtggggtgcctgcggccgcctctccgacatggagagcagtgagtgggctgtggtcgccgctgcaggacttgggagcagcacgtggggagtggggcacgcagggccctcctttcccaggagctccatccaggtacaggccctgcggtgccccgagtttctgaggcctgcagggtctgtgtgttctaggttcatcttcctggccggcttggcactgcccactggggctggtcacacacacacagaaccctggccc

SEQ ID NO: 148825 - DNA, 601 bp, Human
agacttgggggtcagaatgggagctgctccctgagtgtctgaagacgccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcgggatggacactgtcacccatgggctggcgagagatgccctgggaactgtggggtgcctgcggccgcctctccgacatggagagcagtgagtgggctgtggtcgccrctgcaggacttgggagcagcacgtggggagtggggcacgcagggccctcctttcccaggagctccatccaggtacaggccctgcggtgccccgagtttctgaggcctgcagggtctgtgtgttctaggttcatcttcctggccggcttggcactgcccactggggctggtcacacacacacagaaccctggccctgccttccagcccagaggcacccaggcaggggatggggtggggtggggactgaggcaggggatggggtggggacccaggcaggggatggggtggggacccacccag

SEQ ID NO: 148826 - DNA, 601 bp, Human
atccccctactgcccttgtccttggggggccactgtcccctctgacctcgggtgtacggctgcttcctgtatgaccagaaggagactctgcccttttggttggtggttttcgagagttaccaagcgcagctgttttgcatcctctggggaccctgctcccttctcgtgtctcaaagagccagcctctggggccacggggctgccccggccatgagaggctgctgacgtggtgtttgctgggccagtgctcagggctttggtgcatgtgggcagctgaggcctgggtcaggggcactgcacstcggcccctctgctcatcttgggcaggtgacccaggtggagctcaggcccgaggtctgtgctgggccgtgggtccccttttgaccgcccccccggctccggaccccaagcccctcctcgctgactgttcctcggtcccacccgcaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccg

SEQ ID NO: 148827 - DNA, 601 bp, Human; identical to SEQ ID NO: 40541

SEQ ID NO: 148828 - DNA, 601 bp, Human; identical to SEQ ID NO: 40542

SEQ ID NO: 148829 - DNA, 601 bp, Human; identical to SEQ ID NO: 40543

SEQ ID NO: 148830 - DNA, 601 bp, Human; identical to SEQ ID NO: 40544

SEQ ID NO: 148831 - DNA, 601 bp, Human; identical to SEQ ID NO: 40545

SEQ ID NO: 148832 - DNA, 601 bp, Human
taaccccagatctgtagcaggaatctgttttcttcacccacccaggcttttggaccacctgatcctaatctcctctgcctttatgggctcaggaatcagttagagcttagccctgcctgggcctgaacttgtagcacaaaccagtcctttcgtcaatcctgccttgcccccactcaaggctcttgatagcacctttcttctgctcttttcttccccacaaatcctctttcctgtgcacacagtttgctcaagtgcatccctcatgtgctacaagaattcaacgttagtgagttcaagaccrtgcctttagacctgcctgttgtaggaccaaatacaaatcagaagaggcttaatgctttctctttagaatgaggaaagaatttttactcttctcccttaaagcatttagtttgaaaacttttatatttaaatattttctctgcttctttgaaatatatataactcattttaatctgttaactaggtgatttgtcttttttgactcaaaattgtctttaggacatggaaactattgctttgaaatgtgcatagcaagaatatataacctattccgcaatttctgtagcagagtaggaggctg

SEQ ID NO: 148833 - DNA, 601 bp, Human
ctgcctttatgggctcaggaatcagttagagcttagccctgcctgggcctgaacttgtagcacaaaccagtcctttcgtcaatcctgccttgcccccactcaaggctcttgatagcacctttcttctgctcttttcttccccacaaatcctctttcctgtgcacacagtttgctcaagtgcatccctcatgtgctacaagaattcaacgttagtgagttcaagaccatgcctttagacctgcctgttgtaggaccaaatacaaatcagaagaggcttaatgctttctctttagaatgaggraagaatttttactcttctcccttaaagcatttagtttgaaaacttttatatttaaatattttctctgcttctttgaaatatatataactcattttaatctgttaactaggtgatttgtcttttttgactcaaaattgtctttaggacatggaaactattgctttgaaatgtgcatagcaagaatatataacctattccgcaatttctgtagcagagtaggaggctgccttcagcaggtacctgccttcacatatcaaatctacctcctgtcctgaagctgtgggaagtttattttccctt

SEQ ID NO: 148834 - DNA, 601 bp, Human
gtgagttcaagaccatgcctttagacctgcctgttgtaggaccaaatacaaatcagaagaggcttaatgctttctctttagaatgaggaaagaatttttactcttctcccttaaagcatttagtttgaaaacttttatatttaaatattttctctgcttctttgaaatatatataactcattttaatctgttaactaggtgatttgtcttttttgactcaaaattgtctttaggacatggaaactattgctttgaaatgtgcatagcaagaatatataacctattccgcaatttctgtagsagagtaggaggctgccttcagcaggtacctgccttcacatatcaaatctacctcctgtcctgaagctgtgggaagtttattttccctttgaatattaccaattaggaaacccggatgacctcccaaattactaggtgaaagtgtaataaactatgtatgatacatggtactgtcaagtcttctacttgagagctaattatggtgactttctttgttttggcagtctcttagtagactgcctgtaatgcacaccacattttgtttaattctctaacaacacattttcttgctgttctatta

SEQ ID NO: 148835 - DNA, 601 bp, Human
ttatcctaatggaatatgtttccatttatttgtttctacttcactttctgtcattgatatcttattgtatttagtgtataatactatatgttttttatgtcatttggttaaatttattttgattaactttcttatttttatactattgcaaatggaaatggtttctatttttggaaagtttgtttttactctatggaaatgcaagaaatatttgtatgtggtgccaggtgcagtggctcatttctgtgatcccagcactttcagagcccaaggcagttgtatcatgtgagtacaggagtttgagataagcctgggcaatagagtgaggccctgtctcaaaaaaaaaaaaatcccaacaagcatctatatgttgattatgtatcctgatactttaatgaatgcatttattagttcaatcaatttttcttattttactctagggttttatgtatatgcatgatgatattatccacaaacagtaacttttttatttcttttccactctggagagctttattctccttttccttgtctaattgttttgatacaaacttccagtcacatgttaagatagaagctgtggccctggaggcaggcctgc

SEQ ID NO: 148836 - DNA, 601 bp, Human
aattcagcaccagcctgggcaacctggtgaaatcccacctctaccaaaaatacagaaagttagccaggcatggtggcacgaacttgtattcccagctacttgggggactgagtctggaggattgcttgaaccctcagaggtcaaggctgctgtgacctgagatcatgccagtgcactccagcctgagtgacaaagtgagaccctgtctaaaaaaaaaaaaaatcacagcagacttggtcagaaggagatggtgggtctgttgaagaatggagagtttattaatttattattattattattwtttttttttttttggagacagagtctcactctcgtccaggctggagtgcagtggcgagatctcggctcactgcaacctccacctcctgaattcaagtgattttcctgcctcagcctctcaagtagctgggactacaggtgtgtgccaccatgcctggctaattttttgtatttttagtagagacgaggtttcaccatgttggccaggctagtctggaactcctgacctcaggtgatccctccaccttggcctcccaaaatgctaggattacaagcatgagccaccactccccgctgagag

SEQ ID NO: 148837 - DNA, 601 bp, Human
caccagcctgggcaacctggtgaaatcccacctctaccaaaaatacagaaagttagccaggcatggtggcacgaacttgtattcccagctacttgggggactgagtctggaggattgcttgaaccctcagaggtcaaggctgctgtgacctgagatcatgccagtgcactccagcctgagtgacaaagtgagaccctgtctaaaaaaaaaaaaaatcacagcagacttggtcagaaggagatggtgggtctgttgaagaatggagagtttattaatttattattattattattattttttwttttttggagacagagtctcactctcgtccaggctggagtgcagtggcgagatctcggctcactgcaacctccacctcctgaattcaagtgattttcctgcctcagcctctcaagtagctgggactacaggtgtgtgccaccatgcctggctaattttttgtatttttagtagagacgaggtttcaccatgttggccaggctagtctggaactcctgacctcaggtgatccctccaccttggcctcccaaaatgctaggattacaagcatgagccaccactccccgctgagagttttact

SEQ ID NO: 148838 - DNA, 601 bp, Human
taattgtctgtattttttgtagagttggggtttcactgtgtttcaatctcttgacctcgtgatcctcccgcctcagcctcccaaagtgctggaattagaggtgtgagccaccgcacccgaccaaggcctcacttaattttatcacaatggcagttaaattttaacacgaattttgaggggacactaaaaccatagcagtgtgtttttattgcatagctaaatctttctatatttaaatgaattaccgattgataagaacttattactgccattttattcattgtttactgaccatttagtrgtttctgttttttaattccttcatgctgtcatcttttgtgttttcttgaatttttgttttgtttttgttgccttctttttcttgtatgtgcatctactagttttttttttgtaatttccaagagacttacatgaaacctctcattttaaaattttgccttcaatttaaccttttgttttgtacagatagggtcttactttgttactcaggctatagttcagtggtgcattcacagttgagtgcagcctcaacctttgtgggctcaagcaatcctcccatctcagcctcttgagtagctgg

SEQ ID NO: 148839 - DNA, 601 bp, Human
ttaaccttttgttttgtacagatagggtcttactttgttactcaggctatagttcagtggtgcattcacagttgagtgcagcctcaacctttgtgggctcaagcaatcctcccatctcagcctcttgagtagctggaactacaagcacatgccaccatattcagctaattttgtcagtgctttttgtagagacggggttttgccatgttgctcaggctggtcttgaactcctgacctcaagcacttgatttgacctcccaatgtactaggattacaggcatgagccatcaggcccagtcayttctttttttaaaagattgaatagctttctgagatctttattttatttatgtatttattttagagacagcgtcctgctatattgacccaggaggtggaggttgcagtgagccgagatgtcaccactgcactccagcctgagtgatagagtgagactctgtctcaaaaaaaaaaaaaaaagaatctctctttgtctttgaattctggcagtttaattataatgtgtcctgagcaatttttatgaggttcttgctatagagattttaagcttcataaaactgaatgtctattttccttccaa

SEQ ID NO: 148840 - DNA, 601 bp, Human
gacattatacctttacacaattaaaaaaatttttttttctctgtctcctgaacctcttaagagatgtacattcctacagataattatgcagtgtgggacccaaatgcttcagtcactctttcttttttcttttttctttttttttttttttttgagacagagtctcactctgttgcccaggctggagtgcagtggcacgatcttggctcactgcagcttgcgcctcccggattcaagcaattctctaccttagtctcctgagtagctgggactataggcgcgcgccaccacgcccgactamttttttctttttttctttttgtatttgtagtagagacaggatttcgccatgttggccaggatggtctcgatttcctgacttcgtgattcgcccgcctcagcctcccgaagtgctgggattacaggcatgagccaccatgcctggcctcattctttaagttttaattaggaactttcaaatgacttacttttaagtttgcttatttttttttcctgtagaactgagtcttctgttaaagcttgttgttaaattttttagttctattgtgtactccagcatatgtatttggttcttttttaa

SEQ ID NO: 148841 - DNA, 601 bp, Human
cactgcaacttctgcctcttgggttcaagcgattctcctgcctcagcctcctgagtagctgggactacaggcacacgccaccatgcccagctaatttttgtatttttagtagagacggggtttcaccatgttggccaggatgatctcgatctcctgacctcgtgatccacctgcctcagccgctcaaagtgctgggatcacaggcatgagccactgggcctggccaaaataatatattttaaactcttaaaaatgtaacttgaattgcatttgaaaattcttcctctttacatctgccctsaatgttgttattgatgtcactaatcatatttttttgctgtatatttattaccagattatgatgaatagtttataatcatttttatgcttttatcctttaaattttagagaaaaacttttttgcactattataatgatacagaactttatatttgtgtttgtgcatatgtttttcagaaagttatgtattttcatatcatcatattttttttcttgcatcctgttattttcaatggaagatagttcagcatttttttttataaggcaggtgttgtgctaatatacttttcagcatttggtt

SEQ ID NO: 148842 - DNA, 601 bp, Human
tcgtttttgccacttaaaaaacaacttcagccaggcatggtggctcacgcctgtaatcccagcactttgggaggctgaggcgggttggatcacctggggctgtgaccacagcccccacacacgcccgcaaggccgtgaccgcggcccccacacacccctgcgaggccgtgaccgcggcccccacacacccctgcgaggccgtgaccgcggcccccacacacccctgcgaggccgtgaccgccgccccacacacatgcccatgaaaccactcctggtgggaaaacggcctctacctcctccrgtgggaaaatatcatgacacaaaaaccatggacacaaactccaaatgcagagagggagagagggaatgcagagagcagagacaggaacacgagcccagccgtcacggctctaggggagaagacatgaggtcactctccccggccacacgcccgggccagggccagcctcagggcggagctcagctctggacaccgctcccgcaggaaggggccctggacgactccgggtggctcatcaagaatgtgctgtccatgcccatcgtcaacaagaaggaggagattgtgggagtcgccacattt

SEQ ID NO: 148843 - DNA, 601 bp, Human
tggccagaatgtggctttgatgtctgcactcctgagtgtatcttcgtgtcttcctgtctcctctgtgctttgccagatgtttagttttcaccggatgtttagtgggcctgacttggactctgtgtccatctatgtcatctctgctctcagagtgcctaggtgcctgcaactcccagtgtgtgtgcatccgcatgtgtgcacgcacatgggtgtctgtgtgcatgtgtgtgcacatgtgggtgtctgtgtgtgcacaagtgtgtacgtgtgtgtgcatgtaggtgtgtgtgcacacgtgggygtctgcacaggtgtgtacatgtgtgcacatgtgggtatgtgtgtgcacatgtgggtatgtgtgtgcgtgtgtgcattgtatgaatgtgcacatgtgtacacatgtgtgtgcacatgtgtgcccacgagtatgtgtgtgcatgtgtgtgcacatgggcgtttgtgtgtgtgtgcccgtgtgtgcacccatgtgtgtgtgctcacatgtgcacagggggtgtgtattgtgtgtgcatgtgtgtgcacatggatatatatagacacatgcttgtgtgtgtctcctagagacgattgctggatc

SEQ ID NO: 148844 - DNA, 601 bp, Human
agaatgtggctttgatgtctgcactcctgagtgtatcttcgtgtcttcctgtctcctctgtgctttgccagatgtttagttttcaccggatgtttagtgggcctgacttggactctgtgtccatctatgtcatctctgctctcagagtgcctaggtgcctgcaactcccagtgtgtgtgcatccgcatgtgtgcacgcacatgggtgtctgtgtgcatgtgtgtgcacatgtgggtgtctgtgtgtgcacaagtgtgtacgtgtgtgtgcatgtaggtgtgtgtgcacacgtgggcgtcttcacaggtgtgtacatgtgtgcacatgtgggtatgtgtgtgcacatgtgggtatgtgtgtgcgtgtgtgcattgtatgaatgtgcacatgtgtacacatgtgtgtgcacatgtgtgcccacgagtatgtgtgtgcatgtgtgtgcacatgggcgtttgtgtgtgtgtgcccgtgtgtgcacccatgtgtgtgtgctcacatgtgcacagggggtgtgtattgtgtgtgcatgtgtgtgcacatggatatatatagacacatgcttgtgtgtgtctcctagagacgattgctggatcaatgt

SEQ ID NO: 148845 - DNA, 601 bp, Human
gtatcttcgtgtcttcctgtctcctctgtgctttgccagatgtttagttttcaccggatgtttagtgggcctgacttggactctgtgtccatctatgtcatctctgctctcagagtgcctaggtgcctgcaactcccagtgtgtgtgcatccgcatgtgtgcacgcacatgggtgtctgtgtgcatgtgtgtgcacatgtgggtgtctgtgtgtgcacaagtgtgtacgtgtgtgtgcatgtaggtgtgtgtgcacacgtgggcgtctgcacaggtgtgtacatgtgtgcacatgtgggtrtgtgtgtgcacatgtgggtatgtgtgtgcgtgtgtgcattgtatgaatgtgcacatgtgtacacatgtgtgtgcacatgtgtgcccacgagtatgtgtgtgcatgtgtgtgcacatgggcgtttgtgtgtgtgtgcccgtgtgtgcacccatgtgtgtgtgctcacatgtgcacagggggtgtgtattgtgtgtgcatgtgtgtgcacatggatatatatagacacatgcttgtgtgtgtctcctagagacgattgctggatcaatgtggggattatgtggtgtccccatcaccctgtgt

SEQ ID NO: 148846 - DNA, 601 bp, Human
tatcttcgtgtcttcctgtctcctctgtgctttgccagatgtttagttttcaccggatgtttagtgggcctgacttggactctgtgtccatctatgtcatctctgctctcagagtgcctaggtgcctgcaactcccagtgtgtgtgcatccgcatgtgtgcacgcacatgggtgtctgtgtgcatgtgtgtgcacatgtgggtgtctgtgtgtgcacaagtgtgtacgtgtgtgtgcatgtaggtgtgtgtgcacacgtgggcgtctgcacaggtgtgtacatgtgtgcacatgtgggtakgtgtgtgcacatgtgggtatgtgtgtgcgtgtgtgcattgtatgaatgtgcacatgtgtacacatgtgtgtgcacatgtgtgcccacgagtatgtgtgtgcatgtgtgtgcacatgggcgtttgtgtgtgtgtgcccgtgtgtgcacccatgtgtgtgtgctcacatgtgcacagggggtgtgtattgtgtgtgcatgtgtgtgcacatggatatatatagacacatgcttgtgtgtgtctcctagagacgattgctggatcaatgtggggattatgtggtgtccccatcaccctgtgtc

SEQ ID NO: 148847 - DNA, 601 bp, Human
gtgtgtattgtgtgtgcatgtgtgtgcacatggatatatatagacacatgcttgtgtgtgtctcctagagacgattgctggatcaatgtggggattatgtggtgtccccatcaccctgtgtctgcctatgcaatttagccagaatctcccggggccacgagccttgtgagtaggccttggactgagcatgggaatgtgcctggtgggtctgaaagtccactgttgtgtgtgttacctcatggctgtgtgtgtgagcctacatgcgtgagtctgcacgtgtgtgcctgcatgtctgtgggtrtgcctgggtgctcatgtgtgtgcctgtgtgtccacaccggtgcctttgtattcatgggagtggccgtgtatccaggtgtgcctgtgtcacgtgtgtctgtatccgtgtgtgtgtgtgtttcttttcatgtgcacacctttgtgttttcttgtctcaacaacatcaccctgtccacccaactgggcaagttcttcactgttgggccacagggtacaagaggggagagtgaggctgagccaggggggcgtgtgagcagcctgggatacaggctggagcgccaggaatgacacatctcctcag

SEQ ID NO: 148848 - DNA, 601 bp, Human
atatagacacatgcttgtgtgtgtctcctagagacgattgctggatcaatgtggggattatgtggtgtccccatcaccctgtgtctgcctatgcaatttagccagaatctcccggggccacgagccttgtgagtaggccttggactgagcatgggaatgtgcctggtgggtctgaaagtccactgttgtgtgtgttacctcatggctgtgtgtgtgagcctacatgcgtgagtctgcacgtgtgtgcctgcatgtctgtgggtgtgcctgggtgctcatgtgtgtgcctgtgtgtccacaycggtgcctttgtattcatgggagtggccgtgtatccaggtgtgcctgtgtcacgtgtgtctgtatccgtgtgtgtgtgtgtttcttttcatgtgcacacctttgtgttttcttgtctcaacaacatcaccctgtccacccaactgggcaagttcttcactgttgggccacagggtacaagaggggagagtgaggctgagccaggggggcgtgtgagcagcctgggatacaggctggagcgccaggaatgacacatctcctcagagatgcctgaggtgtctgaggcttggcaggggatctg

SEQ ID NO: 148849 - DNA, 601 bp, Human
tggcatccagatgtactacgagctgggcgtggtccgaaagttccagatcccccaggaggtgggagacaccgcagggcgcatagtcaggtccctgaggccgcccaggacatgggggtggggatgtgatcagggcctcaggtgccccagaaggtgagggggatgggattgggggttccagatcccacaggaagtttagagggccgacatgttcatcacagaacaggtaaaatgcacacgggaagtaagcataaaacaaataattggatggctgggtggatggctggattgatggatggctggrtgggtgaaaagcagggaggaaggagggaggttaggaaggaaggaaggccaacaggcaagcagaaagaaacaaaggaagaataaatgaatggatgggtggatgccaatggtagttggatagttggataaatggatggatgggtgggtgggccaatggtagttggatagttggataaatggatggatgggtgggtgggccatggtagttggatggttggataaattgatggatgggtgggtgggcgggccaatggtagttggatggttggataaatggatggatgggtgggtgggccaatgg

SEQ ID NO: 148850 - DNA, 601 bp, Human
atgccaatggtagttggatagttggataaatggatggatgggtgggtgggccaatggtagttggatagttggataaatggatggatgggtgggtgggccatggtagttggatggttggataaattgatggatgggtgggtgggcgggccaatggtagttggatggttggataaatggatggatgggtgggtgggccaatggtagttggatggttggataaatggatggatgggtgggtgggccaatggtagttggatggttggataaattgatggatgggtgggtgggtgggccaatggtmgttggatggttggataaatggatgggtgggtgggccaatggtagttggatggttggataaatggatggatgggtgagtgggccaatggtagttagatggttggataagtgaatggataggtggatggatggagaagtgggtggatgagtgatagatgagtaggtgggtcaattaatgaattaatagatgggtcaatgaatgggtgaatggatgggtggacagcagatggatggtgaatggatagatttaaagttttattattaggagttccaagcaatttgatcattaggcacatcatct

SEQ ID NO: 148851 - DNA, 601 bp, Human
caggtcctggtgcggttcctgttctccatcagcaaagggtaccggagaatcacctaccacaactggcgccacggcttcaacgtggcccagacgatgttcacgctgctcatggtacgtggctgccagaatcaccagggttgtgcaggccctcctggtaccaagggcagcactcaagcaccccgagggatgagatgggggtcctcccagggcagaaggatggaggagggcaacgccctctgacaccgtgcaccgcgcaccccagccctgcggtggtcggaggtccaacctccaacccgacgcytaggtcatcccaacccctcaccactccccaccctgctggagccaggaccggtgagcaaggtggccctgtctctacagaccggcaaactgaagagctactacacggacctggaggccttcgccatggtgacagccggcctgtgccatgacatcgaccaccgcggcaccaacaacctgtaccagatgaagtaggcacctcagggcgggcatgtgaattagccctaaatcaactccacgcccttggcgtgaattaggcttcgcatagcaggctatgtagaaagtggagtccacggccaggccc

SEQ ID NO: 148852 - DNA, 601 bp, Human
aaactgaagagctactacacggacctggaggccttcgccatggtgacagccggcctgtgccatgacatcgaccaccgcggcaccaacaacctgtaccagatgaagtaggcacctcagggcgggcatgtgaattagccctaaatcaactccacgcccttggcgtgaattaggcttcgcatagcaggctatgtagaaagtggagtccacggccaggccccgtactccagcactgtgggaggccaaggcgaggggattgcttgagcccaggagttcgagaccagcctgggcaacatggcaagakctctcctctacaaaaacttaaaaaaaaaaaaaaaaaaaaaagctgtgtatggtggcgcacacctgtggtcccagctacttaggaggctgaggtgggaggatcacttgagcccaggaggtcaaggctgtattgagccatgattgcaccactgcactccagagtgggtgacagaggcagaccctgtctcaaaaaaaagaaagtggggcccatctgggggggctgcagagcgcagggtgggccaagggcaggtcccacgggcctcacctccaccacctgtgtaacaggtcccagaaccccttg

SEQ ID NO: 148853 - DNA, 601 bp, Human
gaccctgaacatctaccagaacctgaaccggcggcagcacgagcacgtgatccacctgatggacatcgccatcatcgccacggacctggccctgtacttcaagtgcgcgccttccgggagggggcgcctcgcggggcgggcgggtagcctgggacccccggcagacacgggggcgcagcggcggcacagcccgggggacgcagccccggattccgtccctgcccgccggccccgcgcaccccggatggggcctcgctcgggctccgcgcctccctgcagacgggcgcttggggcggggtctccacacttgctcccacctgcacctcccttgttccctgggttcaggaagagagcgatgtttcagaagatcgtggatgagtccaagaactaccaggacaagaagagctgggtggagtacctgtccctggagacgacccggaaggagatcgtcatgtgagcgcgggcggagggggcacgaggggtccttccctcgcagggaccgggcccactcaccagctggttaaccctgcagccctccccagacgctctggagcaggaagagcccgtcgcggcagcttgtcgagggctgtgaaacaaatgc

SEQ ID NO: 148854 - DNA, 601 bp, Human
tcgtcatgtgagcgcgggcggagggggcacgaggggtccttccctcgcagggaccgggcccactcaccagctggttaaccctgcagccctccccagacgctctggagcaggaagagcccgtcgcggcagcttgtcgagggctgtgaaacaaatgcgccgtccttatttccccccagctctcagggagatggtgcagagctggggagcacacaggccctgcattggtctgtagcccttggcagtaacttacttcattttgaccttccactttttcacctgtaaaatggtgattcacaaccakcccctccccaggctggtcccagggacccagtgagaaaatacacataaacccagcacttgggaggccgaggggagtggatcacctgaggtcaggagttcgagatcagcctggccaacatggtgaaaccccgtctctaccgaaaatacaaaaattagccgggcgtggtggcgggcgcctgtaatcccagctactcgggaggctgaggcacaagaatcgggaggcggaggttgcagtgagctgagattgcgccattgcactccagcctgggcaacagagcaagactccatctcaaaaaaagaa

SEQ ID NO: 148855 - DNA, 601 bp, Human
tgggagcaaggtgacttggaaaggacagtcttggatcagcagcccattgtgagtgctgcttctggaaccttccactcctgaaacgggtgttagagacccctcttggtcctcaggagcctcaggtcctggcttggtctcaggcagggggttctgaggtcgtggggtccttatctcactttgtgggatcatgtgacatgcgtgtgggtggctcggacctgggtacagctgtggcttgggtgatgcttatgcagaggtgacgtcgttggcactggaggaaccagggccacccgctcatcaccargagcctctgggtccaggcagctctgcaggtgaaccccagcagggccgcgagccatgcaccaagaaagccctggggagggtgctggggcagagaacgcatggggggcgtcccgggcccacacagtggtatgatggacaatgccagggtcctcaggtcagcagcggggtctggatacctcctggcagcaggagaggtgccagcaaatgggagagtcaggataggcgccaggaacaggagaggcagggctgccccagccccacgtggaccaggtgggagctgtggtttctcacacacccgctc

SEQ ID NO: 148856 - DNA, 601 bp, Human
gtggaccaggtgggagctgtggtttctcacacacccgctctggtgggcggcgaggggctctctggagcctgcagtggagagggcttaggccaggtgcagcctcggcaggaaagggggcattggttggtcagcaaagccccacaggggaaggacaggcagcaggtccatcccccgcgcccggcctctagagtcctgcatggttcaccctccaccaggacgctgtgaggggacggacagcccagggcactcggggtctgacactagaaacagctccagagcacgtctgtgtctgccccaggcragtgcacagcgaggtcctggtcagccgagtgtctgggcagtgcagcccagcccggctcagcactgtgtacagcccatccccctccccgcctctccccagctgcagtaagggtccccagagccaagagggggctgccctcaggggaccacgggctggagccaacagcagctgtgggaagaagctgcccacagttcctaggagctgtggagccgctggccaagggagagggtgtcagcttcccctcccgagagccagtttctgtcaggcaggctcgtcccaggctgtgtctccatgagcaca

SEQ ID NO: 148857 - DNA, 601 bp, Human
tcgactcccctcaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaaggtctggctctgtgtggcctgtggggcagggactcggtgactctcccaaggcaaaatgaaaagacagggcacagagcagagttaaaatggagaaaagcagagccactttcaagaagcctcgaggtggacagggccayagtgcagggagagaggccacggcgggggagagtggcagctgactccacctcggtagcaaacccggactgaaaaatttcctctgttcctagccagtgaaccccatttttcaagaaagaagtaaccatatcttatgtcctttataaaggacttagttgcaacaagtcagcacacccccaagttcaaatcccaaaggcatcgtggtcttgccattggcccgcacttggctaccttagctctgaggtttggcttgctattcccgctgctcccagtatcccatgctattcccgctaccccatgct

SEQ ID NO: 148858 - DNA, 601 bp, Human
ccatgctagtaccactaccccatgctattcccgctaccccatgctattcccctaccccatgctattcccgctaccccatgctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccaygctattcccctaccccatgctattcccactacgccatgctattcccactaccccatgctattcccgctaccccatgctattcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatg

SEQ ID NO: 148859 - DNA, 601 bp, Human
ctaccccatgctattcccctaccccatgctattcccgctaccccatgctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccatgctattcccctaccccatgctattcccactacsccatgctattcccactaccccatgctattcccgctaccccatgctattcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatgctattcccactacgccatgctattcccgctacc

SEQ ID NO: 148860 - DNA, 601 bp, Human
taccccatgctattcccgctaccccatgctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccatgctattcccctaccccatgctattcccactacgccatgctattcccactacsccatgctattcccgctaccccatgctattcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatgctattcccactacgccatgctattcccgctaccccatgctattcccgctacc

SEQ ID NO: 148861 - DNA, 601 bp, Human
gctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccatgctattcccctaccccatgctattcccactacgccatgctattcccactaccccatgctattcccgctaccccatgctrttcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatgctattcccactacgccatgctattcccgctaccccatgctattcccgctaccccatgctattcccgctaccccatgcta

SEQ ID NO: 148862 - DNA, 601 bp, Human
ctgctcccactaccccacgctattcccctaccccatgctattcccgctatgccatgctattcccctaccccatgctattcctgctatgccatgctattcccctaccccatgctattcccctaccccatgctgctcccactaccccacgctattcccctaccccatgctgctcccactaccccacgctattcccctaccccatgctgctcccactaccccatgctattcccctaccccatgctattcccactacgccatgctattcccactaccccatgctattcccgctaccccatgctaytcccactaccccatgctattcccactactccatgctgctgccactaccccatgctagtcccactaccccatgctattcccgctaccccatgctattcccctaccccatgctattcccactaccccatgctattcccctaccccatgctatccccctaccccatgctattcccgctaccccatgctattcccctaccccatgctattcccactaccccatgctattcccactacgccatgctattcccgctaccccatgctattcccgctaccccatgctattcccgctaccccatgctat

SEQ ID NO: 148863 - DNA, 601 bp, Human
cccgctaccccatgctattcccctaccccatgctattcccactaccccatgctattcccactacgccatgctattcccgctaccccatgctattcccgctaccccatgctattcccgctaccccatgctattcccgctacgccatgctattcccgctaccccatgctattcccgctaccccatgctattcccgctaccccatgctattcccgctaccccatgctattcccctaccccatgctattcccgctacgccatgctattcccgctaccccatgctattcccgctaccccatgctaktcccgctaccccatgctattcccgctaccccatgctattcccctaccccatgctatccccctaccccatgctattcccgctatcctatgctacataaacaaggcgacttcaggactatggaaggccaggatgagcataatcagggcacagtgtcaacagaggctaaagcactaagaaaggctcagcccagctaatcggcttgggctggtcacagacccaggtgctgtccttcctcctgcaggggttggtagaggtcacaccaggcaggagggaaggaatagggctggtgtgcacaggtgg

SEQ ID NO: 148864 - DNA, 601 bp, Human
taccccatgctattcccctaccccatgctattcccactaccccatgctattcccactacgccatgctattcccgctaccccatgctattcccgctaccccatgctattcccgctaccccatgctattcccgctacgccatgctattcccgctaccccatgctattcccgctaccccatgctattcccgctaccccatgctattcccgctaccccatgctattcccctaccccatgctattcccgctacgccatgctattcccgctaccccatgctattcccgctaccccatgctattcccrctaccccatgctattcccgctaccccatgctattcccctaccccatgctatccccctaccccatgctattcccgctatcctatgctacataaacaaggcgacttcaggactatggaaggccaggatgagcataatcagggcacagtgtcaacagaggctaaagcactaagaaaggctcagcccagctaatcggcttgggctggtcacagacccaggtgctgtccttcctcctgcaggggttggtagaggtcacaccaggcaggagggaaggaatagggctggtgtgcacaggtggttcca

SEQ ID NO: 148865 - DNA, 601 bp, Human
tattcccgctacgccatgctattcccgctaccccatgctattcccgctaccccatgctattcccgctaccccatgctattcccgctaccccatgctattcccctaccccatgctattcccgctacgccatgctattcccgctaccccatgctattcccgctaccccatgctattcccgctaccccatgctattcccgctaccccatgctattcccctaccccatgctatccccctaccccatgctattcccgctatcctatgctacataaacaaggcgacttcaggactatggaaggccasgatgagcataatcagggcacagtgtcaacagaggctaaagcactaagaaaggctcagcccagctaatcggcttgggctggtcacagacccaggtgctgtccttcctcctgcaggggttggtagaggtcacaccaggcaggagggaaggaatagggctggtgtgcacaggtggttccactcaccatcttctgtcttctcttgcagtaggcacagaaatttgcaatggcggcccagcacccaagtcttcaacctgctgtatcctgtgagcactggtcccatggggaccctatggctccctca

SEQ ID NO: 148866 - DNA, 601 bp, Human
actatggaaggccaggatgagcataatcagggcacagtgtcaacagaggctaaagcactaagaaaggctcagcccagctaatcggcttgggctggtcacagacccaggtgctgtccttcctcctgcaggggttggtagaggtcacaccaggcaggagggaaggaatagggctggtgtgcacaggtggttccactcaccatcttctgtcttctcttgcagtaggcacagaaatttgcaatggcggcccagcacccaagtcttcaacctgctgtatcctgtgagcactggtcccatggggacmctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtac

SEQ ID NO: 148867 - DNA, 601 bp, Human
acgatgtcctcacactcttggcataggtcatcctggggagggaggggccccaaggtggaggacacatgagtgggggaggctcccagctccaatggggaggttctcttaggaagaggccaacagagcactccaaggcacatgcagctgcccaccagcccaacttgtcccatctcatccatatcaatttatcccatccatctcttctattcatccatcccaatccatccatctttattctgtgtcatcccatcccatcccatcccatcccatccatctttattctatgtcatcctatcctatcccttcccctcccatccatcccatcccatcccattcatccgactccatctattctatgtcatcgtatcccatcgcatccatcccattccattttatcctatctcatttcatctcatcccatttcatctcatccatcccctatgggggctccactctcctcctgcccatccagagcccacccagcacccttcatttcagacccccagttgccatgcatccttggtggtactcacggctcccacatgtccccagacttcctgtaggcaatgccctagggctctgcactgcaatgcttgctcca

SEQ ID NO: 148868 - DNA, 601 bp, Human
tgggcacatgtaggggcccttcccctcagggaagaccatctctggctgtgctattgagctcagggccatgacctgctcccagccaggaggagctgggacttcccaggcacccaggcctcctcctcagcctggaaatggcccctttagggggctcagctcttccctgctctgtccctcatctcttgggccccaaccttcatccaggatctgggcatcattacctggaaaatggcctccttggccatcttgttaaggatgtggacgatgtcctcacactcttggcataggtcatcctggggakggaggggccccaaggtggaggacacatgagtgggggaggctcccagctccaatggggaggttctcttaggaagaggccaacagagcactccaaggcacatgcagctgcccaccagcccaacttgtcccatctcatccatatcaatttatcccatccatctcttctattcatccatcccaatccatccatctttattctgtgtcatcccatcccatcccatcccatcccatccatctttattctatgtcatcctatcctatcccttcccctcccatccatcccatcccatcccattcatcc

SEQ ID NO: 148869 - DNA, 601 bp, Human
ccagcccataccttttccctgtccagccaggagccaacacaggcctggagcattgcctgtggtatggcctgctcgctgctgttcccggcctgggtggtcacggacatgcagaggtggcactcagagtctcgcggcagccattctcctgtcggcgaccctggagatgtgagcattagggggaaagcaggcaaggccaccctacagaggtgtttggtttctgtcctccttggtgcattgcagtgggaccacagagggagagggtcatgcagtggcagggtagggggaggaggagagcaggcaytgggctaaggagggggcagtgggctcacttgggccagcgctgtcatccatggagcaccggaggacgaggcggcagaccagctggggcagcatgcggcccagcagcgtgtcgagcaggatgacggagtagcgctcagccaggcactggcagatgccgcccgccaccagaggtaccacgcggcacacctgggccactgccacagctagcgcaccctggggcgggggcggagagaggccagcatgggaccttcacttggcaagcctccactctctgcccagcacccagctgggcacttcctac

SEQ ID NO: 148870 - DNA, 601 bp, Human
aatttcctgtcattgactgagtattggcaagggccctaggaccttcaagtccagccctctccttttgccaatgggtttgtcctgagtgagtcacaccttgaggagtgtgggggcagtaaagggatcaggaccctggagagaaggctagtccctttcctggcttgaactggccctagcattactcatctcctggtagataaccaggcctctgaaggcttgcctggtgctcactcagcccgtgaagagggcctgctggtcctctggagcccacagccctttgtccagaggcgactcctaaccyttagcaggctctgccctaacttacagtcccaccattgtctgccccacatcctgtctgcctgtctgtgctccattctggcccatcctaggtgtctctggctgcaaagcctttcctgggctcagccttctgccttgaacgggccctgaccatgagtccccatgtgcccagcccataccttttccctgtccagccaggagccaacacaggcctggagcattgcctgtggtatggcctgctcgctgctgttcccggcctgggtggtcacggacatgcagaggtggcactcagagtctcgcggca

SEQ ID NO: 148871 - DNA, 601 bp, Human
tgcttgcactgaggaaggagacacacagctgtggagggtccctttgcaggactctcctgtcgtgtggtcctggcctctccacatctctggatcactctagggctccctcccgactcctccatcagccctcacggaacacctctggctgcagttgaaacccttaacaaactggagccagctgaaatggaggacttccatcagaaaagcaggcgacactggagacggaggactcaggcagaggggtggaatctcagccaccaccctcccctccctccacctccatttcagttctagaaggaamcttaacgttcatctggtccttgagaccagatgtgatgggcagtcgggaggcttgggagttgctgagcagggagcacagtgtggacagctgcctcctgggaagagcatcagctggctttcctcaggacaggatctcgctttaagaagggaatttcctgtccgggtgcagtggcttatgcctgtaatcccagcactttgggaggccaaggcgggcagatcacttcaggtcaggggttcgagaccagcctgaccaatatggtgaaaccttgtctctactaaaaatacaaaaattagccgggcc

SEQ ID NO: 148872 - DNA, 601 bp, Human
cagtggaacacagttgacagtgtgcagctccagggtcagacttcttttctaatcttggctctgccatttattcagtattaattattgagtgcctactctgcacagtactacatctgttgtgccatctagaacagcccctgcagctcggttaaccaattccccatttgtgagaaggggaatacatcacaggactacagagaggattaaattacagaaatgcacaaaatgctataaaaactgttagggtcttgacagctataaagatccatcctattgagcttcagaaagtgctctgggaggscaggcacggtggctcacgcctgtaatcccagcactttaggaggctgaggtgggcagatcacctgaggttgggagttcgaaaccagcctgaccaacatggaaaaaccccgtctctacttaaaatacaaaaaaattagccaggtgtggtggcgcatgcctgtaatcccagctactcgggaagctgaagcaggagaatcacttgaacctgggaggcggaggttgcagtgagccgagatcacaccattgcactccagcctgggcaacaagatcgaaactccgtctcaaaaaaagaaagaaagaa

SEQ ID NO: 148873 - DNA, 601 bp, Human
ctatctatcctgggcacatctcccatatcctccctggttattctgagaccttttagaattatatgagcaaattctaacatgattatacaagtcatagaagaaatattgctactaagttataacagcaaaaagttcagtatttcttgttagctcccagttgagtttgttctaatggatcaaatcaggaaaaaaggactacaatactagaaaattactgaaaaaggggaggaatttgatggagtgtttgaaaagctatgtatgtgtaaataaatatgcggtgtattatctttaaaaaaaaatsaaaaccctcaacagcagagtaacacacaacataaactaacatttcatagacctgggtgccaggatccagtataagagggttcctgctaacagcttgtattctggaagagaactgattagacccaggctactaacaccagatgtactctggggaagcagaagcaaagcaagttttcaagaagtagaagctgggaaaggggcagcttacactgtggtcaagagcactggactctgcagtcatgaacacctggactcacttctgtttcttaactgctagctgaccttaggcaaattcttcact

SEQ ID NO: 148874 - DNA, 601 bp, Human
gctgggaattcatgcagtggaagtaggacacaaagaacaggccaatggatcttgagacatcaaaaaagagcaggaaaccagctgagaggtcaagcagcagcccaccccagtgcacgaccagcaggctagtcagctcctcagacaacagcagtctgcaaacacatggagaaagttcaagcaccagcccactggagaacacatcaaagcacattcacagcacgaatgtgccttggctactccagtggctgggtagatgcctaaggtacataatccacccatgaagacactcctctaggttgtgtgttgttgttgttgttgttgttgttgttgaaacgaagtttcactctgtcgcctaggctggaaggcaatggcatgatcatggtgcactgtagcctcaaactcctgggctcaagcaatcctcctgtctcagcctccgaagtagctggaaccacaggcacgtgccaccacgcctagctgtttttttaaaaaatttttttgtagagacagtgtcttatattgctcaggctggtcttgaactcctgggctcaagcaatcctcccaccccagcatcccaaagtgccgggattacaggcatgagcca

SEQ ID NO: 148875 - DNA, 601 bp, Human
agctgggaattcatgcagtggaagtaggacacaaagaacaggccaatggatcttgagacatcaaaaaagagcaggaaaccagctgagaggtcaagcagcagcccaccccagtgcacgaccagcaggctagtcagctcctcagacaacagcagtctgcaaacacatggagaaagttcaagcaccagcccactggagaacacatcaaagcacattcacagcacgaatgtgccttggctactccagtggctgggtagatgcctaaggtacataatccacccatgaagacactcctctaggttgtttgttgttgttgttgttgttgttgttgttgaaacgaagtttcactctgtcgcctaggctggaaggcaatggcatgatcatggtgcactgtagcctcaaactcctgggctcaagcaatcctcctgtctcagcctccgaagtagctggaaccacaggcacgtgccaccacgcctagctgtttttttaaaaaatttttttgtagagacagtgtcttatattgctcaggctggtcttgaactcctgggctcaagcaatcctcccaccccagcatcccaaagtgccgggattacaggcatgagcc

SEQ ID NO: 148876 - DNA, 601 bp, Human
ttttcattgttgggctagtggtgcttacttttcctgaatctaatctcagttcaaggaaatgaatgcattgccctatctcaacccacataaaagatagttcaatctggctcttgagaaaaggcaaagcagactcaaatttgttttgctttatggtgtgtgtaagacaaaaccagaccccaaagcacaagggggctctgaagaacagtaaattgtcagcatcagacatctcaccccagggttaaggtagcccagttcgccagtgcggccatcacggtaggtgatcttcacgtgctggtgggarcgggagtgcaccatcatgtcccaggaatagccatacagcccatttgtccagttgttatagccctgggaaggcagcacagaggggaatcagctcaatgcttctcacactgaccccatcccctaccaagaaggggctgcaaaaccagccccattctttcccaactattgtcatccgttcctttctaagtccagcctttgctgtacactccacagcccctacaaacctgggtgagaaaatgagaatagggcaggaatagctgctccaggaggtagagcagggtgaaggcagctcccagctgat

SEQ ID NO: 148877 - DNA, 601 bp, Human
tggaacttgcctttgggaatgaatttttcattgttgggctagtggtgcttacttttcctgaatctaatctcagttcaaggaaatgaatgcattgccctatctcaacccacataaaagatagttcaatctggctcttgagaaaaggcaaagcagactcaaatttgttttgctttatggtgtgtgtaagacaaaaccagaccccaaagcacaagggggctctgaagaacagtaaattgtcagcatcagacatctcaccccagggttaaggtagcccagttcgccagtgcggccatcacggtargtgatcttcacgtgctggtgggagcgggagtgcaccatcatgtcccaggaatagccatacagcccatttgtccagttgttatagccctgggaaggcagcacagaggggaatcagctcaatgcttctcacactgaccccatcccctaccaagaaggggctgcaaaaccagccccattctttcccaactattgtcatccgttcctttctaagtccagcctttgctgtacactccacagcccctacaaacctgggtgagaaaatgagaatagggcaggaatagctgctccaggaggtagagca

SEQ ID NO: 148878 - DNA, 601 bp, Human
tcctcactcctcccacacaggcatatatgggaatctccccccaagtgaccctccatctcccagctggaagggtacaccactctttatacagtctggtagaggattccaggatagggtaggaacagcccacagagaggctggagataagctgaggcagaacaagaaagcaggccatcagatataggccacttattcttccagtaaatcaagaagaatggcaggaaaagatacctagagctaaactgtcctttcctgtatgacagtctctagagttactctccccaggggaaagttaccaagsttgccaacatatgatggcaatgacaaatattgttgtgaacttacctgcggcgaaagacatagagctttcgcaacaagaagcggaagaatcgctcatggaaaggagtatttcgccggcgttcaatctcctggagcctttgttggcgtctaagaaaggtctgaaccagaggtgttggctcagggcccccttttacttccccttccaacagaggctgcagctctgggggtagaggccctgtttctgcccggaagacagaaaaaagaggaatcactgagatggatcactctctccccttagaac

SEQ ID NO: 148879 - DNA, 601 bp, Human
tgagaatttttttcaaataaatgtccattgcatagaatgggtctgtgactggctgcttctacatctgcacccaacatctggcccccttcagaactctgagtggacaggatcaggatttgactcaggaggattagaatgtgaagaatccgtgtttgagggattcagttctccaactgcctcaaagggtctcaagtttgcataagtcacctcctgggccagctgctccagggaaggacggcctaatatcagatttcgaagtgagatacaagtcatcaggaagctgaaaaacaggaaaaagccraccaagttcaaactcctgtttcaccagaagaatttcagctaaagcccttagaaggcacctggtcctcactcctcccacacaggcatatatgggaatctccccccaagtgaccctccatctcccagctggaagggtacaccactctttatacagtctggtagaggattccaggatagggtaggaacagcccacagagaggctggagataagctgaggcagaacaagaaagcaggccatcagatataggccacttattcttccagtaaatcaagaagaatggcaggaaaagatacctagagc

SEQ ID NO: 148880 - DNA, 601 bp, Human
atctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatyttctacactgttgagcttttgtttcctgcgcaactcctaacagcaaaatcagataattgccattttagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgca

SEQ ID NO: 148881 - DNA, 601 bp, Human
agaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattttagtcagaaaatgcttttcatttaattgtttaatcgaattatcttgttgctcattataattggtgwtccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgttt

SEQ ID NO: 148882 - DNA, 601 bp, Human
acgcaagctggagtgccgtggcattatcaccgctaaccgcagccttgaactcctgggctcaagcgatcctcctgcctcagcctcctgagcagctgacaccacaggcctgcaccaacatgcccgactaatttttttattttttctggagacagagtcttgctactcaggctggtctagaactcctgaactgaagcaatcctcccactttggcctcccaaagtgctgggattacaggcgtgggctactgcacctggctaagctcagttctcagggaatggctgaggccataaaacattcttcrccatcttccgcatgccatgctgatgcctctcaggtctctaccctttggtctgcttctcattcaccagatgtttatcatcatgacttctgggccctgggccctctgagagacagcccatcctgggttgacccagggcaactatcctgcctacatcacagtcactagaccctagagcttgtctcctccaactcgctggctttctggaggacaccgaggtcctgagagcacaagagactgcccacaaacacacagggagtggaagcccctgcaagggaggctcccattcccttctgaatccct

SEQ ID NO: 148883 - DNA, 601 bp, Human
cacagatgtcagcattagaaagtgctaaagttgaagaggggagctggggccgggggggaggaataaaacaaaaaaaagaaagcgctaaagttcttatctagtcctgctctgcctgcaccgccctacacatacccatacacgcatagtgcagaaatctcttctatagcatcccttaccatcctcttcttgaaggcttccagtgatgggaaactcaccaccttaccaaacagcctcttctacacctcttaaagcctttacttttccccactctgccatagtgtggtgagttatggacccaccyacctccactactacactgtagggtcctttagggcaggaagtgtattttgcctctggatctagctggaacctcatgcaggtgctcaaagaatgcatttgattaactggacctgctgggctctgattattagactggggtggcacctaagggatagcccaggatttcaaaaggctgggacaggctggagcagccccaggaggcagagagcaggggctaggggtcccagactgccatggggctgggggaggggaggacgcaagtcctgctggctgtcccatggtcctgacttaggctgtcttt

SEQ ID NO: 148884 - DNA, 601 bp, Human
aatcacagatgtcagcattagaaagtgctaaagttgaagaggggagctggggccgggggggaggaataaaacaaaaaaaagaaagcgctaaagttcttatctagtcctgctctgcctgcaccgccctacacatacccatacacgcatagtgcagaaatctcttctatagcatcccttaccatcctcttcttgaaggcttccagtgatgggaaactcaccaccttaccaaacagcctcttctacacctcttaaagcctttacttttccccactctgccatagtgtggtgagttatggacccrcctacctccactactacactgtagggtcctttagggcaggaagtgtattttgcctctggatctagctggaacctcatgcaggtgctcaaagaatgcatttgattaactggacctgctgggctctgattattagactggggtggcacctaagggatagcccaggatttcaaaaggctgggacaggctggagcagccccaggaggcagagagcaggggctaggggtcccagactgccatggggctgggggaggggaggacgcaagtcctgctggctgtcccatggtcctgacttaggctgtc

SEQ ID NO: 148885 - DNA, 601 bp, Human
tcatgcctgtaatcccagaactttggaaggctgaggcgggtggatcacttgagattaggagttcaagaccagcctggccaacatggtgaaactccatctctgctaaaaatacaaaattagccaggcatggtggtgcgtgcctgtagtcccagctacttaggaggctgaggcaggagaattgctggaacccgggaggcagaggttgcagtgagccgagatggcactactgcactctagcctgggcaacagaggaagaatctgtcacacacacacacacacacacacacacacacacacacacacaagcccccttatccttccaggcccgtatcaagccccagctgtccaaggaaacttccaggacattaagtggcctccgccttctctgggagttctcccagccctctcccctgggagcacatactttagcctgttttatagcataaactggctgcttcacatctcaactggagcaaggacacacctgatgcctctgttcctcaagcagcccagcaaagagtctattccattccactcaacgtctgtgctgggggcttggcactgggggtgacatgcacagagacaaagaatagcccatgtt

SEQ ID NO: 148886 - DNA, 601 bp, Human
tgcctgtaatcccagcacactgggagactgaggtaggtggaatgcttgagcttaggagttcaagaccagcctgggcaacatggtgaaatcctgtctctacaaaatatacaaaaattagctgggcgtggtggcgcacacctgtcatcctagctacttgggaggctgcagcacaagaattgcttgaacctgggaggtggaggttgcagtaagccgagatcacaccactgcactccagcctgggtgacagagtgagactctgtctcaaaaaaaaaaaaaaaaaaagtaatttacagaaaaataagaaagaaaaaccccagtgactagcttccatattggactcattaaaaccagactctctaggtggagcctggatgtcagtgtttgagaagctccagatgactctaatgcttggtcagggttgaaactcctgctgcctcattagatctctgtcccgagaccttttgttccagtctctcctggggaagggtccaccctgacctctggcctttcattctttcccctatcccagccctctgtccaagcccacagctccttgagcttcctcagtgtccatgttcacccttacatccattaaagcccc

SEQ ID NO: 148887 - DNA, 601 bp, Human
agccaggcatggtggctcatgcctgtaatcccagcacactgggagactgaggtaggtggaatgcttgagcttaggagttcaagaccagcctgggcaacatggtgaaatcctgtctctacaaaatatacaaaaattagctgggcgtggtggcgcacacctgtcatcctagctacttgggaggctgcagcacaagaattgcttgaacctgggaggtggaggttgcagtaagccgagatcacaccactgcactccagcctgggtgacagagtgagactctgtctcaaaaaaaaaaaaaaaaaaagtaatttacagaaaaataagaaagaaaaaccccagtgactagcttccatattggactcattaaaaccagactctctaggtggagcctggatgtcagtgtttgagaagctccagatgactctaatgcttggtcagggttgaaactcctgctgcctcattagatctctgtcccgagaccttttgttccagtctctcctggggaagggtccaccctgacctctggcctttcattctttcccctatcccagccctctgtccaagcccacagctccttgagcttcctcagtgtccatgttcaccc

SEQ ID NO: 148888 - DNA, 601 bp, Human
gaagtgcaatatttcgcaggggccagggaagtcaggggtagggggaaggcagatgacagagcagaaggtattaagtctgagtaggaaacaaagagggacaggtcaagggcagtgataatggatgtgaaatgctgtgtgaattatgactttccttttcctttcccaacctacaaaatagtggaaggcatattttggcaccacgattccggaagaggacatgcagagagcagaggtttgcggagggaaactttaacgtttctccatcccacagaggatcacatgctgtgcccacatcccctgsaacaggcagcccagcctgtgactcaggcctgagctggtgaagtggctgccccaagctcaagccatcagggagcgctcaagaatgagacacggagtgcgccaattgtcacctttactatttttcattctgtgtttaactcaaaatcaggcagcctacatgccagagagccacatcagggtttggatgaaaggggtttggcaggccgggtgcggtggctcacgcctgtaatcctagcactttgggaggccgtggtgagcagttcacttgaggtcaggagttcgaaaccagcctggccaacat

SEQ ID NO: 148889 - DNA, 601 bp, Human
aggtttatcccaggaatgcaaggttggtttaatatctgaaaatcagggtgatgatagctaataataatgcagtgtatatttcaagatagccagaagagaggatttgaatgttatcatcacaaagaaatgataaatgtttaaagtgatggatatgctaattaccttgatttgatcattatacaatatatacacatacattgcatatgtacaatgaaacatcacactgctcctgctaagtatgtgcaattattatctgtcaattataaatttaaaataaataaataaagccgctcacaacgcmaaaaaaaaaaaaacaggccaaaatttgaaaatcaatgctatacaccctattaacaaacatgtatgtgtaatcacctcaatagatgcagaaacagcatttagcaaaattctacattcattcctagtttaaaattttttcaagcctgggcaatataaggagaccacaaccctacaaaaattttaaaaatcagccaaggccaggtgcagtggctcacacctgtaattccagcactttgggaggccgaggtgggtggatcacgaggtcaggagttcgagaccagcctggccaacatggtgaaac

SEQ ID NO: 148890 - DNA, 601 bp, Human
acagtggccatatctattaaagaaaataaatttgtagtaaaaaactcgttcccccgccaaaaaacccaagcccagatggcttccctggtaatttctaccaaaaatttaaaaaggacataataccaattgtacacaaaatcttcaaaaaaagagatgacagaacacttctcaattcatcctatgctgccaacattctcctgataacaaaaccagataaatatattatgcaaaaagaaaattacagatcagtatctctcatgaacatacacatacaaaaattaacacaatttggctggacacrgtggctcacgcctgtaatcccagcactttgggaggccaaggtgggtggatcatgaggtcaggagttcgagaccagcctggccaacatggtgaaaccctatctctactaaaaatacaaaaatttgctgggtgtggtggcacgtgcctatagtcccagctactcaggaggctgaggcgggaaaattgcttgaacccaagaggcagaggctgcagtgagctaagcccatgccattgtactccagcctgggtgacagagtgagactccatctcaaaaaaaaaaaaaaaaaaaaaaaattaacaa

SEQ ID NO: 148891 - DNA, 601 bp, Human
cccaccgccctgccaggcagagcccctgtcacctctccttttctggtaatggcgaggtctgttcacctgtccccttccttgtctcagcacgtgtagtcctcaccaagagctcctggattgatctccctgccccaaatcttcagcgccacaagacgcagcccatactcctcagccagccaatctcctcatgacctagggctcaccttccaccttgcttaggaatttccctccccctgctcctgtcccccagcccgggtcccagtctcactagacccctggtgtgtgcatgtctgcacccttmcccaccttggtggctcagctcaccttctccctttgcctggagtggcatctcccctcctataggtctagtccaatgtcaccttcctgggacaactggcttcggctcaggctagagggcccctccctgccccaagacccccccagcacatggcagctgtcccccttaaagccctcatcacatcctgcctcaggttatggcaagtgactggcccatcttggctgcctccccagagcgagcttttatggtccctgtgctggctcagagagagcatcatagattcactgaacgaagagataaatg

SEQ ID NO: 148892 - DNA, 601 bp, Human
aagggcaaatgggctggagtcagccaccttggtcaggttcatctgtccagtggcatcagagacctggggaggagggacagtgcctgatctcaccccccacacaccagccctcacctcagcctgaggagggggaggctggtcctccctaggtccctcccactgtgcctcgctgcccactgcccaggtcccaggagcagacaagagagtgaagacctgaaaagcaaattccaggcagccccactccctctcatcaccccaatccctgcagcacaggggccccgaacccatttggaaattaggwggattccaaattacaaagaaatgcacagaattcaagaaagaaaagctcagcattggcttcaagccttcaccaagcataggctggaagtgaggtgcactcatctcctcaggagggcctgccttccgcccactccccatccttgtctcactcccagccctgtataactccccacctcccacctcggttccagccccaccttccccctgccttctcccctccaccctgcttgcatgcagctgtgctgtgcaggctcccaccctccctgctgccgggtcccagggcaggcttggggggcccacc

SEQ ID NO: 148893 - DNA, 601 bp, Human
gtacccttccagatatagatcttgccacagagcccgttgtccagcacaaagcagtcatcagatatcagcagttcaagggcaaatgggctggagtcagccaccttggtcaggttcatctgtccagtggcatcagagacctggggaggagggacagtgcctgatctcaccccccacacaccagccctcacctcagcctgaggagggggaggctggtcctccctaggtccctcccactgtgcctcgctgcccactgcccaggtcccaggagcagacaagagagtgaagacctgaaaagcaaatkccaggcagccccactccctctcatcaccccaatccctgcagcacaggggccccgaacccatttggaaattaggaggattccaaattacaaagaaatgcacagaattcaagaaagaaaagctcagcattggcttcaagccttcaccaagcataggctggaagtgaggtgcactcatctcctcaggagggcctgccttccgcccactccccatccttgtctcactcccagccctgtataactccccacctcccacctcggttccagccccaccttccccctgccttctcccctccaccctgc

SEQ ID NO: 148894 - DNA, 601 bp, Human
gccagcagggctacactggcctaacagttatgctaactaagcacttacaaaaatgaagaccccacgtaatccagtcatttctgctagcagtcctgagaactcaaactgctcattccaggcttttttatttttattttttctgagacgcagtctcgttctgtcgcccgggctggagtgcagcggcaccaacacggctcactacagcctcaacctcccaggctcaagcaatctgcccacctcagcctctcgtgtagctgggaccacaggtgcacgccaccacactcagctaattttggggggttttttttttgtagagaagtgatatttcgccatgttgcccaggctgccagacatttttccaaggaaatgataccgaaacgatgccgtgatgtggttggctctctaggcaggctataaaatgccatgaactacaatgtatctgaaattaatatgctggattccttcctctgtcaactgaccagctgcccccctacccatgagatccttctcttcctggcctcccaagtttcctgtttttcctctgatttctctttccatagttgttgggttccttgctccggtttatacatgcttctgtggg

SEQ ID NO: 148895 - DNA, 601 bp, Human
catttccagtccttgaaaaattgcttgaagatgggactctcacggccctgaggcagaatctccacctgcagggacagcgggggagaagtctggttcacaaagttgccacctctgcctctgcccaggaggacaggagggggccagagccagggaggagggtgtgggcgcctggcctgaatccatgtgcagtccaggctgggaaagctcccctggatgagccatgagatgagaaccaagatttcagggacacagacagaggcaacagactgcttcaagggcgtgggtgcacagtttaataaaygccaccaacggtagctgagccctgtcagctccccacgggatgacttgtggacactgtgctgcggcaggaggggtggcaccagccagggacaacggcccagaggaggagtacccagttctctgggcacccaggagagtgctgcccaacatcctctttgaaaataataagtattttgacattttgaaggattgagatgggctttcccactggatgggtctaagagggaggcctggttgttcctgacagtgcccaaggctctcctgcccttcctggccaatttgaggggtcaggggccacagg

SEQ ID NO: 148896 - DNA, 601 bp, Human
ggccgcttggtcaaggacatgaagatcaagtccctggaggagatctatctcttctccctgcccattaaggaatctgagatcattgatttcttcctgggggactctctcaaggatgaggttttgaagattatgccggtgcagaagcagacccgtgccggccagcgcaccaggttcaaggcgtttgttgctatcggagactacaatggccatgtcggtctgggtgttaagtgctccaaggaggtggccacagccatccgtggggccatcatcctggccaagctctccattgtccccgtgcgcwgaggctactgggggaacaagatcggcaagccccacaccgtcccttgcaaggtgacaggccgctgcggctctgtgctggtgcgcctcatccctgcacccaggggcactggcatcgtctccgcacctgtgcccaagaagctgctcatgatggctggtatcgatgactgctacacctcagcccggggctgcactgccaccctgggcaacttcgccaaggccacctttgatgccatctctaagacctacagctacctgacccccgacctctggaaggagactgtatttaccaagtctccctatc

SEQ ID NO: 148897 - DNA, 601 bp, Human
cccaagaagctgctcatgatggctggtatcgatgactgctacacctcagcccggggctgcactgccaccctgggcaacttcgccaaggccacctttgatgccatctctaagacctacagctacctgacccccgacctctggaaggagactgtatttaccaagtctccctatcaggaattcactgaccacctcgtcaagacccacaccagagtctcggtgcagcggacccaggcttcagatgtggctacaacatagggtttttatacaagaaaaataaagtgaattaagcctgaaaaaaaawttttttaaataagaatccgaatatttcatcattcacagaaaatagatttttaaaaaagaaagagtggactggacacagtggctcatgcctgtaatcccagcacctcgggaggctgaggcaggtggatcacttgagtccaggagttggagaccagcatgggcaacatagtgagacaccccccgcccactggcatctctacaaaaaatagacaaaaattagctggccatcttgacacatgcccatagttctagctgcttggaagactgaggtagaacgatcacttgaacctgggaggtggta

SEQ ID NO: 148898 - DNA, 601 bp, Human
ggtgacactggttatctttaaatatggagggtaaatggggagcagggatgagaaggtgtttcactgagactctttaataccttttgaattttcaatcttgaaaacctaatattacctattcttctcttcagccccagaaaaggtgttacattcagtgcatacacttcccttattttgatttaaaaaaaaaataaaagaaaagggtgtgaaggcaagcccagtgtctgtagcacatatcagactgtgccttaattcctggagcgagtccacctcacccacagcctaagcagcacagggcgcmggtctatctcccctgctgccttgtggctggcgcccagcatgacgtcatgaacgtggtgggcctcaataaatattggttggtgactcaagggaggctgaatgtaacataagccttattcttataaatttccttttcccctacacttcctaagtcagtaaagtgagacagaagactagattgcaaggttggatttctatgtttagacatgaaaaaagggcaattttcaactaggtttgactggtatatatgtaaaaaaagacacctgccaagttcctccttgattaattctatcacttatta

SEQ ID NO: 148899 - DNA, 601 bp, Human
aagtgggtttgggcacggggcatggcagagcacacacacacaaaatatttctcatatacacaagaaaccggtgacactggttatctttaaatatggagggtaaatggggagcagggatgagaaggtgtttcactgagactctttaataccttttgaattttcaatcttgaaaacctaatattacctattcttctcttcagccccagaaaaggtgttacattcagtgcatacacttcccttattttgatttaaaaaaaaaataaaagaaaagggtgtgaaggcaagcccagtgtctgtagcwcatatcagactgtgccttaattcctggagcgagtccacctcacccacagcctaagcagcacagggcgcaggtctatctcccctgctgccttgtggctggcgcccagcatgacgtcatgaacgtggtgggcctcaataaatattggttggtgactcaagggaggctgaatgtaacataagccttattcttataaatttccttttcccctacacttcctaagtcagtaaagtgagacagaagactagattgcaaggttggatttctatgtttagacatgaaaaaagggcaattttcaactag

SEQ ID NO: 148900 - DNA, 601 bp, Human
ttgggattatgtataatgataagtgaacaggatgctatcaatttgtgtaaaagtgggtttgggcacggggcatggcagagcacacacacacaaaatatttctcatatacacaagaaaccggtgacactggttatctttaaatatggagggtaaatggggagcagggatgagaaggtgtttcactgagactctttaataccttttgaattttcaatcttgaaaacctaatattacctattcttctcttcagccccagaaaaggtgttacattcagtgcatacacttcccttattttgatttaaaaaaaaaataaaagaaaagggtgtgaaggcaagcccagtgtctgtagcacatatcagactgtgccttaattcctggagcgagtccacctcacccacagcctaagcagcacagggcgcaggtctatctcccctgctgccttgtggctggcgcccagcatgacgtcatgaacgtggtgggcctcaataaatattggttggtgactcaagggaggctgaatgtaacataagccttattcttataaatttccttttcccctacacttcctaagtcagtaaagtgagacagaagactagattgc

SEQ ID NO: 148901 - DNA, 601 bp, Human
caattctgttcttgaaaaaacaaatgcaagaaataaagagaaagtaatccattttctaaataaaggggcagtttttttttcaaaaaaattgcatctagcataatatattatacataatagatgcaaaatatttcttaatatttgaggatgagaatacaatgaagtgttgctgggagtgttttaaaaactttaaaattctcatttaaaacaggcttcccatgacaacttggacaagttgggattatgtataatgataagtgaacaggatgctatcaatttgtgtaaaagtgggtttgggcasggggcatggcagagcacacacacacaaaatatttctcatatacacaagaaaccggtgacactggttatctttaaatatggagggtaaatggggagcagggatgagaaggtgtttcactgagactctttaataccttttgaattttcaatcttgaaaacctaatattacctattcttctcttcagccccagaaaaggtgttacattcagtgcatacacttcccttattttgatttaaaaaaaaaataaaagaaaagggtgtgaaggcaagcccagtgtctgtagcacatatcagactgtgc

SEQ ID NO: 148902 - DNA, 601 bp, Human
atagcatcagggcaaattaattccaggagaggagccctagagcctgttgggttgagcccacctcatcccacaccccagctgcagtaaatgggagaaggatactgtggagtagttagtggtgggtttttagaagaaggttgtctttggttttggagtgctgagattaagtgctttcccctctgagttcaaacttttattaacatatatttgtcacacagtagactaatgatattatagtttgagcatatgcttggcaatgttttcatttaaaccacaccaatgggatatctaacctttacayggtcagggtccacataatgcatttttttcatgtcacattcttcagtagtataatttaacttgaggatataaaggatccacactccaaacacaagcaatgtacatctggaaaaaaatcaattaggtattatgatgtagtcatgtgagaatcatgagatgcaatgtgaaactgaaaacggaatcctaaatgagtctgcctgctatgcagcataaaactacaatctttaagttgacattggggtgaaaggaaggggccatttcctattttcctgacaagataaactagtcatttatgactgtc

SEQ ID NO: 148903 - DNA, 601 bp, Human
tttctggccaggcatggtggctcatgtctgtaatccccgacctttgggaggccaaggcgggaggatagcttgagcctaggagttcaagatcagcctgggcaacatggcaagaccccatctccacaaaaaataaaaaaattagtcaggcatggtggtgcacacctgtggtcccagctactcagaaggctgaggtggccgtgttcttgccactgcactcaaccctgggtgcagagcgagaccctgactcaaaaaaaaaaaaagggagaaaagaaaaaagaaagaatttctttgttgtttactytatagcatcagggcaaattaattccaggagaggagccctagagcctgttgggttgagcccacctcatcccacaccccagctgcagtaaatgggagaaggatactgtggagtagttagtggtgggtttttagaagaaggttgtctttggttttggagtgctgagattaagtgctttcccctctgagttcaaacttttattaacatatatttgtcacacagtagactaatgatattatagtttgagcatatgcttggcaatgttttcatttaaaccacaccaatgggatatctaacctttac

SEQ ID NO: 148904 - DNA, 601 bp, Human
aaattaggatcaagaaaggaattttgtatatattctcttactcaacttctacatttcacagttgagaaaactgggactcaaaacaatcaagtcacctgcctagggtttcaccattactaagtggcagttagatttgaattgggtaaaacatttaagctctttcctctctgcaccatgctgcttttaactttgggcttctctgtggacactccctaaccaggcagagagcagagtggtcaggagctcagactctgaaaccacaccactgaattcaagccgggcttcaccacgtactgccgcwggtgaccctgggcaggttactaaatctccctgctcctcagtttccctgcctgtgagatggggatgattgtagcacctacatccccaggaatgtgatgaaagttaaatgagctaatattactaatacacttttagaacagttcctggcacacgggagcactaaaccacattataaactagctaaactagacgtgaacttgggtgagcagctcaacctttcaagccatcatctgtaagatggagatgatactgggatatctcccagtcacaatgactaaaggagataatatatataaagcat

SEQ ID NO: 148905 - DNA, 601 bp, Human
aacgtatgaataaaaattaggatcaagaaaggaattttgtatatattctcttactcaacttctacatttcacagttgagaaaactgggactcaaaacaatcaagtcacctgcctagggtttcaccattactaagtggcagttagatttgaattgggtaaaacatttaagctctttcctctctgcaccatgctgcttttaactttgggcttctctgtggacactccctaaccaggcagagagcagagtggtcaggagctcagactctgaaaccacaccactgaattcaagccgggcttcacyacgtactgccgctggtgaccctgggcaggttactaaatctccctgctcctcagtttccctgcctgtgagatggggatgattgtagcacctacatccccaggaatgtgatgaaagttaaatgagctaatattactaatacacttttagaacagttcctggcacacgggagcactaaaccacattataaactagctaaactagacgtgaacttgggtgagcagctcaacctttcaagccatcatctgtaagatggagatgatactgggatatctcccagtcacaatgactaaaggagataat

SEQ ID NO: 148906 - DNA, 601 bp, Human
ttgactgaccactgcagagacaagcagaccacgtggcttaagttcaaaatgatcacaggcagccggggcacaggttgacacagatgtgcctggctggacaggaaaactactaagttgatttcccccagggtattactaaaacacaccttctccaccctgtgcttgtggaatagtattcttggcccttgtacaggagagcgcacctctctcctcagctgacccagactttagaacaatcactttacagttggtcagatggtaatggacaggaaaaagaggatgcaaagagaaagtggagaasggcagcagagaaacaaagggaagagttcccagtccatcagtaagccataccaagtgccatcatttaaagactttctcagaagacaaaaacagagacaggatgtctaaaacctttatccaagagagctgtgaagcgccgtggaattgcaaaggactgggggaggtatgtctgcaaggccagacagtccaggaagaaagggaagcctgagcagagggtactggacacatcctactcgaccaaagcagatgtgttaatgctgatgaaatgacatgagccagcagacacctgaggacacctatg

SEQ ID NO: 148907 - DNA, 601 bp, Human
gcaacctccctgtcttgggttcaagtgattctcctgcctcagcctcctgagtagctgggattacaggtgcctgccaccacgcccagctaatttctgtatttttagtagagacggggtttcaccatgttggccaggctggtctcgaactcctgacctcatgatccgcccacctcagcctcccaaggtgctgggattacaggtgtgcgccatcacacccggtcagacccctgactttcttaaagatccccagagagtcaccacaaaggtggtctgtttatcccatctttggatgcctgggacygtcaaacctttctcctttgagattggctgccatccctatacagagctctgccattaaggccacctgggcaggcccatccttctgcggtctgaacctctggctcattgacactgactgccatgtgccctgtaccaggtcttctctccttaaggctacacagatgttcctatcccttccatgattcctcagggaggtgatcttgagtttctcctctggtcattcttagaaatcactaggattccttaggggagccttaacaagtaacagcctaacaaccagagcacttgactgaccactgca

SEQ ID NO: 148908 - DNA, 601 bp, Human
ggtctcaaactcctggcctcaaatgatccttcctgcctcggcctcccaaaaagctgggattatagacaggagccaccatgcctggctgtactgtatgctttaaatgggtgaactatgtggtgtgttaattatatctcaataaaaatgttttaagggcagggcatggtggctcatgtctataatcccagcactttgggaggctgaggcaggaggatcacttgagtcacttgagtccaggagtttgcgactagcctgggaaacacggtaagaccctgcctctaccaaaaaaaaaaaaaaaaawtaggcacgtatggtggtgcatgctatagtcccagctactcaggaggctgaggtgggaggattgcttgagcctgggaagttgaggctgcagtgagcaatgatcgggccactgcacttcagcctgggtgacagcgtgaggccctgctgaaaagaaaagaagctgggctcagtggctcatgcctgtcatcctagcactttgggagtttgaggcgggtggatcacccgaggtcaggggtttaagaccagcttggccaacatgacaaaaccccatctccattaaaaatacaaaaattagctgggt

SEQ ID NO: 148909 - DNA, 601 bp, Human
gatgactgaatcatgggggcaggtctttcctgtgccgttcttgtggtagtgaatgggtctcatgagatctgatggttttaaaaatgggagtttccctgcacagtttctctcttttgcctgctgccattcatgtaagacgtgacttgctcctccttgccttctgccatgattgtgaggcttcccctgccatgtggagttgtaactacaattaaacctcttctgtaaattgcccagtcttaggtatgtctttatcagtagtgaaaatggactaatataccatatacaaaaattaatgcaaaaygaatcaaagacctaaatgtaagaggtagtatgttataaacatactagaagaaaacttgggactaaacaatagtttcttagatatgacaccaaaagcataaatgaccaaaggaaaaataggtaaattgggtttcatcagaattaaagacttttgtgctaaaaatgataccctaaagaaagtgaaaagacaacttagagagtggagaaaatacttggaaatcacataccagatatagggtactggtatccagaacacagaaagaactcttacaatttaagaataaaaagtcaaatagcccaa

SEQ ID NO: 148910 - DNA, 601 bp, Human
tgtcatagccactcagaacacgaggaccacacgggccatgtcctccactctattcttgcttcagtgatgcacaaattaaggagctgcttcgtgcttagtgtagcattcaaggccttttgctatctggccctgtctcattttcagtcccatatcctgtgatccctcctccccaaatcctcagtgataggcaactcttgccattcctctcatgtgcaaagcattctgaggcctgcacttctgcacaaaccacctcttctgcgtggaaggaagcaggatatcctgtcaggaccgttttgaaaartggagcattttaacaaggtcaaaatgttaaaaacctacttaaaaaaattctctagtaacacaataagacaccctcaattccaccataattatagcaggctttcactttctattttactagtttcaaactcacggagttttacaaacatgtttgacttacacagctgccccccattccttcctctttctctatgaaaaattacaggggactttctcctttacttatttccgtattacttgaatttttggtgttttttttaaataattgaaaaaagtaaccttttagaaatcgctcagcact

SEQ ID NO: 148911 - DNA, 601 bp, Human
gctgcgcttgcaggttgcccacaattaagacaaagtagacatctggtagtgccaattgttaatgctgtggcagtgtgccataaaaacatcatgtgaaattcacagaaaggtattaaaaacaatcaaagtaattttcctcagcaaaatccccactttcatttccactctgaaatcttaaggacaacccttctcagaaatacaagtaagtggcataattcttagtaaaaggcaatgttctattgcacttattattttttaaaaatccggaacagggcagagcattcagattgaaagaaaactygtgtctggcattaatgagatgtgggaaggagctcaattctgccatggatcacgtgatctgggggcatcagtgaccttgtggaactttcatttcccacacctgtaaactctggtgctggtcgcttcttcgcaggttgctctgatgccctaagcattttgcccagtacctggcatgtgtggagacttgtatgatatcacacaaggacaataactgagggtcacgttattgacatattttactcacatttaagttataactcttacccagttagaagcagaaaaaaatttaaataaccaagtc

SEQ ID NO: 148912 - DNA, 601 bp, Human
agtttttaacatcttccaggctgcgcttgcaggttgcccacaattaagacaaagtagacatctggtagtgccaattgttaatgctgtggcagtgtgccataaaaacatcatgtgaaattcacagaaaggtattaaaaacaatcaaagtaattttcctcagcaaaatccccactttcatttccactctgaaatcttaaggacaacccttctcagaaatacaagtaagtggcataattcttagtaaaaggcaatgttctattgcacttattattttttaaaaatccggaacagggcagagcattcagattgaaagaaaacttgtgtctggcattaatgagatgtgggaaggagctcaattctgccatggatcacgtgatctgggggcatcagtgaccttgtggaactttcatttcccacacctgtaaactctggtgctggtcgcttcttcgcaggttgctctgatgccctaagcattttgcccagtacctggcatgtgtggagacttgtatgatatcacacaaggacaataactgagggtcacgttattgacatattttactcacatttaagttataactcttacccagttagaagcagaaaa

SEQ ID NO: 148913 - DNA, 601 bp, Human
gtggcattcatccagatgaggctcactggaagccaggagctggtgactctctcgtaaaatacaagaactcccgttcgtcttatatccagggacaaaaataaaggtttcagtttttaacatcttccaggctgcgcttgcaggttgcccacaattaagacaaagtagacatctggtagtgccaattgttaatgctgtggcagtgtgccataaaaacatcatgtgaaattcacagaaaggtattaaaaacaatcaaagtaattttcctcagcaaaatccccactttcatttccactctgaaatyttaaggacaacccttctcagaaatacaagtaagtggcataattcttagtaaaaggcaatgttctattgcacttattattttttaaaaatccggaacagggcagagcattcagattgaaagaaaacttgtgtctggcattaatgagatgtgggaaggagctcaattctgccatggatcacgtgatctgggggcatcagtgaccttgtggaactttcatttcccacacctgtaaactctggtgctggtcgcttcttcgcaggttgctctgatgccctaagcattttgcccagtacctggcat

SEQ ID NO: 148914 - DNA, 601 bp, Human
gcaatgaagagaggaagcagtgtgactaggctgtgaggactccagagctcccaggaaggcctcagaggcgtcagctggggcctgggtggcattcatccagatgaggctcactggaagccaggagctggtgactctctcgtaaaatacaagaactcccgttcgtcttatatccagggacaaaaataaaggtttcagtttttaacatcttccaggctgcgcttgcaggttgcccacaattaagacaaagtagacatctggtagtgccaattgttaatgctgtggcagtgtgccataaaaacakcatgtgaaattcacagaaaggtattaaaaacaatcaaagtaattttcctcagcaaaatccccactttcatttccactctgaaatcttaaggacaacccttctcagaaatacaagtaagtggcataattcttagtaaaaggcaatgttctattgcacttattattttttaaaaatccggaacagggcagagcattcagattgaaagaaaacttgtgtctggcattaatgagatgtgggaaggagctcaattctgccatggatcacgtgatctgggggcatcagtgaccttgtggaactttc

SEQ ID NO: 148915 - DNA, 601 bp, Human
tggccagaaaacaatttttaaacagtgaaaccaaaaaagaatctaggatgactgcctattggctatcatggtgagtctgaacttctctgtgtgccttccatgtcccagccagcactgccttccaggactcactggccccaagccccttctccagaagccaggcccctcattgactcaagtctcttgctgtgtcctcttcttgcccctgtctgggagttgtggtcctttgctgttttacttgaatctacccaccttccaaatctcacttcctctgacaaggttctgccacttactgtagccrgcagcatgctcctccaacttagggtcagtatgacagtttggagcatccaaccattttgtgtttttgtttcaacttctcaaacgttaagtcccttgtgggcagggactgtgaagagcttcctgtgtccctcactgttcctggagccacactgaccaagagcagtgcactgagttctagaggagaaaggttggttttaaaagcgatgtaccccagtctgggcaattcggagaaaccccatctctactaaaaatataaaaaattagccacgcgtggtgtgtgcctggggtcccagctactggg

SEQ ID NO: 148916 - DNA, 601 bp, Human
ctcccactgtatggtactttccgatttcaactggggggcagggtctcatttgtctctcaggagtgtgaaatttcacccatgaaatcaaaagcactgaggaagtgccggtgctgagaccgcacccaacaaatctcccactagctcctagtatttgttcagtttaaattataaacaccctcaccactgtctctaccaggaattctccaacctgcccatgtgcaagaaccactggaagagggccaggtgcagtggctcatgtttgtaatcccagcacttttggaggctgaggcgggtggatctyctgaggtcaggagtttgagaccagcctggccaacatggtgaaaccccatctctattaaaaatacaaaaattaactgggcgtggtggcaggcgcctgtaatcctagctactcgggaggctgaggcaggagaattgcttgaacctgggatgcggaggctgcagagagccaagactgcaccactgcactccagccctctagcctggacaacagaatgagactccatccccaaaaaaaagaattgctgaggggtttctacaaagagagtgatcatcatttgaaagacaacacataagtatgcat

SEQ ID NO: 148917 - DNA, 601 bp, Human
ctagccaaaagctatgcaagttcatgtctggagaacaaggtgggtgaacaacctcagtaacagcaattttggtcacaatctggatattcccattaagcaatgatcaccattttcatgcgactcttaattaggtctggcccatccatgcagagtgtacagctgtacacagacataggaggaaagcacccactcctggattgacacaactgcagcagggcctctttataaccatctcactccattcccgccaccaaaaggaaaaatactcccactgtatggtactttccgatttcaactgggtggcagggtctcatttgtctctcaggagtgtgaaatttcacccatgaaatcaaaagcactgaggaagtgccggtgctgagaccgcacccaacaaatctcccactagctcctagtatttgttcagtttaaattataaacaccctcaccactgtctctaccaggaattctccaacctgcccatgtgcaagaaccactggaagagggccaggtgcagtggctcatgtttgtaatcccagcacttttggaggctgaggcgggtggatctcctgaggtcaggagtttgagaccagcctggccaaca

SEQ ID NO: 148918 - DNA, 601 bp, Human
gatgtcaaaggcagtctctttgatgataactggattcaaaatcctgaaatgttttggctgcagtgggattttttctgccacctgcttccaaaagaagagtcgtacccagaatggctaaggaaagcaagcaagcagttgttagtcatccttctaggggaggggagaaagcattcccactcatcagaccaaggctgtgggtgtgaccccatgtggccctgtgcactgccttctgaagcaatctactcctatagattgcaaaagctacgcaaatccggcactccaactcaaaaaagtaactctraaatagccacttcacacaggcggcactggacaaagagatgaattgcagaaccagcttgtatttgtttgaggtagacattcctcaatggtgctaacaccatcattttgtctagggaagcccaagtgaataggtccaatttaaggctattaagtgctgaaactgccctcacctcgcatcctctctcacttactctatttcctagtcccatgaagtcgtttcatatatgcttcatcttccaactagaacttctgcccaatagaaaatccagaagaccatgatgactgatatagaatcagcttt

SEQ ID NO: 148919 - DNA, 601 bp, Human
tgagtactgaaggatgtcaaaggcagtctctttgatgataactggattcaaaatcctgaaatgttttggctgcagtgggattttttctgccacctgcttccaaaagaagagtcgtacccagaatggctaaggaaagcaagcaagcagttgttagtcatccttctaggggaggggagaaagcattcccactcatcagaccaaggctgtgggtgtgaccccatgtggccctgtgcactgccttctgaagcaatctactcctatagattgcaaaagctacgcaaatccggcactccaactcaawaaagtaactctgaaatagccacttcacacaggcggcactggacaaagagatgaattgcagaaccagcttgtatttgtttgaggtagacattcctcaatggtgctaacaccatcattttgtctagggaagcccaagtgaataggtccaatttaaggctattaagtgctgaaactgccctcacctcgcatcctctctcacttactctatttcctagtcccatgaagtcgtttcatatatgcttcatcttccaactagaacttctgcccaatagaaaatccagaagaccatgatgactgatat

SEQ ID NO: 148920 - DNA, 601 bp, Human; identical to SEQ ID NO: 20977

SEQ ID NO: 148921 - DNA, 601 bp, Human; identical to SEQ ID NO: 20978

SEQ ID NO: 148922 - DNA, 601 bp, Human; identical to SEQ ID NO: 20979

SEQ ID NO: 148923 - DNA, 601 bp, Human; identical to SEQ ID NO: 20980

SEQ ID NO: 148924 - DNA, 601 bp, Human; identical to SEQ ID NO: 20981

SEQ ID NO: 148925 - DNA, 601 bp, Human; identical to SEQ ID NO: 20982

SEQ ID NO: 148926 - DNA, 601 bp, Human; identical to SEQ ID NO: 20983

SEQ ID NO: 148927 - DNA, 601 bp, Human; identical to SEQ ID NO: 20984

SEQ ID NO: 148928 - DNA, 601 bp, Human; identical to SEQ ID NO: 20985

SEQ ID NO: 148929 - DNA, 601 bp, Human; identical to SEQ ID NO: 20986

SEQ ID NO: 148930 - DNA, 601 bp, Human; identical to SEQ ID NO: 20987

SEQ ID NO: 148931 - DNA, 601 bp, Human; identical to SEQ ID NO: 20988

SEQ ID NO: 148932 - DNA, 601 bp, Human; identical to SEQ ID NO: 20989

SEQ ID NO: 148933 - DNA, 601 bp, Human; identical to SEQ ID NO: 20990

SEQ ID NO: 148934 - DNA, 601 bp, Human; identical to SEQ ID NO: 20991

SEQ ID NO: 148935 - DNA, 601 bp, Human; identical to SEQ ID NO: 20992

SEQ ID NO: 148936 - DNA, 601 bp, Human; identical to SEQ ID NO: 20993

SEQ ID NO: 148937 - DNA, 601 bp, Human; identical to SEQ ID NO: 20994

SEQ ID NO: 148938 - DNA, 601 bp, Human; identical to SEQ ID NO: 20995

SEQ ID NO: 148939 - DNA, 601 bp, Human; identical to SEQ ID NO: 20996

SEQ ID NO: 148940 - DNA, 601 bp, Human; identical to SEQ ID NO: 20997

SEQ ID NO: 148941 - DNA, 601 bp, Human; identical to SEQ ID NO: 20998

SEQ ID NO: 148942 - DNA, 601 bp, Human; identical to SEQ ID NO: 20999

SEQ ID NO: 148943 - DNA, 601 bp, Human; identical to SEQ ID NO: 21000

SEQ ID NO: 148944 - DNA, 601 bp, Human; identical to SEQ ID NO: 21001

SEQ ID NO: 148945 - DNA, 601 bp, Human; identical to SEQ ID NO: 21002

SEQ ID NO: 148946 - DNA, 601 bp, Human; identical to SEQ ID NO: 21003

SEQ ID NO: 148947 - DNA, 601 bp, Human; identical to SEQ ID NO: 21004

SEQ ID NO: 148948 - DNA, 601 bp, Human
ggtcatacaaattcagtcaatcactgcagattttcaccagatgataagcttttggctagttgttcagctgatggaaccttaaaggtatgcttttgtacactattaaaataggttgtattttatggaaagtcttatgatttgattatagaaataggtttctgttttttcacatttctacagaaagagcctgcttctttcaatttccaggagcatatttaatgtaactgtaattgcttatcgtaatgattgtttatgaatggtgtacaacctaatgcttaaagttctataatgtaggctgggygcggtggctcacgcctgtaatcccagcactttgggaggccgaggtgggtggatcacaaggtcaggagttcaagaccagtctggctaagatggtgaaaccccgtctctactaaaaatacaaaaattagctgggtgtggtggtgagtgcctgtaatcccagctacttgggaggctgaggcagagaattgcttgaacccgggaggtggaggttgcagtgagctgagatcacgccactccactccagcctgggcgacagagtgagactccgtctcaaaaaaaaaaaaaaaagttctgtaatgta

SEQ ID NO: 148949 - DNA, 601 bp, Human
acaaggtaggaaaaatgcaagagttagggaaaaaagcttattcagccttctgaaatttataggcctaaaaaaatgaaataattcttcctcaaatccccaccttctccaataagattcccaattccactttattattcctgtctctattgtctctcctgtttattgactgtcctttctttctttggtcttaagatcaacccatctttgacattgttgtctcttggtctacatttttccctcttgttctgtagtagttgctctagttcaggctgttgtctgctcatgcctgatagcaaccatytaagatgcattctgcatctcttcttatctaagttcagagatactagaataaccttctaccactgttttctttctttttttttttttttttggagacagagtctcactctttcactcaggctggagtgcagtggtaccatcatggctcactgcagccttcacttctggtctcaagcagtcctcgtacttcagcctctcaagtaactggaatcacaagcatgtgccatcacacctggcgaaattttttttttttttttttttttagagataggatcttactatgttgcccatgcttgtctcc

SEQ ID NO: 148950 - DNA, 601 bp, Human
tcttcttatctaagttcagagatactagaataaccttctaccactgttttctttctttttttttttttttttggagacagagtctcactctttcactcaggctggagtgcagtggtaccatcatggctcactgcagccttcacttctggtctcaagcagtcctcgtacttcagcctctcaagtaactggaatcacaagcatgtgccatcacacctggcgaaattttttttttttttttttttttagagataggatcttactatgttgcccatgcttgtctccagctcctgggctcaagcawtcccagtgctgggattataggcgtgagccaccaagcctagcctaccactcttttcttttttcttttcttttctttttctttactcttctcttttctttctttctttcttttttttgaaacagggtcttattctgttgtctaggctggagtgcagtggcctgatcctggcccaccacagtctatctcctgggcttagatgatcctcccacctcagcctcttgagtagctgggactgcaagtgcctgctaccatgcccagctaattttttgtacttttattagagatggggttttgcctatg

SEQ ID NO: 148951 - DNA, 601 bp, Human
aaacgcagactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagwgagtgtgtgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgca

SEQ ID NO: 148952 - DNA, 601 bp, Human
acgcagactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagwgtgtgtgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaa

SEQ ID NO: 148953 - DNA, 601 bp, Human
gactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagagtgtstgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaagcatt

SEQ ID NO: 148954 - DNA, 601 bp, Human
ttgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagagtgtgtgtgtstgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaagcattcttcag

SEQ ID NO: 148955 - DNA, 601 bp, Human
gtactgggatcacagacatgagccaccacacctggactgcaaagcattcttcagaaagtgttctcttacagcatccatctgtttggttctgagtacatatatctatctatatctataggtagaaactgcttggtttgtcttctgatttccacttataaatgtgttgtactgttcagtcattttaatgtgtcttctgtttctttgattaggttgaatataggtttatgatctgcagggaacttgacatctttttgttgtattatacctttctttgtaactcatagtacagaattgtactcawgtattcagtaaattttcttgactacaccttttctaggaaaatacttaaatactcctgggcactattttgtttgttagaatctctagggaaggagattcagcaatgctactaactcctgagaaaggtaaactgttttgattctgatactctggttgaatctttgatcttgctttgctgacggaagataactgtttttgtataaattactccagagtatctagaaactctttctgggtagaattctactttgtagagtttagctagctgttagtgggtgctgggagcattcttaggtagaat

SEQ ID NO: 148956 - DNA, 601 bp, Human
cctgtaatcccagcactttgggaggccgaggtgggcggatcatgaggtcaggagttcgagaccagcctggccaacatggtgaaaccccgtctctactaaaaatacaaaaattagctgggcgtggtggcgcatgcctgtaatcccaactactcaggaggctgaggcaggagaattgcttgaacccgggaggcggaagttgcagtaagctgagattgcgccactgcactcaagcctgggggaagagcgagactccgtcttgaaaaaaaaagaaaaaatcctgtacttgtacctactgttcctmcctttccttcttttcctggcaccttgtttcattagttgtttcctctctatgttgcttcttcagatttttcttcttttttgaattattttccacagcttacaaatgttcttgggccttcctgagccttataaagccaaaaagtgaaaaacctttgattcttccttgattgtattgttctttaaaattgtcattctgtttttctctttcccttcatgactgggcttcttaagtcatctatacttgcctctgtttcctgactacctactccctgcttaaccattttttagcctggtttcatct

SEQ ID NO: 148957 - DNA, 601 bp, Human
ctgtaatcccagcactttgggaggccgaggtgggcggatcatgaggtcaggagttcgagaccagcctggccaacatggtgaaaccccgtctctactaaaaatacaaaaattagctgggcgtggtggcgcatgcctgtaatcccaactactcaggaggctgaggcaggagaattgcttgaacccgggaggcggaagttgcagtaagctgagattgcgccactgcactcaagcctgggggaagagcgagactccgtcttgaaaaaaaaagaaaaaatcctgtacttgtacctactgttcctcmctttccttcttttcctggcaccttgtttcattagttgtttcctctctatgttgcttcttcagatttttcttcttttttgaattattttccacagcttacaaatgttcttgggccttcctgagccttataaagccaaaaagtgaaaaacctttgattcttccttgattgtattgttctttaaaattgtcattctgtttttctctttcccttcatgactgggcttcttaagtcatctatacttgcctctgtttcctgactacctactccctgcttaaccattttttagcctggtttcatctt

SEQ ID NO: 148958 - DNA, 601 bp, Human
gttttttcatttgtttagtttttatatgtgcttatcttcaaactctctcttgttaatttgctccttaaatgattcaaacttaccaggcattttataagtcttttcttggaaacaacatttttggaaggttctatcttgctccattctggtcggtaatggtaatactattcccagagtccagctgccatcctgaggtcttccttaccatcatcctagggattccttttgcttttcttttaaattggaacacttgtttttcagttttttttttttttttcgtcttctttcttggcttactttytcagcttggtggagaatctcctctagcttcctaagaaagaatctatgggaagtaaatttttaaggtgtctttattataatgtctaaagatgtctctgtttttcacttgctgatttgcttgagttccttatgaattctggatattagacctttgttggatgcatagtttaacaaggccaacaaaagcaatgcgggagaggactctctattcaataaatggtgctgggataactggctagccatatgcagaagaatgaaactagacctttaccttttaccacatgtaaaaattaaagatgga

SEQ ID NO: 148959 - DNA, 601 bp, Human
ttgagttccttatgaattctggatattagacctttgttggatgcatagtttaacaaggccaacaaaagcaatgcgggagaggactctctattcaataaatggtgctgggataactggctagccatatgcagaagaatgaaactagacctttaccttttaccacatgtaaaaattaaagatggattaaaaatttaaatatatgacctcaagctattaaaatcctagaagaaaacctaggaaatacccttcttgacatcagtcttggcaaataatttttggccaagtcctcaaaagcaattgytacaaaaacaaactttgacaagtggaacctaattaaatgaaagcttctgcacagcaaaagaaactatcaacagagtaaactgcctacagaatggtggcttctttcaatctggaaacttatccttcagttctggcatttccttgaattatttgatttcttcctattttctctttctggaatgcttgtgtttctggattaaaattttttttcctctccttccttctttttgtccatttgccctactttttgaaagatttctttagctttacttttctttccttctattgagttttaaatttc

SEQ ID NO: 148960 - DNA, 601 bp, Human
agcaatgcgggagaggactctctattcaataaatggtgctgggataactggctagccatatgcagaagaatgaaactagacctttaccttttaccacatgtaaaaattaaagatggattaaaaatttaaatatatgacctcaagctattaaaatcctagaagaaaacctaggaaatacccttcttgacatcagtcttggcaaataatttttggccaagtcctcaaaagcaattgctacaaaaacaaactttgacaagtggaacctaattaaatgaaagcttctgcacagcaaaagaaactrtcaacagagtaaactgcctacagaatggtggcttctttcaatctggaaacttatccttcagttctggcatttccttgaattatttgatttcttcctattttctctttctggaatgcttgtgtttctggattaaaattttttttcctctccttccttctttttgtccatttgccctactttttgaaagatttctttagctttacttttctttccttctattgagttttaaatttctgctaccatatttttaagtattcattcttgtgtgattagttccttttaaatattattctgttcttg

SEQ ID NO: 148961 - DNA, 601 bp, Human
atatatgacctcaagctattaaaatcctagaagaaaacctaggaaatacccttcttgacatcagtcttggcaaataatttttggccaagtcctcaaaagcaattgctacaaaaacaaactttgacaagtggaacctaattaaatgaaagcttctgcacagcaaaagaaactatcaacagagtaaactgcctacagaatggtggcttctttcaatctggaaacttatccttcagttctggcatttccttgaattatttgatttcttcctattttctctttctggaatgcttgtgtttctggwttaaaattttttttcctctccttccttctttttgtccatttgccctactttttgaaagatttctttagctttacttttctttccttctattgagttttaaatttctgctaccatatttttaagtattcattcttgtgtgattagttccttttaaatattattctgttcttgtttcatggatgcagtatcttttatctttttatgggcattagtaatagggttttttttgaagttttcatattccagtgtaatagatatttttctatttgttggttttggtttctgtttggattttagaca

SEQ ID NO: 148962 - DNA, 601 bp, Human
gttttaaatttctgctaccatatttttaagtattcattcttgtgtgattagttccttttaaatattattctgttcttgtttcatggatgcagtatcttttatctttttatgggcattagtaatagggttttttttgaagttttcatattccagtgtaatagatatttttctatttgttggttttggtttctgtttggattttagacatagatatatcttagctatctgatcctttgctatctgctcatatttaagaatacatcaccaacaagttgaatgggaattgtgaacttttaaattktggttttcctatgggttatctgtttttatcatgaacaattttttttttttttttttagacagtcttggtgtgttgcccaggctggagtgctgtggcaccatctcggctcactgcaagatggtgaacttttgatgtcaaagtctttatatcttttgtcttgaactggttgggtgtccagagtaaaaattttcttttctcttttttctttttcttgcattttttttccctcccgagatggagtcttgctctgttgcccaggctggagtgcagtggcgtgatctcagctcaccacaacctctg

SEQ ID NO: 148963 - DNA, 601 bp, Human
agaaaaattcctattactattgtttacctgagttttgggagagtttggaaatggtctgtgtctgttctctgttttctgaaacataatacctgagactgggtaatttataaagaaaaggggtttacttggctcatgattctgatggccggaaattccaggattgggaagctacacctgatgagggccttcggctgcttccactcatggtggaaaggggaggggaagtgggcgtgtgcaaagagatcatatgaaaagagaggattgaagatagcgaaacccaggaagccagactgttttcaamaacccgcactcttgagaactaatccattcccagggaactcaccccagtgggaaggcattagaaggcattcatctgtttatgagggatccacccccatgacccagacacctcctatcaagccctacttcccaacactgccacagtggggatccaatttcaacacgagtttgggtcaggataaataaaccatctccaaaccatagcagagctgtatgtgttctctgcatctttaacacctgaaccctatttctttcagcaacactattgtctgtactcgcctgtgcttgaaacttgggagtg

SEQ ID NO: 148964 - DNA, 601 bp, Human
ctcagcttgaatatagcctccccactgtgctataccttttcctttcaaatgacacctgacatattttgtgtttaagttatttatgtgcttgtcttacttcccttactggcctgtcaactcattgagggtagtatctgtatctgattcatttatatagtctcaaagtgactagcatagtgtttaataaatgtgttaaagatgataaacccttgctgtgtcacttcaagtcaaactaagacttcttcaaactcggacactttttaaaaagtcatcatttgacagggacaggattttgatttcygtattcatgtatgagtatcaaaatgtgattgtggctcacagagcactcgcagcaggggacagacactactgcactcttggtgagaactgcccatgtttgtggtggctttcccaccgtgctgttaagtcagtatcattggttggttcacactgatataatgacaggtagtaagcagaggtcctgcaaaatgatgttagataacagcatttcaaggtcaaattctcctgtaagtttttaccttttgagaggatgaaaactgtaaaattatgtcctgccccaaatggctctataactttttaa

SEQ ID NO: 148965 - DNA, 601 bp, Human; identical to SEQ ID NO: 21005

SEQ ID NO: 148966 - DNA, 601 bp, Human; identical to SEQ ID NO: 21006

SEQ ID NO: 148967 - DNA, 601 bp, Human; identical to SEQ ID NO: 21007

SEQ ID NO: 148968 - DNA, 601 bp, Human; identical to SEQ ID NO: 21008

SEQ ID NO: 148969 - DNA, 601 bp, Human; identical to SEQ ID NO: 21009

SEQ ID NO: 148970 - DNA, 601 bp, Human; identical to SEQ ID NO: 21010

SEQ ID NO: 148971 - DNA, 601 bp, Human; identical to SEQ ID NO: 21011

SEQ ID NO: 148972 - DNA, 601 bp, Human; identical to SEQ ID NO: 21012

SEQ ID NO: 148973 - DNA, 601 bp, Human; identical to SEQ ID NO: 21013

SEQ ID NO: 148974 - DNA, 601 bp, Human; identical to SEQ ID NO: 21014

SEQ ID NO: 148975 - DNA, 601 bp, Human; identical to SEQ ID NO: 21015

SEQ ID NO: 148976 - DNA, 601 bp, Human; identical to SEQ ID NO: 21016

SEQ ID NO: 148977 - DNA, 601 bp, Human; identical to SEQ ID NO: 21017

SEQ ID NO: 148978 - DNA, 601 bp, Human; identical to SEQ ID NO: 21018

SEQ ID NO: 148979 - DNA, 601 bp, Human; identical to SEQ ID NO: 21019

SEQ ID NO: 148980 - DNA, 601 bp, Human; identical to SEQ ID NO: 21020

SEQ ID NO: 148981 - DNA, 601 bp, Human; identical to SEQ ID NO: 21021

SEQ ID NO: 148982 - DNA, 601 bp, Human; identical to SEQ ID NO: 21022

SEQ ID NO: 148983 - DNA, 601 bp, Human; identical to SEQ ID NO: 21023

SEQ ID NO: 148984 - DNA, 601 bp, Human; identical to SEQ ID NO: 21024

SEQ ID NO: 148985 - DNA, 601 bp, Human; identical to SEQ ID NO: 21025

SEQ ID NO: 148986 - DNA, 601 bp, Human; identical to SEQ ID NO: 21026

SEQ ID NO: 148987 - DNA, 601 bp, Human; identical to SEQ ID NO: 20977

SEQ ID NO: 148988 - DNA, 601 bp, Human; identical to SEQ ID NO: 20978

SEQ ID NO: 148989 - DNA, 601 bp, Human; identical to SEQ ID NO: 20979

SEQ ID NO: 148990 - DNA, 601 bp, Human; identical to SEQ ID NO: 20980

SEQ ID NO: 148991 - DNA, 601 bp, Human; identical to SEQ ID NO: 20981

SEQ ID NO: 148992 - DNA, 601 bp, Human; identical to SEQ ID NO: 20982

SEQ ID NO: 148993 - DNA, 601 bp, Human; identical to SEQ ID NO: 20983

SEQ ID NO: 148994 - DNA, 601 bp, Human; identical to SEQ ID NO: 20984

SEQ ID NO: 148995 - DNA, 601 bp, Human; identical to SEQ ID NO: 20985

SEQ ID NO: 148996 - DNA, 601 bp, Human; identical to SEQ ID NO: 20986

SEQ ID NO: 148997 - DNA, 601 bp, Human; identical to SEQ ID NO: 20987

SEQ ID NO: 148998 - DNA, 601 bp, Human; identical to SEQ ID NO: 20988

SEQ ID NO: 148999 - DNA, 601 bp, Human; identical to SEQ ID NO: 20989

SEQ ID NO: 149000 - DNA, 601 bp, Human; identical to SEQ ID NO: 20990

SEQ ID NO: 149001 - DNA, 601 bp, Human; identical to SEQ ID NO: 20991

SEQ ID NO: 149002 - DNA, 601 bp, Human; identical to SEQ ID NO: 20992

SEQ ID NO: 149003 - DNA, 601 bp, Human; identical to SEQ ID NO: 20993

SEQ ID NO: 149004 - DNA, 601 bp, Human; identical to SEQ ID NO: 20994

SEQ ID NO: 149005 - DNA, 601 bp, Human; identical to SEQ ID NO: 20995

SEQ ID NO: 149006 - DNA, 601 bp, Human; identical to SEQ ID NO: 20996

SEQ ID NO: 149007 - DNA, 601 bp, Human; identical to SEQ ID NO: 20997

SEQ ID NO: 149008 - DNA, 601 bp, Human; identical to SEQ ID NO: 20998

SEQ ID NO: 149009 - DNA, 601 bp, Human; identical to SEQ ID NO: 20999

SEQ ID NO: 149010 - DNA, 601 bp, Human; identical to SEQ ID NO: 21000

SEQ ID NO: 149011 - DNA, 601 bp, Human; identical to SEQ ID NO: 21001

SEQ ID NO: 149012 - DNA, 601 bp, Human; identical to SEQ ID NO: 21002

SEQ ID NO: 149013 - DNA, 601 bp, Human; identical to SEQ ID NO: 21003

SEQ ID NO: 149014 - DNA, 601 bp, Human; identical to SEQ ID NO: 21004

SEQ ID NO: 149015 - DNA, 601 bp, Human; identical to SEQ ID NO: 148948

SEQ ID NO: 149016 - DNA, 601 bp, Human; identical to SEQ ID NO: 148949

SEQ ID NO: 149017 - DNA, 601 bp, Human; identical to SEQ ID NO: 148950

SEQ ID NO: 149018 - DNA, 601 bp, Human; identical to SEQ ID NO: 148951

SEQ ID NO: 149019 - DNA, 601 bp, Human; identical to SEQ ID NO: 148952

SEQ ID NO: 149020 - DNA, 601 bp, Human; identical to SEQ ID NO: 148953

SEQ ID NO: 149021 - DNA, 601 bp, Human; identical to SEQ ID NO: 148954

SEQ ID NO: 149022 - DNA, 601 bp, Human; identical to SEQ ID NO: 148955

SEQ ID NO: 149023 - DNA, 601 bp, Human; identical to SEQ ID NO: 148956

SEQ ID NO: 149024 - DNA, 601 bp, Human; identical to SEQ ID NO: 148957

SEQ ID NO: 149025 - DNA, 601 bp, Human; identical to SEQ ID NO: 148958

SEQ ID NO: 149026 - DNA, 601 bp, Human; identical to SEQ ID NO: 148959

SEQ ID NO: 149027 - DNA, 601 bp, Human; identical to SEQ ID NO: 148960

SEQ ID NO: 149028 - DNA, 601 bp, Human; identical to SEQ ID NO: 148961

SEQ ID NO: 149029 - DNA, 601 bp, Human; identical to SEQ ID NO: 148962

SEQ ID NO: 149030 - DNA, 601 bp, Human; identical to SEQ ID NO: 148963

SEQ ID NO: 149031 - DNA, 601 bp, Human; identical to SEQ ID NO: 148964

SEQ ID NO: 149032 - DNA, 601 bp, Human; identical to SEQ ID NO: 21005

SEQ ID NO: 149033 - DNA, 601 bp, Human; identical to SEQ ID NO: 21006

SEQ ID NO: 149034 - DNA, 601 bp, Human; identical to SEQ ID NO: 21007

SEQ ID NO: 149035 - DNA, 601 bp, Human; identical to SEQ ID NO: 21008

SEQ ID NO: 149036 - DNA, 601 bp, Human; identical to SEQ ID NO: 21009

SEQ ID NO: 149037 - DNA, 601 bp, Human; identical to SEQ ID NO: 21010

SEQ ID NO: 149038 - DNA, 601 bp, Human; identical to SEQ ID NO: 21011

SEQ ID NO: 149039 - DNA, 601 bp, Human; identical to SEQ ID NO: 21012

SEQ ID NO: 149040 - DNA, 601 bp, Human; identical to SEQ ID NO: 21013

SEQ ID NO: 149041 - DNA, 601 bp, Human; identical to SEQ ID NO: 21014

SEQ ID NO: 149042 - DNA, 601 bp, Human; identical to SEQ ID NO: 21015

SEQ ID NO: 149043 - DNA, 601 bp, Human; identical to SEQ ID NO: 21016

SEQ ID NO: 149044 - DNA, 601 bp, Human; identical to SEQ ID NO: 21017

SEQ ID NO: 149045 - DNA, 601 bp, Human; identical to SEQ ID NO: 21018

SEQ ID NO: 149046 - DNA, 601 bp, Human; identical to SEQ ID NO: 21019

SEQ ID NO: 149047 - DNA, 601 bp, Human; identical to SEQ ID NO: 21020

SEQ ID NO: 149048 - DNA, 601 bp, Human; identical to SEQ ID NO: 21021

SEQ ID NO: 149049 - DNA, 601 bp, Human; identical to SEQ ID NO: 21022

SEQ ID NO: 149050 - DNA, 601 bp, Human; identical to SEQ ID NO: 21023

SEQ ID NO: 149051 - DNA, 601 bp, Human; identical to SEQ ID NO: 21024

SEQ ID NO: 149052 - DNA, 601 bp, Human; identical to SEQ ID NO: 21025

SEQ ID NO: 149053 - DNA, 601 bp, Human; identical to SEQ ID NO: 21026

SEQ ID NO: 149054 - DNA, 601 bp, Human; identical to SEQ ID NO: 20977

SEQ ID NO: 149055 - DNA, 601 bp, Human; identical to SEQ ID NO: 20978

SEQ ID NO: 149056 - DNA, 601 bp, Human; identical to SEQ ID NO: 20979

SEQ ID NO: 149057 - DNA, 601 bp, Human; identical to SEQ ID NO: 20980

SEQ ID NO: 149058 - DNA, 601 bp, Human; identical to SEQ ID NO: 20981

SEQ ID NO: 149059 - DNA, 601 bp, Human; identical to SEQ ID NO: 20982

SEQ ID NO: 149060 - DNA, 601 bp, Human; identical to SEQ ID NO: 20983

SEQ ID NO: 149061 - DNA, 601 bp, Human; identical to SEQ ID NO: 20984

SEQ ID NO: 149062 - DNA, 601 bp, Human; identical to SEQ ID NO: 20985

SEQ ID NO: 149063 - DNA, 601 bp, Human; identical to SEQ ID NO: 20986

SEQ ID NO: 149064 - DNA, 601 bp, Human; identical to SEQ ID NO: 20987

SEQ ID NO: 149065 - DNA, 601 bp, Human; identical to SEQ ID NO: 20988

SEQ ID NO: 149066 - DNA, 601 bp, Human; identical to SEQ ID NO: 20989

SEQ ID NO: 149067 - DNA, 601 bp, Human; identical to SEQ ID NO: 20990

SEQ ID NO: 149068 - DNA, 601 bp, Human; identical to SEQ ID NO: 20991

SEQ ID NO: 149069 - DNA, 601 bp, Human; identical to SEQ ID NO: 20992

SEQ ID NO: 149070 - DNA, 601 bp, Human; identical to SEQ ID NO: 20993

SEQ ID NO: 149071 - DNA, 601 bp, Human; identical to SEQ ID NO: 20994

SEQ ID NO: 149072 - DNA, 601 bp, Human; identical to SEQ ID NO: 20995

SEQ ID NO: 149073 - DNA, 601 bp, Human; identical to SEQ ID NO: 20996

SEQ ID NO: 149074 - DNA, 601 bp, Human; identical to SEQ ID NO: 20997

SEQ ID NO: 149075 - DNA, 601 bp, Human; identical to SEQ ID NO: 20998

SEQ ID NO: 149076 - DNA, 601 bp, Human; identical to SEQ ID NO: 20999

SEQ ID NO: 149077 - DNA, 601 bp, Human; identical to SEQ ID NO: 21000

SEQ ID NO: 149078 - DNA, 601 bp, Human; identical to SEQ ID NO: 21001

SEQ ID NO: 149079 - DNA, 601 bp, Human; identical to SEQ ID NO: 21002

SEQ ID NO: 149080 - DNA, 601 bp, Human; identical to SEQ ID NO: 21003

SEQ ID NO: 149081 - DNA, 601 bp, Human; identical to SEQ ID NO: 21004

SEQ ID NO: 149082 - DNA, 601 bp, Human; identical to SEQ ID NO: 148948

SEQ ID NO: 149083 - DNA, 601 bp, Human; identical to SEQ ID NO: 148949

SEQ ID NO: 149084 - DNA, 601 bp, Human; identical to SEQ ID NO: 148950

SEQ ID NO: 149085 - DNA, 601 bp, Human; identical to SEQ ID NO: 148951

SEQ ID NO: 149086 - DNA, 601 bp, Human; identical to SEQ ID NO: 148952

SEQ ID NO: 149087 - DNA, 601 bp, Human; identical to SEQ ID NO: 148953

SEQ ID NO: 149088 - DNA, 601 bp, Human; identical to SEQ ID NO: 148954

SEQ ID NO: 149089 - DNA, 601 bp, Human; identical to SEQ ID NO: 148955

SEQ ID NO: 149090 - DNA, 601 bp, Human; identical to SEQ ID NO: 148956

SEQ ID NO: 149091 - DNA, 601 bp, Human; identical to SEQ ID NO: 148957

SEQ ID NO: 149092 - DNA, 601 bp, Human; identical to SEQ ID NO: 148958

SEQ ID NO: 149093 - DNA, 601 bp, Human; identical to SEQ ID NO: 148959

SEQ ID NO: 149094 - DNA, 601 bp, Human; identical to SEQ ID NO: 148960

SEQ ID NO: 149095 - DNA, 601 bp, Human; identical to SEQ ID NO: 148961

SEQ ID NO: 149096 - DNA, 601 bp, Human; identical to SEQ ID NO: 148962

SEQ ID NO: 149097 - DNA, 601 bp, Human; identical to SEQ ID NO: 148963

SEQ ID NO: 149098 - DNA, 601 bp, Human; identical to SEQ ID NO: 148964

SEQ ID NO: 149099 - DNA, 601 bp, Human; identical to SEQ ID NO: 21005

SEQ ID NO: 149100 - DNA, 601 bp, Human; identical to SEQ ID NO: 21006

SEQ ID NO: 149101 - DNA, 601 bp, Human; identical to SEQ ID NO: 21007

SEQ ID NO: 149102 - DNA, 601 bp, Human; identical to SEQ ID NO: 21008

SEQ ID NO: 149103 - DNA, 601 bp, Human; identical to SEQ ID NO: 21009

SEQ ID NO: 149104 - DNA, 601 bp, Human; identical to SEQ ID NO: 21010

SEQ ID NO: 149105 - DNA, 601 bp, Human; identical to SEQ ID NO: 21011

SEQ ID NO: 149106 - DNA, 601 bp, Human; identical to SEQ ID NO: 21012

SEQ ID NO: 149107 - DNA, 601 bp, Human; identical to SEQ ID NO: 21013

SEQ ID NO: 149108 - DNA, 601 bp, Human; identical to SEQ ID NO: 21014

SEQ ID NO: 149109 - DNA, 601 bp, Human; identical to SEQ ID NO: 21015

SEQ ID NO: 149110 - DNA, 601 bp, Human; identical to SEQ ID NO: 21016

SEQ ID NO: 149111 - DNA, 601 bp, Human; identical to SEQ ID NO: 21017

SEQ ID NO: 149112 - DNA, 601 bp, Human; identical to SEQ ID NO: 21018

SEQ ID NO: 149113 - DNA, 601 bp, Human; identical to SEQ ID NO: 21019

SEQ ID NO: 149114 - DNA, 601 bp, Human; identical to SEQ ID NO: 21020

SEQ ID NO: 149115 - DNA, 601 bp, Human; identical to SEQ ID NO: 21021

SEQ ID NO: 149116 - DNA, 601 bp, Human; identical to SEQ ID NO: 21022

SEQ ID NO: 149117 - DNA, 601 bp, Human; identical to SEQ ID NO: 21023

SEQ ID NO: 149118 - DNA, 601 bp, Human; identical to SEQ ID NO: 21024

SEQ ID NO: 149119 - DNA, 601 bp, Human; identical to SEQ ID NO: 21025

SEQ ID NO: 149120 - DNA, 601 bp, Human; identical to SEQ ID NO: 21026

SEQ ID NO: 149121 - DNA, 601 bp, Human; identical to SEQ ID NO: 20977

SEQ ID NO: 149122 - DNA, 601 bp, Human; identical to SEQ ID NO: 20978

SEQ ID NO: 149123 - DNA, 601 bp, Human; identical to SEQ ID NO: 20979

SEQ ID NO: 149124 - DNA, 601 bp, Human; identical to SEQ ID NO: 20980

SEQ ID NO: 149125 - DNA, 601 bp, Human; identical to SEQ ID NO: 20981

SEQ ID NO: 149126 - DNA, 601 bp, Human; identical to SEQ ID NO: 20982

SEQ ID NO: 149127 - DNA, 601 bp, Human; identical to SEQ ID NO: 20983

SEQ ID NO: 149128 - DNA, 601 bp, Human; identical to SEQ ID NO: 20984

SEQ ID NO: 149129 - DNA, 601 bp, Human; identical to SEQ ID NO: 20985

SEQ ID NO: 149130 - DNA, 601 bp, Human; identical to SEQ ID NO: 20986

SEQ ID NO: 149131 - DNA, 601 bp, Human; identical to SEQ ID NO: 20987

SEQ ID NO: 149132 - DNA, 601 bp, Human; identical to SEQ ID NO: 20988

SEQ ID NO: 149133 - DNA, 601 bp, Human; identical to SEQ ID NO: 20989

SEQ ID NO: 149134 - DNA, 601 bp, Human; identical to SEQ ID NO: 20990

SEQ ID NO: 149135 - DNA, 601 bp, Human; identical to SEQ ID NO: 20991

SEQ ID NO: 149136 - DNA, 601 bp, Human; identical to SEQ ID NO: 20992

SEQ ID NO: 149137 - DNA, 601 bp, Human; identical to SEQ ID NO: 20993

SEQ ID NO: 149138 - DNA, 601 bp, Human; identical to SEQ ID NO: 20994

SEQ ID NO: 149139 - DNA, 601 bp, Human; identical to SEQ ID NO: 20995

SEQ ID NO: 149140 - DNA, 601 bp, Human; identical to SEQ ID NO: 20996

SEQ ID NO: 149141 - DNA, 601 bp, Human; identical to SEQ ID NO: 20997

SEQ ID NO: 149142 - DNA, 601 bp, Human; identical to SEQ ID NO: 20998

SEQ ID NO: 149143 - DNA, 601 bp, Human; identical to SEQ ID NO: 20999

SEQ ID NO: 149144 - DNA, 601 bp, Human; identical to SEQ ID NO: 21000

SEQ ID NO: 149145 - DNA, 601 bp, Human; identical to SEQ ID NO: 21001

SEQ ID NO: 149146 - DNA, 601 bp, Human; identical to SEQ ID NO: 21002

SEQ ID NO: 149147 - DNA, 601 bp, Human; identical to SEQ ID NO: 21003

SEQ ID NO: 149148 - DNA, 601 bp, Human; identical to SEQ ID NO: 21004

SEQ ID NO: 149149 - DNA, 601 bp, Human; identical to SEQ ID NO: 148948

SEQ ID NO: 149150 - DNA, 601 bp, Human; identical to SEQ ID NO: 148949

SEQ ID NO: 149151 - DNA, 601 bp, Human; identical to SEQ ID NO: 148950

SEQ ID NO: 149152 - DNA, 601 bp, Human; identical to SEQ ID NO: 148951

SEQ ID NO: 149153 - DNA, 601 bp, Human; identical to SEQ ID NO: 148952

SEQ ID NO: 149154 - DNA, 601 bp, Human; identical to SEQ ID NO: 148953

SEQ ID NO: 149155 - DNA, 601 bp, Human; identical to SEQ ID NO: 148954

SEQ ID NO: 149156 - DNA, 601 bp, Human; identical to SEQ ID NO: 148955

SEQ ID NO: 149157 - DNA, 601 bp, Human; identical to SEQ ID NO: 148956

SEQ ID NO: 149158 - DNA, 601 bp, Human; identical to SEQ ID NO: 148957

SEQ ID NO: 149159 - DNA, 601 bp, Human; identical to SEQ ID NO: 148958

SEQ ID NO: 149160 - DNA, 601 bp, Human; identical to SEQ ID NO: 148959

SEQ ID NO: 149161 - DNA, 601 bp, Human; identical to SEQ ID NO: 148960

SEQ ID NO: 149162 - DNA, 601 bp, Human; identical to SEQ ID NO: 148961

SEQ ID NO: 149163 - DNA, 601 bp, Human; identical to SEQ ID NO: 148962

SEQ ID NO: 149164 - DNA, 601 bp, Human; identical to SEQ ID NO: 148963

SEQ ID NO: 149165 - DNA, 601 bp, Human; identical to SEQ ID NO: 148964

SEQ ID NO: 149166 - DNA, 601 bp, Human; identical to SEQ ID NO: 21005

SEQ ID NO: 149167 - DNA, 601 bp, Human; identical to SEQ ID NO: 21006

SEQ ID NO: 149168 - DNA, 601 bp, Human; identical to SEQ ID NO: 21007

SEQ ID NO: 149169 - DNA, 601 bp, Human; identical to SEQ ID NO: 21008

SEQ ID NO: 149170 - DNA, 601 bp, Human; identical to SEQ ID NO: 21009

SEQ ID NO: 149171 - DNA, 601 bp, Human; identical to SEQ ID NO: 21010

SEQ ID NO: 149172 - DNA, 601 bp, Human; identical to SEQ ID NO: 21011

SEQ ID NO: 149173 - DNA, 601 bp, Human; identical to SEQ ID NO: 21012

SEQ ID NO: 149174 - DNA, 601 bp, Human; identical to SEQ ID NO: 21013

SEQ ID NO: 149175 - DNA, 601 bp, Human; identical to SEQ ID NO: 21014

SEQ ID NO: 149176 - DNA, 601 bp, Human; identical to SEQ ID NO: 21015

SEQ ID NO: 149177 - DNA, 601 bp, Human; identical to SEQ ID NO: 21016

SEQ ID NO: 149178 - DNA, 601 bp, Human; identical to SEQ ID NO: 21017

SEQ ID NO: 149179 - DNA, 601 bp, Human; identical to SEQ ID NO: 21018

SEQ ID NO: 149180 - DNA, 601 bp, Human; identical to SEQ ID NO: 21019

SEQ ID NO: 149181 - DNA, 601 bp, Human; identical to SEQ ID NO: 21020

SEQ ID NO: 149182 - DNA, 601 bp, Human; identical to SEQ ID NO: 21021

SEQ ID NO: 149183 - DNA, 601 bp, Human; identical to SEQ ID NO: 21022

SEQ ID NO: 149184 - DNA, 601 bp, Human; identical to SEQ ID NO: 21023

SEQ ID NO: 149185 - DNA, 601 bp, Human; identical to SEQ ID NO: 21024

SEQ ID NO: 149186 - DNA, 601 bp, Human; identical to SEQ ID NO: 21025

SEQ ID NO: 149187 - DNA, 601 bp, Human; identical to SEQ ID NO: 21026

SEQ ID NO: 149188 - DNA, 601 bp, Human
ccgtgcctggcaggaattactgtagttaccttttgtgtagttgctgaaatttattatggaacccaaacaaaaataatcatgagattaaatttttatgttagctgtttggtgcatttaattttttttttcttgttttaaataaaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcytgtatagcaatatgcttggagaggtatgtaattaactttaaaattgaatgttccgagtgtttaagactttccgagtgttcttagatttttgtctgtcttgccttattttagcactgaagaaaatggtcctacaaagtgagcaacttgttttaaatcgtatgcctgtgtcagcagagacaggttgataaatgtatttcattaaattacaattctccttttaatatactatcttgttttctaagtaagttggattttgagttttttagagaagggctctgggactcctttgcgtagttccgg

SEQ ID NO: 149189 - DNA, 601 bp, Human
cctgacctcaggtgatccacccgcctcggcctcccaaagtgctgggattacaggcgtgagacaccgcgtctggctgtgaacttcattttttagtattaagcctaccagactttttaaaaagactattataacatttaatgtctatttacctgtatgtagaacataaacttgagaggtaaagataagttaatacatggtttgagccctggactgagttttttttttttccctagagtaaggaccatttgtcggtctacaaatgacttgatgtttggcctaaacatttactattaacttttasggagggcttgttagtatccttgtgatctattcacagttaagaatttccatgaccacaacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcgg

SEQ ID NO: 149190 - DNA, 601 bp, Human
tttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacaggcatgcaccgccatgcccggctgatttttgtttttgttttttgtttttttttgagatggagttttacccttgttgcccaggctggagtgcagtggtgcartcttggctcactgcagcctccgcctcctgggttcaagcgattctcctgtctcagcctcctgagtagctgggattgcaggcgtctgccactacgcccggctaatttttagtatttttagtagagacggtttcactatgttggccaggctggtctcaaactcctggccccaggtgatctgcctgcctcggcctcccaaagtgctgggattacaggcgtgagccaccgcgcctggcctgatttttgtaaagatggggtttcaccatgttgatgagtctggtctcaaactcctgacctcaggtg

SEQ ID NO: 149191 - DNA, 601 bp, Human
taatagctcactgcaacctcctcctcctgggttcaagtgattcttctgccgcagcctcccaagtagctgggacaggcatgcaccgccatgcccggctgatttttgtttttgttttttgtttttttttgagatggagttttacccttgttgcccaggctggagtgcagtggtgcaatcttggctcactgcagcctccgcctcctgggttcaagcgattctcctgtctcagcctcctgagtagctgggattgcaggcgtctgccactacgcccggctaatttttagtatttttagtagagacggtttcactatgttggccaggctggtctcaaactcctggccccaggtgatctgcctgcctcggcctcccaaagtgctgggattacaggcgtgagccaccgcgcctggcctgatttttgtaaagatggggtttcaccatgttgatgagtctggtctcaaactcctgacctcaggtgatgtgcctggcctataaagcagttttatcttcccataacattttatatgctttttaggattcataaatacttgctaactagttcctaaaagggctgtttcatgggatgtcattattaggcttggga

SEQ ID NO: 149192 - DNA, 601 bp, Human
aagtagctgggacaggcatgcaccgccatgcccggctgatttttgtttttgttttttgtttttttttgagatggagttttacccttgttgcccaggctggagtgcagtggtgcaatcttggctcactgcagcctccgcctcctgggttcaagcgattctcctgtctcagcctcctgagtagctgggattgcaggcgtctgccactacgcccggctaatttttagtatttttagtagagacggtttcactatgttggccaggctggtctcaaactcctggccccaggtgatctgcctgcctyggcctcccaaagtgctgggattacaggcgtgagccaccgcgcctggcctgatttttgtaaagatggggtttcaccatgttgatgagtctggtctcaaactcctgacctcaggtgatgtgcctggcctataaagcagttttatcttcccataacattttatatgctttttaggattcataaatacttgctaactagttcctaaaagggctgtttcatgggatgtcattattaggcttgggaatgtattgatcttactgttgcaccatttttttgttgttgtttattaagaattttatacag

SEQ ID NO: 149193 - DNA, 601 bp, Human; identical to SEQ ID NO: 149188

SEQ ID NO: 149194 - DNA, 601 bp, Human; identical to SEQ ID NO: 149189

SEQ ID NO: 149195 - DNA, 601 bp, Human; identical to SEQ ID NO: 149190

SEQ ID NO: 149196 - DNA, 601 bp, Human; identical to SEQ ID NO: 149191

SEQ ID NO: 149197 - DNA, 601 bp, Human; identical to SEQ ID NO: 149192

SEQ ID NO: 149198 - DNA, 601 bp, Human
ctacttttcctgttggccatttcttcattggcagcacttacccattggaagcacttgtttatttggggtctgaatgggaagagtggctgtctgggctggtgaatagaggcctattctggatctaactacaattttccctgtctcaggctgtggccccaactttgtttttaatctattttttcattcacaaactaaagaatacatcctacagaatacctaaaactccaccagggtttcagaagctacgtggaatgcggtattgtgaatatttcacaagctccttttccaaccttcacataarctttcacgaactatgcttaactcgtacttcgatagaagctaaaacacaggtgttttcctgacatcacaaagtgtccaacgtgacatctactcatctcctttgaaagcctcaggggcagttagggtgaccctggctacatcaaacactgagttatcagaggcacattaggatgaggatgtagctttggtaaagatttatttaacaacgctcagaatcttctcacttgacagggaaccttcccatggatttcaatcagagaacatgtagctagaaaagagaaaaatatgttttgtctaatct

SEQ ID NO: 149199 - DNA, 601 bp, Human
aagggtccacaaatggctttgctgcaacatgataaagccagaagcacttgaactaaatggctcaatgcaaactatatttactaaatcgaatcacttatgatgtagtactagagatgctcatctgtcttttcagcaagactataaattcctggatgtgagaggtcatgcatgtcttaatcattttgcttactctgcccactgcattgtataggcattcaataacatggaagcagagaggacaaggtaggaaaacaagaagagaggaagcagaaatcacattcagtaaagcagaagggtaggsgcaagagtaagtgctggtaaaggcatcacacatgcagaatcagaggtctccaactgcatgaggacagaggactcccacaggctgcttaaggtaaagaggaaagaaaggagctggtaaatcaacttaggacttagaagatataatgagatgtgaaactggactgagaggtgggacacgaggaagcaaagagaggattgggaagtcataaatacaaggagatgagttaccacggtcagaagctaagaaaactgtcttcattaaaccaccactgacacagggaaagtgggaggaaaaatgaaa

SEQ ID NO: 149200 - DNA, 601 bp, Human
agaaaaatactttccaggaattaggtgtttattactcttcaaaaattaatcccattatcctctgactcattatcaataataaagtttaaaagctatttagccccctaaatacagctcttgaatcaaagaaatctgccttacaccagattctgcaacaaagaccaacattggtagagttaaaaatcaagagataccacaccaggaaggcttaagattagtaagctccatggacagaaaccaggagcttggttcccagctaacaaccacaacgcctagcacataacaggcacacaataaatayagtcagccctcatatggataagttctgcacccacagattcaaccaaccacagacaaagaaagaaagaaaaagaaaaaaactcaacatttaaaaatgacataaaaaatacagtacaacaactatttacatagcatttacattgcactgggtattactagtaatctagagatgatttaaagtatacggggggatgtgcataggttatatgcaaatatgatgacattttatataaagacttgagcgtccttggattttggtatcctcagggggtactggaaacaatccctaggactgagtata

SEQ ID NO: 149201 - DNA, 601 bp, Human
agacactgcaaatataaaaagtcaatttatttgtctctctcccacgatccttcaccacttaaaagttctacccccagctaagaggtgggctgaaatcaactttatttcaacaaaccaaacatccaaactatgtaatcatgggatgacatctgagtttgatctggctggctgcttataaaggaggctttcacaatgatacatgggaattttcattgttgaccaagctagacactagggcatactgcctgcatatttcctgctgaaatcagccaagtgcaaatagagacctaccttttttttaaaaaaaaaaaatgcctccatccatctgttttgaactatactgaaacttattttattttacacataaagataggactattagcctcctactttcgagacatggacctttttagttgttttctgagttcggtgatagatgtaggctgaattacatgtatactttcccacaaaccttaaccagtaccacatttgagaggacagctggttatttagggaacagtctggggccagggacctagtagatctaagagtgggattcaagcccaagtccttggcctcattagcacagtgttctcaccaa

SEQ ID NO: 149202 - DNA, 601 bp, Human
tagacactgcaaatataaaaagtcaatttatttgtctctctcccacgatccttcaccacttaaaagttctacccccagctaagaggtgggctgaaatcaactttatttcaacaaaccaaacatccaaactatgtaatcatgggatgacatctgagtttgatctggctggctgcttataaaggaggctttcacaatgatacatgggaattttcattgttgaccaagctagacactagggcatactgcctgcatatttcctgctgaaatcagccaagtgcaaatagagacctacctttttttwaaaaaaaaaaaatgcctccatccatctgttttgaactatactgaaacttattttattttacacataaagataggactattagcctcctactttcgagacatggacctttttagttgttttctgagttcggtgatagatgtaggctgaattacatgtatactttcccacaaaccttaaccagtaccacatttgagaggacagctggttatttagggaacagtctggggccagggacctagtagatctaagagtgggattcaagcccaagtccttggcctcattagcacagtgttctcacca

SEQ ID NO: 149203 - DNA, 601 bp, Human
agtagctgggactacaggcacgtaccactatgcctggctaatttttgcatttttggtagagatagggtttcatcatgttggccaggctggtctcaaactcctgacctcaaacgatccacctgccttggcctcccaaagtgctgggatgacaggcgtgagccatggaacctggccattatctaaaaatttctaaaagttggcagcccagttacatatggctatgtaatttgaaatagcaaagatggccatagaggttcacagatctttgaaacacaaacatactcactgctagaaagagggmaaaaatacaaagcagcagagattgccatttgagatttcctagagagaacagttccaggttaaacattagacactgcaaatataaaaagtcaatttatttgtctctctcccacgatccttcaccacttaaaagttctacccccagctaagaggtgggctgaaatcaactttatttcaacaaaccaaacatccaaactatgtaatcatgggatgacatctgagtttgatctggctggctgcttataaaggaggctttcacaatgatacatgggaattttcattgttgaccaagctagacact

SEQ ID NO: 149204 - DNA, 601 bp, Human
aaagggaatgccatctatccagtagcccaggccagaaactcaaaaatcatccagctaatctttcttcattaccccacatccactcaatcactaagctctgtttctcaaatctaatccttccaccatctcaacagcctctcccatcatgagtggcacatttacctccaacacatggtcgcctggcctccaaccttgctgtagcaataagagtcattgtgtcaattccctgatgaaatcccttcaatagcttttggttggttttatttatttaatttgagacagaatttcactcctgttgccmaggctagagtgcaatggtgtgatcccagctcactgcaaacctctgcttcccaggttcaagtgattctcctgactcagcctcccaagtagctgggattacaggcacacaccaccacgcccagctaatttttgtatttttagtagagggggtttcaccatgttggccaggctggtctcaaactcctgacctcaggtgatccgcccacctcagcctcccaaagtgctgggattacaagtgtgagccaccatgcccagcagcttttggttggttttaggaaaaagataaattactttttaaaac

SEQ ID NO: 149205 - DNA, 601 bp, Human
agaagagtattaagagccaggcacggtggctcacacctgtaatcccagcactttgggaggccgaggtgggcggatcgcttgaggtcaggcattcaagaccgaggtggccaacatggtgaaaccccatctctaccaaaaaaatataaaaaaattagctgggtgtggtgatgcgtgcctgtgatcccaactacttgggaggctgaggcaggagaatcacttgaacctgggagacggaggttgcagtgagctgagatggtgccaccgtactccagcctgggccatagagcaagactccgtctcaaaaaaaaaaaaaaagactattaaggaaattgaaagaatattttatcccttttctggattcacttcctaattctttagtctttcttatatattttatccttcttatcatcattaaatcaaggtattaaaaaattttaaaacccttcactcccacaaacatcctttcaagtgcaaaaagacactgaatgatcatcttttaattaaattgcattaattcttaggaaacgcttccttctgcattaacacacaatacatgaacacacagtccctcatctgtgagctcttgagaaacatgttttca

SEQ ID NO: 149206 - DNA, 601 bp, Human
ttggaaacattcaacataaatatcctgtcctatagggaatatttgcaaagccaaaaaaaaaaatgtcaattgagaatacaactaaaataattcccggcaatattttgtgactaatgatgacttgttaaagaagagtattaagagccaggcacggtggctcacacctgtaatcccagcactttgggaggccgaggtgggcggatcgcttgaggtcaggcattcaagaccgaggtggccaacatggtgaaaccccatctctaccaaaaaaatataaaaaaattagctgggtgtggtgatgcgygcctgtgatcccaactacttgggaggctgaggcaggagaatcacttgaacctgggagacggaggttgcagtgagctgagatggtgccaccgtactccagcctgggccatagagcaagactccgtctcaaaaaaaaaaaaaaagactattaaggaaattgaaagaatattttatcccttttctggattcacttcctaattctttagtctttcttatatattttatccttcttatcatcattaaatcaaggtattaaaaaattttaaaacccttcactcccacaaacatcctttcaagtgca

SEQ ID NO: 149207 - DNA, 601 bp, Human
catgaggctcataaagatcaaagaactgacaccttgagatcttggggagaaaagtagcttgtctccaacacatgatgctctcccctattatcttcctcccatccttcaagttgcgttttttgcttagtaacttggtaaatgttactcgaaacatctggaaaaaacagctaaagaaaccaaatggccctttgacagtagcacagtaaaaactttttaaaaatgcattcagaacttaaagtacaataaaaataaataaataaaaaatgcattcagtgattctcagctctatatatctctctgkaatctcttcacactctgttgtaaatttccatgtaaaaatatttctggtttcctatgggagcctttttataagcagatatgccaaagccttttcaagcactgtattggaaacattcaacataaatatcctgtcctatagggaatatttgcaaagccaaaaaaaaaaatgtcaattgagaatacaactaaaataattcccggcaatattttgtgactaatgatgacttgttaaagaagagtattaagagccaggcacggtggctcacacctgtaatcccagcactttgggaggccgaggtgg

SEQ ID NO: 149208 - DNA, 601 bp, Human
ctaatcctcacaataatttttaaaagatagtagtattattttcacattttagataaggaacatgaggctcataaagatcaaagaactgacaccttgagatcttggggagaaaagtagcttgtctccaacacatgatgctctcccctattatcttcctcccatccttcaagttgcgttttttgcttagtaacttggtaaatgttactcgaaacatctggaaaaaacagctaaagaaaccaaatggccctttgacagtagcacagtaaaaactttttaaaaatgcattcagaacttaaagtayaataaaaataaataaataaaaaatgcattcagtgattctcagctctatatatctctctgtaatctcttcacactctgttgtaaatttccatgtaaaaatatttctggtttcctatgggagcctttttataagcagatatgccaaagccttttcaagcactgtattggaaacattcaacataaatatcctgtcctatagggaatatttgcaaagccaaaaaaaaaaatgtcaattgagaatacaactaaaataattcccggcaatattttgtgactaatgatgacttgttaaagaagagta

SEQ ID NO: 149209 - DNA, 601 bp, Human
gccaagcccactgtatttgtctgttttcatactgctataaagatactacccaaaactaggtaatttgtaaacaaaggaggtttaattaactcacagttctgcatggctgggaggactcaggaaacttacaatcatggcagaaggggaagcaggcaacgaccttcttcacgtggtggcaggagagttagcaagagcaaggaaaactgccttacaaaaccattagatctcgtgagaacatattcactatgagtagaacagcatgggggaaactgcccccatgatccaatcacctcctacctgrtcccaccctccacatgtgaggattatggggattacaacgagatttgggtggggacacagagccaaaccatatcacctagcttggcccagtagtcccacccaggcttttacgccagtactgatggaccaacaaagcaaagaaggtataatcatgccatcaacagcaaccaaatccaggttctagaggaagtatttacaatatccactgtcaaaagttgggggcagtagcctaaaaatctgaatgtctccactgttcaatggtggtggcaggactgtctttaatggcttggtcctggtgaca

SEQ ID NO: 149210 - DNA, 601 bp, Human
gcagccaagcccactgtatttgtctgttttcatactgctataaagatactacccaaaactaggtaatttgtaaacaaaggaggtttaattaactcacagttctgcatggctgggaggactcaggaaacttacaatcatggcagaaggggaagcaggcaacgaccttcttcacgtggtggcaggagagttagcaagagcaaggaaaactgccttacaaaaccattagatctcgtgagaacatattcactatgagtagaacagcatgggggaaactgcccccatgatccaatcacctcctacytggtcccaccctccacatgtgaggattatggggattacaacgagatttgggtggggacacagagccaaaccatatcacctagcttggcccagtagtcccacccaggcttttacgccagtactgatggaccaacaaagcaaagaaggtataatcatgccatcaacagcaaccaaatccaggttctagaggaagtatttacaatatccactgtcaaaagttgggggcagtagcctaaaaatctgaatgtctccactgttcaatggtggtggcaggactgtctttaatggcttggtcctggtg

SEQ ID NO: 149211 - DNA, 601 bp, Human
tttccagcatctgaatgcgttttctatttgaatagaattccaaccatatgtgtctggcagggaagcagatcccaccaccacccacagaaggtaaaaaggccagatgttcactttgtcagcctattgcagccaagcccactgtatttgtctgttttcatactgctataaagatactacccaaaactaggtaatttgtaaacaaaggaggtttaattaactcacagttctgcatggctgggaggactcaggaaacttacaatcatggcagaaggggaagcaggcaacgaccttcttcacgtgrtggcaggagagttagcaagagcaaggaaaactgccttacaaaaccattagatctcgtgagaacatattcactatgagtagaacagcatgggggaaactgcccccatgatccaatcacctcctacctggtcccaccctccacatgtgaggattatggggattacaacgagatttgggtggggacacagagccaaaccatatcacctagcttggcccagtagtcccacccaggcttttacgccagtactgatggaccaacaaagcaaagaaggtataatcatgccatcaacagcaaccaaat

SEQ ID NO: 149212 - DNA, 601 bp, Human
tgattactattcattaaatacacaaacacacacacacatatttctgtgcacaagacactgtgtttgatgctgggctggtataaaaatgagtataaacaggcatggtatctaacctcttggagtttacaatctaggaggagagttagacttcagctatgcaaccccacaaaggtaaaattcagctgtagcaagtgctgcaaaggagaaaggcctgatgtatatcaataatggggaactgacctagttaggaaaatcagacaagacttccctgaggaaatgacactggtgctagggtaaataygagcaaaaaaggcaaaaagaagaatgagggagaatgttccaaactcaagagaacagccatgtgcaaaggccctgagataagaggtagcacaggtatgctgtggacagaagaaaggccagaagtcatgccatgtcccttccattgcattttattcttccaagtagtcccaagttccatccaggttcccagagagaaaaaacatactccacttcttgaaagacggtggcaaggtcagagaaaagagagcaaaaggaagtgttagactgtggatcctgaaaggtatgacgaccccagaacaca

SEQ ID NO: 149213 - DNA, 601 bp, Human
agaccctctcctcttagaataatccaaaaccagaatctccagagccccgtggtcaaaactaaaacgttccatctaggagtgagagagcacgatatctacttcctcacacttctcctcggttctcaaataaaagcgctcacttacatttgccatctttattctgtgatccgtttttatgttacagcaaataagcaaattatgaggtcctctgggcgaaaggaaaatcagcatggaatgtaagttattgtgccatctagagaaaatgtgagaggctggaagcctcaatcaactgtcttccttkaagaataacctagatcttggctcccactggcaaagatgagtgggggttattgtcttctctaagaaactaaacgtccctcacatgcttgaagatgtcgcaagggagacctgatggccccatttctgtgaggttgttcctcaaagaagaatcaaagatttcagtcacattagcatcatcatgttctcttagtccagaatttttcagcaaacatattccacaaaattttctgcaagttcagggtacatatagcaggtgcagtggatttttgttatgttttaatataacatactagagaaaatc

SEQ ID NO: 149214 - DNA, 601 bp, Human
atttcctggtatttttgctccctgaagattaagctctgattttttatcttgcccaaattcctatctaaggggtctggggagtcataacctacaaatcataaattctcatcagatgggttttatttgaccttgcatatcgtgacttactttccaatctgattctggcataacaaggaagaaaataaaaatgttttaccctaaaatatatttccttgccataccttgaaattgccctgcaaagtctcttgtgggaaaaatccacattctatacgaatctcctttcccctttgttttccttccttttttttttttttttttccagatccaggagataatcaactaagagccaggtacccttttaagtccagtaagaaataatttacaacctgctctctctgaagtctgctatctgagagcttcctctgcacaataaaacttggtccccacaatcctttgtctttaaccggaacattcttttctattgatcccaggtctttggacaaactcaaccaattgtcaacaagaaaatgtttaaatttacctatagcctggaagcccccactttgagttgtcccgcctttctgaaccaaacaaatgtatt

SEQ ID NO: 149215 - DNA, 601 bp, Human
ttgctgggtaggagccaaacttcctgtcataaagacatgagacgtttgtttctcctttggataaaaacaaattagctaatacaaatggtcaccccaaatacctggtaaaattaggatgaattaattacgtgtgacaaatgatgctgtcaagccctctttcttgaagactagttttgtttatcttgaaaacatgtatgtaatgggtagcctctacttggctatctaaaagggtaagatttctttttgtctttgcaatcgtttcatggattgcctgtgatgggtgtcatattctgatttaacrcttgtgtaataataacactcttctttctctactaccttttgtggagagaatttctggattgggaaaagacttttttttcaatcatgtttcctcagcagtgtcttctaatacaatgcactgaacagggaacataatttcctggtatttttgctccctgaagattaagctctgattttttatcttgcccaaattcctatctaaggggtctggggagtcataacctacaaatcataaattctcatcagatgggttttatttgaccttgcatatcgtgacttactttccaatctgattctggca

SEQ ID NO: 149216 - DNA, 601 bp, Human
aagcattgaaacctcaatagcaagaatcacccctaatgcccagatgctggtttctaaataccattctccaataaaagggactagagatccttggagaaacaatttattccagggccagagaaagaaaaatataagacaagcctggaacatcttgtggtgctggaaagtaattaaataaaaaaataaaaataaaaaaaaaaacagcagggccgtactggaaagacacaaaagccaacttgaaagagttctcagtggccaaatcaagaataatttaagcaacaaaacgaatgatattattagrttttaacacctaaaataaatatctaagaatccatactgatgcaaataaatgattgaataaatacattaaaaaataaatgagggcaattcttccatatagaagaattccaattaatatgtagaagaaataatgaaaatagaaaatcaccttttggtaaacacaatagtaacagttactacagaaaagaaccatcaatggatgctaaaatttgtgggtgaaactatgaatattaagaaacagtatatttgcatagtctcaaactatctcctccacaagacggtaattaattacaaaggaaaa

SEQ ID NO: 149217 - DNA, 601 bp, Human
tcttttttgatgtaatgatttctttcctctgggtagatacccagtagtgggactgccagactgaatggtagttctatttttagttctttgagaaatctccattattttccacagcagttgtactaatttacattcccaccaacagtgtataagtatttctttttctctgcatccttgccaacatttgttgttttttgactttttaataatagccactctgactggtataagatgatatctcattgcatttttaatttgcatttctctgatgatcagtgatgttgagcagtttttcatatgytttttggccatttgtatgccttcttttgaaaaatgactatgcatgaatttttccactttttaatgaaattatttgtggggttttttttttccttttttgagttgtttgagtccttgtaaatttggatatcagtcccctgtgggatgcatagtttgcaaatattttctcccattctgcagggtgtctgtttactttgttgattatttcttttgctgtgtagaagttttttaatttaattaagtcccatttgtctacttttgttttgttttgtttgtctttttctctggtccttgattcaga

SEQ ID NO: 149218 - DNA, 601 bp, Human
cagaaaggaggctggagtagctggagtgcagtagggagaaggaggaaaggacaggctggcgggcacaatgcagggcctcctacaccaaagaaagaaggctaagtttcagcctaagcataattagactccactgcagatttttataaacatcaccccagctgccacatggagaagagactgcagaaagcaagaatggaagcaaggagaccaaaaaggaggctggtgagttatccaagtcagagatggtggtagcttttcctgggggatgactgaggaaaaaaagaaaagtgggtgaagcctmgatacatgtttgcagtagaagctggaacttgctgaaagaagtttgtggctagtaagcgaaggagacctggaacagtcaggtggacagtgatgctgtctactgggacagagaacatttgcacttgctgtggatccagagttcagtcttggacattacatctgagatgcctatgagacctccagatagaggtgccattcatgcaggcaggctggggctccatgaagtcagggctagagacacagatgtgggagtaatcagcatactgatcatatttaaagccatgaaaatgaaagtgctcag

SEQ ID NO: 149219 - DNA, 601 bp, Human
gcctccccatctctcaaggtcatgcagtaagcaaagaagcagtcacatgaatccacttctgacttccaaaccagagttcttcctactgtgccttgcagcacatacgttctcacgttcacccaagtctgtctccccttgactactatcaaatattcttcacatgaggctaacagtacaatttatgtacaacctgatgtcaggcctctgagcccaagctaagccatcatatcccctgtgacctgcacatatgcattcagatggcctgatgcaactgaagaaccacaaaagaagtgaaaatagycagttcctgccttaactgatgacattccaccattgtgatttgttcctgccccaccctaactgaccaattgaccttgtgacattccttctcctggacagtgagtctcaggagctccccaccgagcaccttgtgacccccacccccgcctgcaagagaacaactccccttaactgcaattttccactacctacccaaatcctgtaaaactgcctcaccccatctccctttgctgactcctttttcggactcagtctgactgcacccaggtgattaaaaagctttattgctcacacaaagcct

SEQ ID NO: 149220 - DNA, 601 bp, Human
aagatctcactatatactgtttataagagacacactttaaatataaagacgtgagtaggccaggtatggtggcccatgcccataatcccagcagtttggcaggctgaaatgggaggactgcttgagcccaggagttcaggaccagcttgggcaacatagtgagaccctgtctattaaaaaaataataattaaaaaaaagacaaaaacaagatatgggtaggttaaaactatggaaaaagatataccagataaatattaatcaagtaaattcagatgtttttggtcaatgcaaaactacaaragaaacataatatccattttcttgattaattttcatagtagatttgtattaaagtgttttttaaacaaatatactttttatacttggctatgtcttagagaacattatatcccatataatatctgatgtgctaaaatatctttttctagtattgtgctcttttggatgtaagaaaatcgagctccaaaaaattaagctccagaaaattaaataagtattgttaatctgaaatagtacagctcccgggtattttgggtatataatcttctatggtatcaaaggaaaatactaactgcataa

SEQ ID NO: 149221 - DNA, 601 bp, Human
aggaacaagatctcactatatactgtttataagagacacactttaaatataaagacgtgagtaggccaggtatggtggcccatgcccataatcccagcagtttggcaggctgaaatgggaggactgcttgagcccaggagttcaggaccagcttgggcaacatagtgagaccctgtctattaaaaaaataataattaaaaaaaagacaaaaacaagatatgggtaggttaaaactatggaaaaagatataccagataaatattaatcaagtaaattcagatgtttttggtcaatgcaaaaytacaagagaaacataatatccattttcttgattaattttcatagtagatttgtattaaagtgttttttaaacaaatatactttttatacttggctatgtcttagagaacattatatcccatataatatctgatgtgctaaaatatctttttctagtattgtgctcttttggatgtaagaaaatcgagctccaaaaaattaagctccagaaaattaaataagtattgttaatctgaaatagtacagctcccgggtattttgggtatataatcttctatggtatcaaaggaaaatactaact

SEQ ID NO: 149222 - DNA, 601 bp, Human
cagcccagcctgttcccagctcaactatggattatactataagatcagctcctttccctagcagcccaatagaagaaggggacatgctttttcctggggataattatcacctactttaaatttctataagttttatacaaaatttcatacaaaatgactagtacacaacacaaactataaaacatgtaaataaagtagaaaacatgacgacctgttatcaagagaaataaggtcaaacccagagatgatcatgatattgaaattagcaaataaggattttaatataaatgttataaatacrttaaaaaattcagtagaaaaggtggaaaaatgctaaattaagaggaattttagcccagaaattgaaactctaaagaaacaaaagaaaattctagaactaaaaaacagaatatctgtaatgaagaattcattccatgcgctttagcaaattagacacaacagagagtgccctgagaaaatatcctccaaaaaggaagttgaaacaaagaccttttttagacagataaaagccgagagaattgactgttgccagacccatgctaccaaaaaatcacaaaggaagttcttcaaacacggaaaa

SEQ ID NO: 149223 - DNA, 601 bp, Human
caaaattcaaactttcactttgtactttgactttgtcatttggtgaaggaatcaacaccaagcaaaagcaggacacactgatgactgacctcttgccttgattctgcactgggctcaacattgtcttgaaaaaccaaatttatttcaatattgagaagtaggttagccgagtgaattagagagaggagtcattctggagcaggctgaagaggctggcaaaaccccatttcaaacccctgagtggagattagatagatagatagatagatagatagatagatagatagatagatagatagayagacagacagacagacagacagacagacagacagacaaaatatttcttggaaatatttccaaagtcaaaggtggcaaaagtaacttaaccattcttaccctgctggaatgggatgagctaggagtctagtgcagaatttggatacaaatcacatgctgtctccaatatatcaccctgtctctgacatcttatttagattagattttatgtcacagatgaccatacaaaaataaaatgcttcatgtgaatccagtaagtttacataagtaatttaagtcaagttcacaaattccataacag

SEQ ID NO: 149224 - DNA, 601 bp, Human
tctgagtatgtaaattattacttgaattcaatcaaaccatctgttttaaataataattgttttcctcattcggcatggcaaaagtgttccccaaatgttcatgattaaccagttgaattgaaaactaatcttaaagttatatttccttgagttacataattaaaataactaaattactgttttcagatacactaaaaatctgaaaaactactcaaagtagtatacctgaattgtaaaagaaacaaaaagataattataaaaaatgattcatactttttaaaaacaataccagtttttatayaaaatgcatttttagcaggcattttaagtaataaacaacacacaaaaaaattaaaccaaatcaactgggtataagaggaacttctccagagccctaatcggggataaagggttggtcagttgatggtactctagggacatgatggctttagatgatggggaacataatgataaattagaatttttaaatcaattttcttattagcccatacacttccccttgcactgtaaacataaatgccacttcaggccaggtgcagtggcttacacctataatcccagcactttgggaggccaaggg

SEQ ID NO: 149225 - DNA, 601 bp, Human
actggttttgcggaagataatttctccacagacggagtgggggacgggatggttatgagatgacattgttccacctcaaatcatcaggaattagattctcataaggaacacacaacctagatacctcgcatgcacagttcacaataggcttcatgctcctatgagaatctaatgctgctgctgatctgacagggggtggagtgcaggcggtgatgctcgcctgccactcacctcctgctgtgcagtcgggttcctaacaggccacggaatggtaccagtccatggcctgggggttggggamccctggagagtgcctataaatcaataagataaacgtgcaaaggccatgacagacagttcagatacaatggatataaatatgtggcatttacttacagagtaccttggtcatttagaacacaggctctggagccggaatgcctactaggcttgaatcccagccctgctactcagtatctccataaccctgggcaaataattttcctgctctatgtctcacatctcatgtctattaaaagagaatagaaacactacctacctcatagggtcgctcagttaattaagtcaaaaatataaagca

SEQ ID NO: 149226 - DNA, 601 bp, Human
caacaaaatcaaaggtttaaataaaattttaaaatacaaggagaaaacataggagaatattcttataatcttggagtaaggaagatctaaacaagtcataaaacgtagtgattataaagattgaaaattagactgcattaaaatttaagatatttgtatgaaaaaagaaatgtaaagaaaatgcaaactggaagtgtacttaaaacatatcagaaaaggccaatttccccaatatgtctagagcagtggtccccaacttttttagcaccaggaactggttttgcggaagataatttctccrcagacggagtgggggacgggatggttatgagatgacattgttccacctcaaatcatcaggaattagattctcataaggaacacacaacctagatacctcgcatgcacagttcacaataggcttcatgctcctatgagaatctaatgctgctgctgatctgacagggggtggagtgcaggcggtgatgctcgcctgccactcacctcctgctgtgcagtcgggttcctaacaggccacggaatggtaccagtccatggcctgggggttggggaaccctggagagtgcctataaatcaataa

SEQ ID NO: 149227 - DNA, 601 bp, Human
ccaacaaaatcaaaggtttaaataaaattttaaaatacaaggagaaaacataggagaatattcttataatcttggagtaaggaagatctaaacaagtcataaaacgtagtgattataaagattgaaaattagactgcattaaaatttaagatatttgtatgaaaaaagaaatgtaaagaaaatgcaaactggaagtgtacttaaaacatatcagaaaaggccaatttccccaatatgtctagagcagtggtccccaacttttttagcaccaggaactggttttgcggaagataatttctcyacagacggagtgggggacgggatggttatgagatgacattgttccacctcaaatcatcaggaattagattctcataaggaacacacaacctagatacctcgcatgcacagttcacaataggcttcatgctcctatgagaatctaatgctgctgctgatctgacagggggtggagtgcaggcggtgatgctcgcctgccactcacctcctgctgtgcagtcgggttcctaacaggccacggaatggtaccagtccatggcctgggggttggggaaccctggagagtgcctataaatcaata

SEQ ID NO: 149228 - DNA, 601 bp, Human
ttcccagaatcgagcagtttcacagtaaccttcctttactgtaaaactgctgctacgagctacaattaatatgttacttattaaaagaacagtcataattttaccagatgattttaaatgtccacaaaaatttttttaaagaacaggaaaataagtattagaaaactaaaccagaaagacagtgcatattttttaaggttataagcaagagctattaataaatggaaggatttcagtatcatcaaaaagctttctgtcttcctatattacataataagattaaatgtcatttacagacgcaaaaaaaaaaacccattgacctgtcagcttgtttcctgatgacataaatggccatatcatacagaaccatgaaatacaatgaaaatagccaccaatagccaccaacattcctgaaatgtatttgtgtttttagttagtatacagatggtaaagtctctttctttataacattgtacctctactcctaacaagtctaaatatcaacacttaacccagaattctatgttttttgccttaacttaagctggacatggtggcctatgcctatagttccagctacttggaaggctaaggcaagagg

SEQ ID NO: 149229 - DNA, 601 bp, Human
tcttcccagaatcgagcagtttcacagtaaccttcctttactgtaaaactgctgctacgagctacaattaatatgttacttattaaaagaacagtcataattttaccagatgattttaaatgtccacaaaaatttttttaaagaacaggaaaataagtattagaaaactaaaccagaaagacagtgcatattttttaaggttataagcaagagctattaataaatggaaggatttcagtatcatcaaaaagctttctgtcttcctatattacataataagattaaatgtcatttacagacrcaaaaaaaaaaacccattgacctgtcagcttgtttcctgatgacataaatggccatatcatacagaaccatgaaatacaatgaaaatagccaccaatagccaccaacattcctgaaatgtatttgtgtttttagttagtatacagatggtaaagtctctttctttataacattgtacctctactcctaacaagtctaaatatcaacacttaacccagaattctatgttttttgccttaacttaagctggacatggtggcctatgcctatagttccagctacttggaaggctaaggcaaga

SEQ ID NO: 149230 - DNA, 601 bp, Human; identical to SEQ ID NO: 38283

SEQ ID NO: 149231 - DNA, 601 bp, Human; identical to SEQ ID NO: 38284

SEQ ID NO: 149232 - DNA, 601 bp, Human
tacttccttttttcattcctttttaaatgtagatgacaaagatgcctgccttgtggggtgaggttaaataaatcactactgtaaagagcttggcatagtgttgagcccacaagggcccggtaaatgtcagccagcgtgactgcttcttcgcatgcccacgtctgccccaaccatctcaccctcccttggatctgaaggtcctctcccctcatctacctttttctgaattttaaacagtttcaaaggcagagctcaaattcaacttcctctgtggactgctgccattgtacattcagtcctkccctccctctcatggtcaccaatctctagatatttgatgtttagcattagcttgtttgttgcctttttaagctatcttctttatttcaagtagattgtaagttgcttgagggcaagagctctattgatttttattttatttttgtcataatagtataagagtctcagctaatgagttcttaatatctgttatgctgagttcggcactacttatgtacacaaaattatttgtctttctttcaagaatttcacatgatataaccaaaaaaaaggagggatctaaatcattaggagacaatat

SEQ ID NO: 149233 - DNA, 601 bp, Human
ccaattcattaaaggaaaggagtaaattaatcctgttaaaaatcgagcttgtgactttggatttactggcataggaagttctgtgtggctcaatgccaaacattcacacactgcctaagccgagtttgtgagaacctaccaggcactgggcactgtgccaggggttattctcctctactcaaacgtgacctcctgaaagaggcctttccaaccacccagctgaaatagcaccctctctcacttcctcttcccatgtcttcatgtatttttattcatgtttatccctggtgtatatcacacrtattgtgcatttgtttctggaatgtaacctccgtgcatttagtacttcagaatctctgggccctgaagcaccagaacagtcccaggacatcatatgaactcaataaatagttgttggatcagcgaatcagtcaatgacaatatactcaaagaagagttataatagatgtccgcccccactgcggccacctagcggactcacctatatcacatacctgtacgtgtcccactgcctcctgcttctattcttgccccaaaccatttctctagagataccacagccagaatgagcacttaaaaa

SEQ ID NO: 149234 - DNA, 601 bp, Human
acgtcactgtagagatcagcaagtggggtttagaggataaatcttgtgtaagatcctgtagccagtcaggggcagagcagctgcctccaaaactactgtaaatccactgccttaacaatcctctcactcctgcacctttctgcagaaccagccagtgtctattggatgagaaatggtgacttcccctacagtgatcaattaatctacaaataccttcgtaacaagttgtcgctatgggtgtatagatgtcatcctacaagcagccatacactctgcttgtagaaattctccaatattaacragtctgttggtgaccaccatggtctctaagaatcgcaaatccagagccacacacagactcaagaggctcacgaccacatgtccccacttgttcctgagggagctgcgcagatgcttgcccctactcccacaaggcagcctgggtgatcacaccttccatggttatctctggtccccatgtgtctctcacaatgaagaccctgtggctgccaaaagtgggctcctccacacaaaagggaggttgagtttcggtggcttttatcactggcccagtacagctcctggggagccacatagcagc

SEQ ID NO: 149235 - DNA, 601 bp, Human
aatgctgtttatccattctaagtatttgtaaatgaagcttacaaaatatcagattagaatgcaccatcaagatgttctaaagcatgggtatcaggagtgtgccattactcaatgcttacagtttgcagcctttaatttcaattgtcaccataatataggtataattgacctacatgcacacacacacatatatatcaacaaatactgaccctgtgctgactactctgtgcggaatgctctgaacatttatctgtgtcctttacatgtgacctatggtccaggatctgctgatattctaaakgaccgggccctttccaggttttatatcaccccaggcctgacaaggaaaacagggagttgaagagggagaaagggtaataaaccctatggctacatcttcctcctccctccaccctgtcaccctctatgataggcatctcaccaacattcatgacatcagacacctccctaaccaagcccccatgtggcccttcctcagattccaggatgaaatgctcagagtgacccaatttcagcttctttcagaaaagcagataaatcatgcttcagtctttggtatgccagaaactcaccactgggg

SEQ ID NO: 149236 - DNA, 601 bp, Human
tgcaacccctgcctcctgggttcaagcaattctcatgccttagcctcccaagtagctgagactacaggcatgcgacactatgcccggctaatttttgtatttttagtagagacagggtttcaccatgctggccaggctggtcttgaacccccgacctcaggtgatccacccatctcggcctcccaaagtgctgggattacaggcatgagccactgtgccaggccactttattatgtaattttaaaggaaataaaatcttgcccagtttcaaagaaacaatttggtattatcatccaattgyataaaataagaataaatgggtagctttaaacctacaaagctcaaaggtattttacagatattttatctttatctccactgtgatagcacactgcatggtgatttgcaataaaggttatatcttattttgaaaataactagggcaatagagaagaataaaaatagagttcatatacaaaataggccacagactacaaaggagtcccagggtatcacataagtgaggaaatactccttccctgtctcatagtgccaagcagtatttagtaattgtcccagacattggactaaatacatttaa

SEQ ID NO: 149237 - DNA, 601 bp, Human
ttagatcacaaaacaagttttaaaaaaactcaaaaaaaattgaaaacatatcaagtatcttctctgtcacaatgaaataaaactagaaatcagtaacaagaactctggaaactgtacaagtacatggaaactaaataatatgctcctaaatgaccaatgggtcaatgggtaaatcaagaagaaaattaaggaatttctgcaaacaaatgaaaatggaaacatgacataaaatgtatgggatatagcgaaggcagtactaagaggaaagttgatagatgtaagtgcctacatcaaaaaagtaaaaaaaaaaaaattcatataccataatgatgtatcttaactagaaaagcaagagcaaacccaatccaaaattaaaagaaataacaacagagcagaaataaatgaaattgaaacaaaaaatacaaaagatcaatgaaataaatagtggaaaaaaaaataaaattgacaaatttttagccagactaataaaaaaagaccaatgcaacagaacagagaacccagaaataaatccatacacctacaataaattcatttttgacaaaggtgacaagaacatacactggggaaaggacagtctctt

SEQ ID NO: 149238 - DNA, 601 bp, Human
aagcaaatattattaaagagagcaatagaccccaatacagtaatagctgaagacttcaacacccccactttcattattggacatatcatccagacagaaaattaacaaagaaacactggacttattatgcacaacagactaaatggacctaatagacatatacagctttatccaacagctgcagaacacacgttcttctcaccacatggatcattctcaaggatagatcatatgttagatcacaaaacaagttttaaaaaaactcaaaaaaaattgaaaacatatcaagtatcttctctgwcacaatgaaataaaactagaaatcagtaacaagaactctggaaactgtacaagtacatggaaactaaataatatgctcctaaatgaccaatgggtcaatgggtaaatcaagaagaaaattaaggaatttctgcaaacaaatgaaaatggaaacatgacataaaatgtatgggatatagcgaaggcagtactaagaggaaagttgatagatgtaagtgcctacatcaaaaaagtaaaaaaaaaaaaattcatataccataatgatgtatcttaactagaaaagcaagagcaaacccaatcc

SEQ ID NO: 149239 - DNA, 601 bp, Human
caaaggagaagagaatggggccaaaaataagcagaaggtggcctgggtgctccgcctgtcataggctctcatctgtggccagtaatcacggctggctaaaacagagcactagggtgggcctgctgtgcttaaacgacaaggatcctacagaggtaaaaatgttgcaaatgttatacacttcttccttatggcaatgaaaaatatgttctgaacatacatatattctaagcattcaatttctaaaagcatgttgtcccttctagtgctataaggcaaaagttactgatggtaacattataakatacacaatctgcatgcacaaatatatttataaaatatgtgaacaattctaaaagacagactgctttagaagaacagaaataatacaaattattctgcaaagtgtcattttccaacttatatcctaatccttacacctaccctattaattcaagaaaaaaaaaacagaaaatataaatcatacccctaaagcactcctacaccaggcaccaaaattacatagcatgatgatgcaaaattatggcactttcaaacagcatttgagagtgtgtcacaagcgatgaaaaatgtaatttatttc

SEQ ID NO: 149240 - DNA, 601 bp, Human
caggcttgcagggccaaaggagaagagaatggggccaaaaataagcagaaggtggcctgggtgctccgcctgtcataggctctcatctgtggccagtaatcacggctggctaaaacagagcactagggtgggcctgctgtgcttaaacgacaaggatcctacagaggtaaaaatgttgcaaatgttatacacttcttccttatggcaatgaaaaatatgttctgaacatacatatattctaagcattcaatttctaaaagcatgttgtcccttctagtgctataaggcaaaagttactgayggtaacattataatatacacaatctgcatgcacaaatatatttataaaatatgtgaacaattctaaaagacagactgctttagaagaacagaaataatacaaattattctgcaaagtgtcattttccaacttatatcctaatccttacacctaccctattaattcaagaaaaaaaaaacagaaaatataaatcatacccctaaagcactcctacaccaggcaccaaaattacatagcatgatgatgcaaaattatggcactttcaaacagcatttgagagtgtgtcacaagcgatgaaaa

SEQ ID NO: 149241 - DNA, 601 bp, Human
tttgctaagactcaggctggtcttaacatatataaagggagacaactactgctatgttttgaggaatccccaaagaccacatgaaaatatctccagccagtacccaccacttggaattccagtaaagttatccaatcaaaggactgcttgagcccaggagtttgaggctgcagtgtagcggttaaggtagtttgatttaagcatctggggactgagctatgatcatgctactgcacttcagcctcagtgatagagcaagaccttgttttcttggatatatatatacatatttaactatttwtatatatatatataaaatcacagcaaatacccataacttgggggaagaattaattaaaagacattattatttggaacttagtgcaactgaacttactgtaggcttttcaacatgtaattgtattgggagggtaaggaacaagaaatggtttgagggccctagtcatctagagatggagtacactgaagatagggtaggctaagaagggaagaacatattgagaataagaaatactccaaacaaactttctgaataaaacaccattcagtcactcacagatatatgccgagctcctttcaa

SEQ ID NO: 149242 - DNA, 601 bp, Human
cattaggtccaggagtgggcacatgatattaagctggatcagtcagaatcctttcctgtgatttttttcaatctaaagctaaaagggaaagttctctttactctcatgttcccaggctaaaaggaaataatccaggagctgcctacagctatgttcctctcaaatgagggaagtttatataaataaagaagaatgaagccaagggtctagaagaattagagctggataatgcaaaaagaattttgtgggtgtctgtgtccctcattcgagtttttgaggtctctggctttgatctggtttytgacactctttcttcaattctgtaaattatctttttcaatattgaaaatcacttggaagaaaacatacatataataatatcattctgtaaaacaaaacttggaaaatatcacaccaatccaagctggtgtgagatgtacaaagataaaagaaattatatgtttccatttgctcaactaagagccaacaaggaggcaggcaatgtaatatagttaaaatatatattaaactcacatctagcattatctgtaaggttaaaagtaaatatattttgaacactgagattaaccaattagaaaat

SEQ ID NO: 149243 - DNA, 601 bp, Human
tctactaaatgccagcttaaatgcaaattataccaaaatgagtgaactgtggaccctgcctttaactagctcatgatcttgtgagagatgcacataaaatgcagatagattatgcacaatgacataaagataaacactaataagccagacttgtaaggaagcaggaggccaactatagaagaaggttcaaggaatatcctagggaaaggtcacacctaagctgactcttaaaaacaagtaagctttgacaaaaagaagttggttggccgtatgaggaaggagaattttaaaggagaccataaaaaaaaaaaaatcgcacggggcacagaggaaattacaagccattgaatgtagtgagcgatcaagcccagcttaggaagtgctggaagatgatacaaaagagtcagaacataaacttgagtgcaaagttgaagataatgggctttgtcccgtgggcaacaggaagccaatggcgggtttgcagcatgtgaaccacacagtcagattttgtttggacagataacgttgggaacgagtgcagaacaaaactcagaaggcaaagcccagaagaaagggcacctgttaggaggttattgctgcc

SEQ ID NO: 149244 - DNA, 601 bp, Human
gcactcaagcaatgtttttaaagatttattcacataaagtgccataaaattgacgtacatctcaattaaccaggcacagaaatattttaactatagcataataaatactagttcactaagttttcaaacacctaaggaatgaaagtttatacatcccctacaaacagaaggacattctctcgtttaaatgagcacactgctgtcactgtgtttcagaactctgtcttacttgcaagttcgcaaagtcaactcaatcagcatgttcaggcactaaacaaactcaccaatactaaagtgtaarccaggaggccatcaaaattaattagatcattatattttagagcctcagaggacttgagaaagtaaatggttcaaccctttcattttacaattgagaacagaattgttgaacaatttgcccaaggcatgactagacccatatttttcacttacaccagccatgctctttaatttacaataggctatatctggttgatagacaaaatattattttgatgggttgaacaagggaaatcaaatttataacattgctttagtgaacatggagctctctatagcttgacacagtgccttccagaag

SEQ ID NO: 149245 - DNA, 601 bp, Human
gacttcaagataatatttgttgcatgactttagtaatttcatatatatatacacacacacacacacacacacacacatacatacatataactaaaatgctcaattttgttgatggagtagtttaaactttatacagcaatttaatcgaatataacagatataaaaagatatatggttatgccatgtctgaaatatcaggaatatccatgcactcaagcaatgtttttaaagatttattcacataaagtgccataaaattgacgtacatctcaattaaccaggcacagaaatattttaactrtagcataataaatactagttcactaagttttcaaacacctaaggaatgaaagtttatacatcccctacaaacagaaggacattctctcgtttaaatgagcacactgctgtcactgtgtttcagaactctgtcttacttgcaagttcgcaaagtcaactcaatcagcatgttcaggcactaaacaaactcaccaatactaaagtgtaaaccaggaggccatcaaaattaattagatcattatattttagagcctcagaggacttgagaaagtaaatggttcaaccctttcattttacaatt

SEQ ID NO: 149246 - DNA, 601 bp, Human
atgtgggatcaatctagttttaaacagaaagatttttctaatgcatttttggtatttttcaagctgtgatacagctgataggagttctgataaaatgtgaattacaggaaattcatatttataagcatttccaagtcattttagagcagtgacttttaaacatctgctaatgaagaatcctgaaagcagcactgtgtactaacttcgaatatttcctacctctgtttctttccttaacccaggctctgatggaataatcacatcttgggtcttgccatcctgagtctggttttgtgagctygtggtcactgtccacaaagaggatgtgactcagagtggagaggagaggtgggagtcataggtcataatctcttgagggggctggttgcctagtagttctagttctgttgtggccactgctagatttcacaatcatacacttctgaagtgctttctggttctgtttttggcttttaattttcccccaaagaataccagaaatcatagcactgctaagtagatgcgttgtgaaaacatatagacaggtctccccttgctctttctgtattggtttcctacagctactgttataagttaccac

SEQ ID NO: 149247 - DNA, 601 bp, Human
ctaagtcccagaaaaaaaatgtgaaattgcataactgctgtgggactctgggtgctttttttaaatttcaagaatggaactaaaggtaccatttcagttagatatacgatgataatgaagctgtcagaagtaactcctgagcacctgcaacatgttcaacaatttgttaggtgcaatccatctaggagaagcagtagacacaaataaacacatcttctcctgaccagaaaaacatgcagttaaacttgatacacacacacacacacaaatatgtgtgcatatctgcatatacatactgaaygtagatatgaagatggatagaaagctcacaaaagaacactaaaaactgaatattagcctgtgactataaatcagtcaaccatgctcaatgtactaaccatctccccttcctaagcagtcctcaacaccaggcagtcagattgttttaactcttcacttaaatggtatgaaatttctaatgtcagcaagcctatgatttacttacattttatatattacattaaaacaactcttagaaagttttcacacacacacagacacacacaaatataatgtcctgagactatagctctttgatagg

SEQ ID NO: 149248 - DNA, 601 bp, Human
ccgggaatgggctctctatccagctttgcagtttataaacactttcatcagttcattcgttcattcattaattcattcattcatccattcattcattcagctgttcattctccgagcaccaactctgtaccaaccactgccactgcttcttagactctaaagatacaaagaaccagagccctgcgcttcaaaaggaaatggctatgtatgcaactgggcacactatgtgttctcatggtctaatagacatctgccaggggtacaatggtgcacagaggacagagctgttaaacacctaagrtgaagagcttactaatatgatctgctcagtgctctttaactgaagcacttggtgagcgtgtgtgtgcatgtggtgtgtacatgcatgtatatgtacacacacatatgtggtgtgcactggtgctcaaaactcaaaactggggtggcagaagccggaaggtaaaaggctttgtaagccccctctcaggaatgttgcccaaggatgagagggaaccactatggaagatgagctcacaatgaccttcaagcattcctttctccaggaagcccaccctggcctcccagtctgctctcagctacc

SEQ ID NO: 149249 - DNA, 601 bp, Human
tgaccttgacctcatccttggtctttctcttaacactgaggattgtgacaatctggatcaactgcagatgcccaccaggcgcacagattcccgccaaccctctcaagacagaaaaaaaaaaggaagattcaggaaagttttctccctgacagtcagaggtggtgtaaaactggcatcaccagagttcaccgggaatgggctctctatccagctttgcagtttataaacactttcatcagttcattcgttcattcattaattcattcattcatccattcattcattcagctgttcattctcygagcaccaactctgtaccaaccactgccactgcttcttagactctaaagatacaaagaaccagagccctgcgcttcaaaaggaaatggctatgtatgcaactgggcacactatgtgttctcatggtctaatagacatctgccaggggtacaatggtgcacagaggacagagctgttaaacacctaaggtgaagagcttactaatatgatctgctcagtgctctttaactgaagcacttggtgagcgtgtgtgtgcatgtggtgtgtacatgcatgtatatgtacacacacatatgtggtg

SEQ ID NO: 149250 - DNA, 601 bp, Human
ggtttaaatggaacatggcaaacctatatcagaaaacttttggaaaaagctattaagatgaagctcataatatcattgaaactgtgcctgcctgaattgacttcattatgaatacaattctaagaatattcacacagtccaattttacatttaaatgtatgacacattgttcttaagtacattttaagctgcacattttagaactagatgatgaaaccacgtgcaattttatggtgtggtcacaaaggacacctaggagaggctgacatttctgtacacgagtgagtgaggctaactctaygcaaacatgaagagcgctttgtggttcctgcttcaaatggcatccagaaagtcatattttgtgtatcgagcactctctctcactttcccagtttatctattttgtgagactcatgcaggttgcaacaattttactttaactttggaaaggcctttgaattgctggaggtggtacactctagcaaatgaataactgaataaatgcataaatgatagataatccccaaaagaaaattctacattaagtaaacaatccatgtaaatttttttgcatatccgacttacctctttgaatttctta

SEQ ID NO: 149251 - DNA, 601 bp, Human
acttttaagaaaaaaagactgattaaagtgtatactcttatatgggtatgtgtgtataaaaaacctgattttctccttttcaaaaagtcagtggccaaatgaatttagcacacaataatgaattccacagctgggtttaaatggaacatggcaaacctatatcagaaaacttttggaaaaagctattaagatgaagctcataatatcattgaaactgtgcctgcctgaattgacttcattatgaatacaattctaagaatattcacacagtccaattttacatttaaatgtatgacacatygttcttaagtacattttaagctgcacattttagaactagatgatgaaaccacgtgcaattttatggtgtggtcacaaaggacacctaggagaggctgacatttctgtacacgagtgagtgaggctaactctacgcaaacatgaagagcgctttgtggttcctgcttcaaatggcatccagaaagtcatattttgtgtatcgagcactctctctcactttcccagtttatctattttgtgagactcatgcaggttgcaacaattttactttaactttggaaaggcctttgaattgctggag

SEQ ID NO: 149252 - DNA, 601 bp, Human
cacctccccagaagtcttccacatctctgaagtttttacacttattctctgtaccctaacagtaccacatgacagacaatttagatgttgctacagagaggagacgacactgtttcatatccacttcccccaaagctcatcacacacaacatggtcaggttacatacagcactccatatggagctaggacagggaaagcaacctagttttgtttttgttttcaggatgtctactacgtgctaagtccttgcctcacaattacctgtgaagtggatatttttagcctactttatggataagsaacttgaagtttaaataacatgcctaaggcggcataggcaggaagtgtttgagccaggggtaaggcccaagtttctccctccatgatgcctttcattacgcccatcattatctacagaaccttggaggaagcatcaccactgttaaggcactcaactgctaagtacaccaactagaccaaatctgaacacatgttttaagagtcataggggaaagctatgttactttgaacttttaggctgcttctgaagtcatggatgagaagaagcaaattcgaaagttaaaaatggaaatagtaggt

SEQ ID NO: 149253 - DNA, 601 bp, Human
accaaggataattctgtcctgttctttcttaattatatcagccaacctcttacactgaaaatgacaaaagagaaggaaagtgaaatataaggctacccatcgctccttttcttcagtccttactcaacagtaagcctaaggtaaagagggttggtagaatgtatacctatcaagaagtaaaataaaaacagctgagttagctttgtacagtatttccattcttctaataagaacaagatgcatatgcaggtacaaaataagaaataccaattgtgtaatttcattaatttcatgctcttawgttttgcacttaaaattggcattgcacaataaaaatagtaaaattagtattaataatggacatttttaatttttatttactcagaatgacagtaagtagcaaacaaattaacaacaacaaaaaaacaaatccatgacaggtcaagaagcagagaagaaatggaaaaagacatatgtaactacttttagcagcattcttccctactttttgaacatgaggtcctacatcttcattttgctctggaccccacaaattatgcagtcagccctggaagggtaactgtcatttcacaaaattttt

SEQ ID NO: 149254 - DNA, 601 bp, Human
gaaggagtacagagggtgctcacagcccctagaggccacactttctatcaaaaccagaacttgcttccgaggaggaaaggagacaatggcattctaagaaataaagatgaccaaggataattctgtcctgttctttcttaattatatcagccaacctcttacactgaaaatgacaaaagagaaggaaagtgaaatataaggctacccatcgctccttttcttcagtccttactcaacagtaagcctaaggtaaagagggttggtagaatgtatacctatcaagaagtaaaataaaaacagytgagttagctttgtacagtatttccattcttctaataagaacaagatgcatatgcaggtacaaaataagaaataccaattgtgtaatttcattaatttcatgctcttatgttttgcacttaaaattggcattgcacaataaaaatagtaaaattagtattaataatggacatttttaatttttatttactcagaatgacagtaagtagcaaacaaattaacaacaacaaaaaaacaaatccatgacaggtcaagaagcagagaagaaatggaaaaagacatatgtaactacttttagcag

SEQ ID NO: 149255 - DNA, 601 bp, Human
agatgaggtctccctacattgcccaggctggtcctgaactcctgggctcgagtaatctgcttacctcaacctcccaaagtgccgggattaaggcctgagctactgcatccggcctattttaaaaataaataaaaataaacctttggggaaaaaaagaaaagatagaaaatattcctctcaagcattttaacctatgattggggttcatcaaataatttcatttgaaaaggaataattctggcttcttaagttcaacagatggtatcttccagatatccttgcttctttcttaactgataastatgaaatactaatgatctacttgttttaatctgggaggaggaacagaaataaaagtagtcttttattggatttcttattgaactataatttttaaaatatttccattgtattaagtgcagttgaattaacttttattttgttgttatattttatatacttccagacacaagaaaacacagatgttggtaaacttaagaaaatatctgttttaggataagtgggaatgctgatatagtcaagaaacatttttttattcaacatttacctacagcaagatataagtcaataatgatgatga

SEQ ID NO: 149256 - DNA, 601 bp, Human
tgcagtggcacagtcatagctcactgcagtcttgacctcctgcctccatcctcccacctcagcctcctgaatagctgggactacgggcatgcatcatcacacctgactaatttcttttgctttttgtagagatgaggtctccctacattgcccaggctggtcctgaactcctgggctcgagtaatctgcttacctcaacctcccaaagtgccgggattaaggcctgagctactgcatccggcctattttaaaaataaataaaaataaacctttggggaaaaaaagaaaagatagaaaataytcctctcaagcattttaacctatgattggggttcatcaaataatttcatttgaaaaggaataattctggcttcttaagttcaacagatggtatcttccagatatccttgcttctttcttaactgataagtatgaaatactaatgatctacttgttttaatctgggaggaggaacagaaataaaagtagtcttttattggatttcttattgaactataatttttaaaatatttccattgtattaagtgcagttgaattaacttttattttgttgttatattttatatacttccagacacaa

SEQ ID NO: 149257 - DNA, 601 bp, Human
tttcatgtcatgacttgtagatttgttctctatctataataaaaatgtatgtatgctgtattttagaaaagataaaatacataccattttatctgtcagttttgttttgctttttttctgatacagggtctcactctgtcaccagggcttgagtgcagtggcacagtcatagctcactgcagtcttgacctcctgcctccatcctcccacctcagcctcctgaatagctgggactacgggcatgcatcatcacacctgactaatttcttttgctttttgtagagatgaggtctccctacaytgcccaggctggtcctgaactcctgggctcgagtaatctgcttacctcaacctcccaaagtgccgggattaaggcctgagctactgcatccggcctattttaaaaataaataaaaataaacctttggggaaaaaaagaaaagatagaaaatattcctctcaagcattttaacctatgattggggttcatcaaataatttcatttgaaaaggaataattctggcttcttaagttcaacagatggtatcttccagatatccttgcttctttcttaactgataagtatgaaatactaatgatc

SEQ ID NO: 149258 - DNA, 601 bp, Human
atgacctaacacaaatatgcccatatatcagcaattgacacaaacacaacttttgtactcagatacaaaatgactatatgttaatttagtgcccaatttgagagaatcaaacatgaaatatcaaatcaatgggaaaagagatctcagtagcctcaattaatgataggaaatattcaaatgagccataaaatagtactatttattacaaaattatcaaggaagaagattcaaaatagatcaaaacaaaccagccagcatttttttcacttggattaaggttgctccaacaacagatattgaytgagcatccaccagattctgtgttcttttcatgtcatgacttgtagatttgttctctatctataataaaaatgtatgtatgctgtattttagaaaagataaaatacataccattttatctgtcagttttgttttgctttttttctgatacagggtctcactctgtcaccagggcttgagtgcagtggcacagtcatagctcactgcagtcttgacctcctgcctccatcctcccacctcagcctcctgaatagctgggactacgggcatgcatcatcacacctgactaatttcttttgct

SEQ ID NO: 149259 - DNA, 601 bp, Human
aagaaggctgtgagagacggaagctacaaatcaaaagacaagacaaattagtcattaaggagcaaaggaaggcactctggacagaagaatcagcatatgcaaaggcttggaggcattgcaggttgtattccaagaactgcaggcagatccgtgtggctgcagcaaggctgtagggataaggagtggctgggtataaggctgtctgatgtgaccaagaatttgaacttgatcatgaagataatgaagagcaactaagggactttaagcatggagtggggtgcatggggctgagggagcgtcmtggaaacagagttgcctggacagaagcaggtgaagattcatgacaggctgtgtggagggggagatcatggaaagtgttatcacccacagccacctaggactgatattgctgaggtggagatatcatggcagagtgagaccaggcaagactgtagaaaagaatgcctgaaactgggtcagactgaagccaccaaaggcaatacatattaaaattggagatcagtgaggctggtagccaggagatttcaaagcaatgaaatgggaaacaaagcatgccatgatgggtcaggacgctccgaag

SEQ ID NO: 149260 - DNA, 601 bp, Human
tggaagtggtctgtggcctgttaggaactgggctgtacagcaggaggtgagcggcaggtgagtgagaattgccacctgagctccaccctcccatcagatcagcagcagcattagattctcataggagcacaaaccgtattgtgaactgcacatgcaagggatctagggtgcacgctccttacgagagtctaactaatgtctcatgatctgaggtggaacagtttcatcctggaaccatcccccgacgcccctgaataaactgccttccacaaaactggtccctggtgcaataaatgttggsaagcgttcttctggaaagaacatctgcagtggccaccacagatccactttctgagtcctgcagatacctgctgggcaaaaacaggcctttcagataccctctgctcctcctgccaaaaagacagtggtcagaaaaccctcctttgagcctcctgccttttgttttctttccctaactgtaaatacttctctttctcattctcctaccaggtgcaaaacactaccaccaaccccagacacccacacatcttccagaggaaagtgattctatttttttaagtcttaccctgccctaaaaacc

SEQ ID NO: 149261 - DNA, 601 bp, Human
gtagtaaaagtgagctcttgggaaaagtaataatgggatggcgcatcatctcagaatgcagagcacctggtgcttagctgtctagagtcacggtctcatcctcacccccacactttccccagctctttctaatctatcttctataacagcaccccagagagattattcttgtcaaaattatcaatgaccatcattacaatatttattatctcatttacttgatcttttagcagcttttaatgcagcagtatcagggtgtgtgtgtgtgtgtgtgtgtgtgtgtgtctgtctgtctgtctgyctgcctgcctgcctgtctgtcttcaccctcctggttttaccagaagtttctcctaagtctccttggccaatccatcctcctctgttcaacttctaaatattggcccacctcagagctgcattgtggatcaggttctctatctacacactttctagattaatctcatttgagtaccatcaatgtgccagtgattctctaatacgtatattcagcctcgacctctttatagatcccaaaacatatatatctatctaactgtctaacttgacacttcaccttggatgtccaataggcacctca

SEQ ID NO: 149262 - DNA, 601 bp, Human
ctcttctctaggtagtaaaagtgagctcttgggaaaagtaataatgggatggcgcatcatctcagaatgcagagcacctggtgcttagctgtctagagtcacggtctcatcctcacccccacactttccccagctctttctaatctatcttctataacagcaccccagagagattattcttgtcaaaattatcaatgaccatcattacaatatttattatctcatttacttgatcttttagcagcttttaatgcagcagtatcagggtgtgtgtgtgtgtgtgtgtgtgtgtgtgtctgtstgtctgtctgtctgcctgcctgcctgtctgtcttcaccctcctggttttaccagaagtttctcctaagtctccttggccaatccatcctcctctgttcaacttctaaatattggcccacctcagagctgcattgtggatcaggttctctatctacacactttctagattaatctcatttgagtaccatcaatgtgccagtgattctctaatacgtatattcagcctcgacctctttatagatcccaaaacatatatatctatctaactgtctaacttgacacttcaccttggatgtccaa

SEQ ID NO: 149263 - DNA, 601 bp, Human
gtaactcttctctaggtagtaaaagtgagctcttgggaaaagtaataatgggatggcgcatcatctcagaatgcagagcacctggtgcttagctgtctagagtcacggtctcatcctcacccccacactttccccagctctttctaatctatcttctataacagcaccccagagagattattcttgtcaaaattatcaatgaccatcattacaatatttattatctcatttacttgatcttttagcagcttttaatgcagcagtatcagggtgtgtgtgtgtgtgtgtgtgtgtgtgtgtstgtctgtctgtctgtctgcctgcctgcctgtctgtcttcaccctcctggttttaccagaagtttctcctaagtctccttggccaatccatcctcctctgttcaacttctaaatattggcccacctcagagctgcattgtggatcaggttctctatctacacactttctagattaatctcatttgagtaccatcaatgtgccagtgattctctaatacgtatattcagcctcgacctctttatagatcccaaaacatatatatctatctaactgtctaacttgacacttcaccttggatgt

SEQ ID NO: 149264 - DNA, 601 bp, Human
gtttgcagatgtgttttagaataagcattttaccagaaaagaagaatacaatcgataacaacaaataaaataaaattgaaagggcactggaatggaaaatgacaaccataaggatataaacagcaaagagacaaatcagcaaagctcaacgctgtgcacagtgacacaaagagaatataaatactttttttaaatggttgcctcaggtgtggagggaggatgtgtttatcagtgaaccaaaatgtttaagccattgccattaacagcacagagcaagaaatgaagatcagaaaggaattcrtaagaataaacagtgatcaaaaaaaggcagaacagctagaaaggcctttgtgataggcctactagaattttcatttttaccataaacattatataaaattaaaggcagaatattaatttttcgagaaaactattttaaatagtatttttgattataaattgtttatatgcattttagaaaacttggaaggtgaaaaaataaatatgtttaatctcatgacccagagacagccatcactaatattttgacaattctttccttccctccctcactccatctatctttctctctctctctctc

SEQ ID NO: 149265 - DNA, 601 bp, Human
ctattttatctaataatctttcgtattgctaaagctatgaagtcactcttaattaaatgtaaaatatatttttacacttgttgaggaccaattatatgcaaggcaggatgtgaacccaggagacagcctaagatatgaatgaaatgtggactgttctctcaagttgcttccagtccaatgaggagacagagataaacatacttccaataaggtgaatgatgaggaagggcaatagcagagtattatggaagctgaaaatatacagcccagtgaggaaggaatgaaggaaagaaggaaggawggaaacaggaagggaggaaaagagtgaagaaaaataggtatgtttgacattcatttctaccttctgaaattaccttgaaaaacaaccatcatagtcagatgctaaactcagtagactacagttatgacctatgcacatgactttttggatgacattttgtgtccaaatgttgcacttgcttactaagagactacaaaggcaggcctatagatacaaaaggaatacagtcttaatactcacattcaatgaaatgtttaactgtatccaagcggagctacgaatggtttgcagatgtgtttt

SEQ ID NO: 149266 - DNA, 601 bp, Human
atatatagaccaactgaacagcacagagttctcagaaataacatcgcacatctacaaccatctgatctttgacaaacctgacaaaaacaagcaatggggaaaggattccctatgtaataaatggcgttgggaaaactggctagccacatgcagaaaactggaactggacccctttcttacatcttatagaaaaattaacttaagatggatgaaagacttaaatgtaagacctaaaaccataaaaaccctagaagaaaacctaggcaataccattcaggacataggcatgggaaaagacttmatatgaataaaacaccaaaagcaatggcaacaaaagccgaaattgacaaatgggatctaattaaactgaagagcttctgcacagcaaaagaaactatcatcagagtgaacaggcaacctacagaatgggagaagatttttgcaatctattcatctgacagggctaatattcagaatctacaaggaacttaaaaaaatttacaagaaaaaaaacaaacaaacccatcaaaaagtgggcaaaggatatgagcagacacttctcaaaagaagacacttatgcagccaacaaacataagaaaaa

SEQ ID NO: 149267 - DNA, 601 bp, Human
gaacaaagctggaggcatcatgctacctgacttcaaactatactacaaggctacagtaaccaaaacagcatgatgctggtaccaaaacagatatatagaccaactgaacagcacagagttctcagaaataacatcgcacatctacaaccatctgatctttgacaaacctgacaaaaacaagcaatggggaaaggattccctatgtaataaatggcgttgggaaaactggctagccacatgcagaaaactggaactggacccctttcttacatcttatagaaaaattaacttaagatggatkaaagacttaaatgtaagacctaaaaccataaaaaccctagaagaaaacctaggcaataccattcaggacataggcatgggaaaagacttcatatgaataaaacaccaaaagcaatggcaacaaaagccgaaattgacaaatgggatctaattaaactgaagagcttctgcacagcaaaagaaactatcatcagagtgaacaggcaacctacagaatgggagaagatttttgcaatctattcatctgacagggctaatattcagaatctacaaggaacttaaaaaaatttacaagaaaaaa

SEQ ID NO: 149268 - DNA, 601 bp, Human
aaaacattccattcttgtggataggaagaattgatattgtgaaaatggccatactgcccaaagtaaggtatagattcaatgctatccccatcaagctaccattgactttcttcacaaaattggaaaaaactactttaaagttcatatgggaccaaaaaagagcccatatagccaagacaattctaagcaaaaggaacaaagctggaggcatcatgctacctgacttcaaactatactacaaggctacagtaaccaaaacagcatgatgctggtaccaaaacagatatatagaccaactgarcagcacagagttctcagaaataacatcgcacatctacaaccatctgatctttgacaaacctgacaaaaacaagcaatggggaaaggattccctatgtaataaatggcgttgggaaaactggctagccacatgcagaaaactggaactggacccctttcttacatcttatagaaaaattaacttaagatggatgaaagacttaaatgtaagacctaaaaccataaaaaccctagaagaaaacctaggcaataccattcaggacataggcatgggaaaagacttcatatgaataaaacacca

SEQ ID NO: 149269 - DNA, 601 bp, Human
cactcctatttaacatagtattagaagttctggccagggcaatcaggcaagagaaagaaagggtattcaaatagaaataggaagagaggaagtcaaattgtctgtctttgtggatgacatgattgtatatctagaaaactccaagatctcagcccaaaatctccttaagctgataagtaacttcagcaaagtctcaggatacaaaatcagtgtgcaaaaatcacaagcattcctatacaccagtaatagacaaacagagagccaaatcatgagtgaactcccattcacaattgctacaaaragaataaaatacctaggaatacaacttacaagagatgtgaaggccctcttcaaggggaaggacaaaccactgcccaagcaaataagagaggacacaaacaaatggaaaaacattccattcttgtggataggaagaattgatattgtgaaaatggccatactgcccaaagtaaggtatagattcaatgctatccccatcaagctaccattgactttcttcacaaaattggaaaaaactactttaaagttcatatgggaccaaaaaagagcccatatagccaagacaattctaagcaaaagg

SEQ ID NO: 149270 - DNA, 601 bp, Human
cagaagagtgggggccaatattcaacattcttaaagaaaagaattttcaacccagattttcatatccaggcaaactaagcttcataagcgaaggagaaataaaatcctttacaggcgagtaaatcctgagagacttttgtcaccaccaagcctgccttacaagaggtcctgaaggaagcactaaatatgggaaagaaaaaccagtaccagccactgaaaaacataccaaattgtaaagaccatcgacactaagaagaaactaacgggcaaaataaccagctagcatcataatgacaggatmaaattcacacataacaatattaaccttaaatgtaaacgggctaaacgccccaattaaaagacacagactgccaattggataaagagtcaagacccatcggtgtgctgtattcaggagactcatctcatgtgcaaagacacacataggctcaaaataaagggatggaggaatatttaccaagcaaatggaaagaaaaaaagaaaaaaaaaaaccaggggttgcaatcctagtctctgataaaatagactttaagccaacaaagaacaaaaaagacaaagaaggccattacataattgtaaa

SEQ ID NO: 149271 - DNA, 601 bp, Human
agctgaaatgatcaagtggaagaaaggatatcagagattgaaggtcaacttactgaaataaagcgtgaagacaagattagagaaaaaataatgaaaaggaacaaagcctccagaaaatatgggactatgtgaaaagaccaaacctacaactgattggagtccctaaaagtgatagggagaatgaaaccaagttagaaaacactcttcaggatgttatccagcagaacctccccaaactagcaaggcaagccaacattcaaattcaggaaatacagagaacaccacaaagatgatcctcaaraagagtaaccccaagacacataattgtcagattcaccaaggttgaaatgaaggaaaaaatgttaagggcagccagagagaaaggtggggtgatccacaacgggaagtccatcagaccagcagtgaatctctctgcagaaaccctacaagccagaagagtgggggccaatattcaacattcttaaagaaaagaattttcaacccagattttcatatccaggcaaactaagcttcataagcgaaggagaaataaaatcctttacaggcgagtaaatcctgagagacttttgtcaccaccaag

SEQ ID NO: 149272 - DNA, 601 bp, Human
tagatagaataagactgataagacttatccagtttcttttttgagacagagtctcgctgtgtcacccacactacagtgaggtggcatgatctctgctcactgcaacctccgcctcccagattccagcagttctcatgcctcagcctcccgattatctggaattacaggtgcctgtcaccacacctggttaattttttgtattttcagtagagaccaggtttcaccgtgttggccaggctggtctcgaacactcctgactttaggtgatccagaccacctcagcctcccagaatgctgggaytacaggcatgagctaccacacccagctccaataagacctatctgacagggttgttttcataattaaacgaaagaaataaaaatccttagtccagtgcctggcactcagtagttacttaatcaatggtagctattgtttaatgcagatcaccattgtgggctgttgcagagttggtcttactataatgaaactaatgggctttcaacgaatttctccacacttttagttttccatatttataatatagctgcttaggatgtaaacgtcagcagaccatagagaatggctgtaacctgactt

SEQ ID NO: 149273 - DNA, 601 bp, Human
acttcctttgtgtatttatagataggtagatagataagtaggtagatagaataagactgataagacttatccagtttcttttttgagacagagtctcgctgtgtcacccacactacagtgaggtggcatgatctctgctcactgcaacctccgcctcccagattccagcagttctcatgcctcagcctcccgattatctggaattacaggtgcctgtcaccacacctggttaattttttgtattttcagtagagaccaggtttcaccgtgttggccaggctggtctcgaacactcctgacyttaggtgatccagaccacctcagcctcccagaatgctgggattacaggcatgagctaccacacccagctccaataagacctatctgacagggttgttttcataattaaacgaaagaaataaaaatccttagtccagtgcctggcactcagtagttacttaatcaatggtagctattgtttaatgcagatcaccattgtgggctgttgcagagttggtcttactataatgaaactaatgggctttcaacgaatttctccacacttttagttttccatatttataatatagctgcttaggat

SEQ ID NO: 149274 - DNA, 601 bp, Human
ttttttatgcaatactctctcctcagatcacttgtctgcctttaagttggatagacagcatttaagtcccatttcctctaattaacatggtacagccttgagcaaataatttcacctcatgagctcacttcctttgtgtatttatagataggtagatagataagtaggtagatagaataagactgataagacttatccagtttcttttttgagacagagtctcgctgtgtcacccacactacagtgaggtggcatgatctctgctcactgcaacctccgcctcccagattccagcagttcycatgcctcagcctcccgattatctggaattacaggtgcctgtcaccacacctggttaattttttgtattttcagtagagaccaggtttcaccgtgttggccaggctggtctcgaacactcctgactttaggtgatccagaccacctcagcctcccagaatgctgggattacaggcatgagctaccacacccagctccaataagacctatctgacagggttgttttcataattaaacgaaagaaataaaaatccttagtccagtgcctggcactcagtagttacttaatcaatggtagcta

SEQ ID NO: 149275 - DNA, 601 bp, Human
ctaaaacttaatctgcttctcaagaatggataaataacttggccaatttgcacaagatacttacatatagacatatacacacacacaggcacatacaacttccttcttcaaggccctctgactaaaattacaacacagatcatttagatgacaggaaaacagtccaaagacattaactagctaatggccttagagagagtgtatttaagtatcttttctagctaagacaagtagtataccatgactatatttcctttcttaattaggattttttttttcctttctgggttaataattggcttttttttttatgcaatactctctcctcagatcacttgtctgcctttaagttggatagacagcatttaagtcccatttcctctaattaacatggtacagccttgagcaaataatttcacctcatgagctcacttcctttgtgtatttatagataggtagatagataagtaggtagatagaataagactgataagacttatccagtttcttttttgagacagagtctcgctgtgtcacccacactacagtgaggtggcatgatctctgctcactgcaacctccgcctcccagattccagcag

SEQ ID NO: 149276 - DNA, 601 bp, Human
gcagaaagggaagccaagaagcaagcctttgcgtgcttaaaaacctaaagaaggcttggggatggaggcaccatctgcctctgaaataagggggatagataactgtggctaaaaataggtagattggctcagagtctttaaaagaagcaaatagatcccctgagatcacctcccttgagaaatatgggaggtttattatctggagatgttgaaccttagggaaacgactcaagtatagctcagaacaaggggactatactgaaacagagaataaatctcttgatccatgcctctttctcayagtcagatcccaaaatgttgacagctaggttcttatcaacaaggcaaaagactgaaagattcctctcaaaggatatagaccccaaaagagcaatacttacagatactgaaacttggaggaggcctgccaatgaaatggccaaaacgaatcaccctacaggacacctcccctacctatgcacacagtgtgtccttaatacctcactctcaaatctaaccagacagccaagaaacgactctgacatggatacagagatcaaaacatagagacaaagaaaacaaaaaagaacctcagaagaaa

SEQ ID NO: 149277 - DNA, 601 bp, Human
gaaactgaaaagagccctgggccacgggctgtgccatcctattactcatgctgttccttataccttcatccaggatgcccttccttccccatgggtagaaccaccttctccagaaagccttcctgctccctcaggtggccgtcactcctcacctgtgccctcctaatacttgctaagatacctctagtacattctaaccacactgtgcagttattctctatttatgtgcaaaaaaaatagtgaacataaattgctattgagtagatacccccaaaatatttggaatgattatagaataacrgggaaatatcagccctggcactatggaggtcttctggaagtttcttgaagtaagggctttttgttattcatctttgttcccaacaccactgactctggatattcgtcttaaataagacacaaatgtgcctcccacagataaaagtcagcctcatatgtgccttcaggaaggcactgatgataaggctcacacttatccagagcttgccaggtacccagtgctatggcctaagcacgtcatatgcataatcatatttacactaacctcacaacaattatttaagaaaaacacgatgatgat

SEQ ID NO: 149278 - DNA, 601 bp, Human
aacattagttaaaaggcttataaacctttaaaatatcctgagtctggaacaaaatttattattacaacgacactacaattcagggcaaaaaaataaaaatgctgctatgacagatctgtaatgaataaatgaaaagcaatgtgctttttggtgtaatctcctttgaagcagacattaaattattaaagatgtttccagtgtacacatcaatcaaatcatccccagaaggaacaccgggttttacacccatccatacacatcacacacacacacacacacacacacacacacacacacacayatacacacagataaaatctataccatggtgacagtctgcaaagaaggaaaagggcactccctctatgtaactattctttaggataaaaaagaaatacaagaggcaaaggaggaacaagttgcacccttcctccatccccttcactcctctctcactgtgctgtagcaaaactactgaagaggaatctggtaccactcacacaaactcagagctatcaccagccctgggaacttgtagtccattaagactgttgggtctgattcatatggactaatcatcctcactctcagttatgtttat

SEQ ID NO: 149279 - DNA, 601 bp, Human
ttcaactttaagaaatgcaagattatcgtgttgaaatgccaatttgatcaatttaaataagacggtaacattagttaaaaggcttataaacctttaaaatatcctgagtctggaacaaaatttattattacaacgacactacaattcagggcaaaaaaataaaaatgctgctatgacagatctgtaatgaataaatgaaaagcaatgtgctttttggtgtaatctcctttgaagcagacattaaattattaaagatgtttccagtgtacacatcaatcaaatcatccccagaaggaacacygggttttacacccatccatacacatcacacacacacacacacacacacacacacacacacacacacatacacacagataaaatctataccatggtgacagtctgcaaagaaggaaaagggcactccctctatgtaactattctttaggataaaaaagaaatacaagaggcaaaggaggaacaagttgcacccttcctccatccccttcactcctctctcactgtgctgtagcaaaactactgaagaggaatctggtaccactcacacaaactcagagctatcaccagccctgggaacttg

SEQ ID NO: 149280 - DNA, 601 bp, Human
atttttttctccttttaatgcaaacggctggtatataccctaatttctttctaggaaagaagacaactggccctaaattcaggccctgtctcatagtcattattaccaccagtactaacaagcagtattatgctttcatcccattatttctattagactttcccggcacagctattttagtagtcatcaaatgaagccacatctggttagttcaactttaagaaatgcaagattatcgtgttgaaatgccaatttgatcaatttaaataagacggtaacattagttaaaaggcttataaayctttaaaatatcctgagtctggaacaaaatttattattacaacgacactacaattcagggcaaaaaaataaaaatgctgctatgacagatctgtaatgaataaatgaaaagcaatgtgctttttggtgtaatctcctttgaagcagacattaaattattaaagatgtttccagtgtacacatcaatcaaatcatccccagaaggaacaccgggttttacacccatccatacacatcacacacacacacacacacacacacacacacacacacacacatacacacagataaaatctatacc

SEQ ID NO: 149281 - DNA, 601 bp, Human
tacctgaagcagtatataacaaaactcccaaaatactgcagtactaatggccaataggaacagatttctttttaaattacctctgaaaattggataattatacatcactctcctagaaatggttttgatccttactgtgcctaaacttgccctattattcagaacaactttgttttagttttaaagagaagttgtgtagcatttaataaaataacaaaaaactcataatttactgtaactttttaggattctggatatggtcctcgcctctctgagaacatattaccagtgcttgctgaaktatgttaagacaatcacacctaaataagaaaatgtctattttcctcttctgacatctggatttatacctaaaaattgcaaaataataacatattagtatttagttttgtatttctcagccttacctctttctttatccagaattcccaaacacttatacatttttttctccttttaatgcaaacggctggtatataccctaatttctttctaggaaagaagacaactggccctaaattcaggccctgtctcatagtcattattaccaccagtactaacaagcagtattatgctttcatcc

SEQ ID NO: 149282 - DNA, 601 bp, Human
aattagccgggcttggtggtgcatgtctgtaatcccagccactcaggaggctgaggcagaattgcttgaacccaggagatggaggttgcagtgagctgagattgcaccactgcactccagcctgggccacagagagagactctgtctcaaaaaataaaaataaaaaaaaaaagaattactgacctgaaaacaaaatattttgggaatttctatcactgacttttggtgtgatctaggaaggaaacattattataagaattgtctagcagagtacctgaagcagtatataacaaaactcccraaatactgcagtactaatggccaataggaacagatttctttttaaattacctctgaaaattggataattatacatcactctcctagaaatggttttgatccttactgtgcctaaacttgccctattattcagaacaactttgttttagttttaaagagaagttgtgtagcatttaataaaataacaaaaaactcataatttactgtaactttttaggattctggatatggtcctcgcctctctgagaacatattaccagtgcttgctgaattatgttaagacaatcacacctaaataaga

SEQ ID NO: 149283 - DNA, 601 bp, Human
atgaatgtgtttcataccactgaactgtatgtacacttaaaactggttaagatggtaaatatgccattatgagtatattaccacaaaaagaaataaaatggagcagaggaaatgtactgagccaaagattacattctgcatcgctgaagagcaaggatttctagggagttcaggaaaggagcccacaccaggaagtcgagagttttcctttaccaagacactaaggcagagaggggacttccaagggggaagaaggtataataaaccagctcagagaaaacatggcggatggttccccacraacaagtcagaagaagccaggaaaagccctgtggacccttggcccagagacaagtttccttccatggactctgcagaataacatacatggtcattgtgggaccctgagagacacataagggactctcacgccttatgacttcagtgattgggccaagggcacccatctgtgttaagcagtactgagagttcccggcattcggagataaataccactgtctccgagatcaaagagcgcagagcagagcacaataggcaggaaagatgcgtaaacaaatcacattacaatgtggaatgaggc

SEQ ID NO: 149284 - DNA, 601 bp, Human
aggcaacccatagaatgggaggcaatatttgcaaatcatttatctgataaaggcttgatatctagaatatatagggaacacctaaaactcaacaacaaaaagtctcattcaaaaatgtgcgaagtacttgaatagacatttctgcaaagaagatatacaaatggccaataatcacatgaaaagattgtcaacttactaataattagggaaatacaaattaaaactgcaataagatactacctaacacccattataatgacaagaaaaaaaaaaaaaaaaaaaaaacagaagaaaacaagcrttgacaaggatgtggagaaactggaactcctgggcattttgggggatgcaaaatgctacagccacctgaaaaacagtatggtcattcctcaaaaagttcaaaatagaattaccatatgatctagcaactccaccctctgggtaaatacccaaaagaactgaaagcaaggacttgaagagatatttgtacacccaagtttataggagaattattcacaatagcttaaaatgtggaagcaacccaagtgttcatcaaaagatgagtggataatcaaaatgcagtatatccatacaatggagt

SEQ ID NO: 149285 - DNA, 601 bp, Human
aattttaaaattttgtacatcaaaagacaataccaacagagtaaaaaggcaacccatagaatgggaggcaatatttgcaaatcatttatctgataaaggcttgatatctagaatatatagggaacacctaaaactcaacaacaaaaagtctcattcaaaaatgtgcgaagtacttgaatagacatttctgcaaagaagatatacaaatggccaataatcacatgaaaagattgtcaacttactaataattagggaaatacaaattaaaactgcaataagatactacctaacacccattatratgacaagaaaaaaaaaaaaaaaaaaaaaacagaagaaaacaagcgttgacaaggatgtggagaaactggaactcctgggcattttgggggatgcaaaatgctacagccacctgaaaaacagtatggtcattcctcaaaaagttcaaaatagaattaccatatgatctagcaactccaccctctgggtaaatacccaaaagaactgaaagcaaggacttgaagagatatttgtacacccaagtttataggagaattattcacaatagcttaaaatgtggaagcaacccaagtgttcatca

SEQ ID NO: 149286 - DNA, 601 bp, Human
tgaaagtgagaaaagtctccaatctctaacaaagagaataacatttccaatctgccccaccagacccatctcaccctctcctcaaagagaacaagctaagtaaggcactgagatacagacacttgaggtgataaggagaggagggcttggcaagggaaagatgggtgttgtcattataaaaacagaacggaggagaatacatcacacatgaaaatgagttgcatttctatacactaacaatgaacaatctggaaggagattacagaaacaatttcatttacaatagcatcaaaaggaatamaacacttaggagttagccagtgaggtgaaagacttgtgcaatgaaaaatacaaaacattgccaaaagaaaatttaaaagacataaataaatggaaatatgtcccatgttaatgtattagaatacttaatatcattaagaggtcaatattatccaaagtgatctacagattcaatgcaatccctgttgttttttacggaaatagaaaaacccatcctataagtcatatggaatctcaagggaccctgagtggccaaaacaactttgaaaaaggacaaagatggagaattcccacttcttta

SEQ ID NO: 149287 - DNA, 601 bp, Human
tgtgatccacctgcctcagcctcccaaagtgctgggattacaggcatgagccaccatgcccagcccagggtttttttcaatgatagggtagaatgatttatttggtgttaagatctcattattgcctctttctagctacctgacattggacaggtcacttaattctccttccctgtaaaatgagagtttggaacccagttagccctgacccccctttccaactctagaagcccatctcttctaactgaccaaacaactgaccaaactttttgtcattacaaaagttaacataatgctttcrgttttggaagtaaggaaggaaatgaaggggacaagactaaaagttcagaaaaaaattccacacattatttttaagaagaaagagttggaactagtaataattcttatcttctgtcaaaaataaagtctcagatttaattacatgataccaaatgtgtattttttaaatgaaggaaaaaactagttgttcttagatactgaaaaaaccacaatgtttgtcattatgcagattaaaagacaccgtgagcctaggctgttcaaattttattcggatgcttaaggtcaaatagcggagagtcct

SEQ ID NO: 149288 - DNA, 601 bp, Human
gatagaaagccaaaccgcaaggtccttggccactgtctagtgaagcacctggcccagaggaagaggtttaaaaaaaaaaagtctttgtggaaagattgtcatcctcaaggctaaggatgagggcaatggcaccaggctgtgaattcatgttttctgacgtggaatgtagacagctttccccacaatgcctaaggaagctgacagcttctctctaaacacaataactgattttcctgcagatctaaggtcaagaaactatatgtcctctctgtaagaataataaatgctgagggccaggcayagtggtcacacttgtaatcctagcactttgggaggccgaggcgggcagatcatgaggtcaggagatcgagaccatcctggctaacatggtgaaaccccatctctactaaaaatacaaaaaaattagctgggcatggtggtgcacacctgtagtcccagctactcgggaggctgaggcaggagaatggcgtgaacccaggaggcagagcttgcagtgagccgagatcgcgccactgcactccagcctgggtgacagagcaagacaccatctcaaaaaaaaaaaaaaaaaaaaaaagaataa

SEQ ID NO: 149289 - DNA, 601 bp, Human
actgtgatccagaatctcctcgacttgctcaggggcatctgtagcctccctacctccttcctcttcaaggtcaccattcattcctgaaaagtcttctttctgttctgcatccttgtttgccttctctccatcttcttcctcgtctactatttctgctggcctctgatggatcaaaaggaataatggataaaagtaagaagcataacagaacatttccactgcacatcatagtaatgtaatacttatattacagtcaagtaaaacattcttacatttgcatagtactttacagtatagaatrcacttacgtttactgagtacctaccacatgccacatgttacaagcattccctcatttaatcctcacaacaatcctttgaaattgttatcattcccattttgcagatgagaaaactaaacaggtggagcccaagatcccacagaaagagccagagtttgaactaggcctgtgactccagaaccagtgcttgtaacccccatggcagatagaaagccaaaccgcaaggtccttggccactgtctagtgaagcacctggcccagaggaagaggtttaaaaaaaaaaagtctttgtggaaagat

SEQ ID NO: 149290 - DNA, 601 bp, Human
cactgtgatccagaatctcctcgacttgctcaggggcatctgtagcctccctacctccttcctcttcaaggtcaccattcattcctgaaaagtcttctttctgttctgcatccttgtttgccttctctccatcttcttcctcgtctactatttctgctggcctctgatggatcaaaaggaataatggataaaagtaagaagcataacagaacatttccactgcacatcatagtaatgtaatacttatattacagtcaagtaaaacattcttacatttgcatagtactttacagtatagaayacacttacgtttactgagtacctaccacatgccacatgttacaagcattccctcatttaatcctcacaacaatcctttgaaattgttatcattcccattttgcagatgagaaaactaaacaggtggagcccaagatcccacagaaagagccagagtttgaactaggcctgtgactccagaaccagtgcttgtaacccccatggcagatagaaagccaaaccgcaaggtccttggccactgtctagtgaagcacctggcccagaggaagaggtttaaaaaaaaaaagtctttgtggaaaga

SEQ ID NO: 149291 - DNA, 601 bp, Human; identical to SEQ ID NO: 38285

SEQ ID NO: 149292 - DNA, 601 bp, Human; identical to SEQ ID NO: 38286

SEQ ID NO: 149293 - DNA, 601 bp, Human; identical to SEQ ID NO: 38287

SEQ ID NO: 149294 - DNA, 601 bp, Human; identical to SEQ ID NO: 38288

SEQ ID NO: 149295 - DNA, 601 bp, Human; identical to SEQ ID NO: 38289

SEQ ID NO: 149296 - DNA, 601 bp, Human; identical to SEQ ID NO: 38290

SEQ ID NO: 149297 - DNA, 601 bp, Human; identical to SEQ ID NO: 38291

SEQ ID NO: 149298 - DNA, 601 bp, Human; identical to SEQ ID NO: 38292

SEQ ID NO: 149299 - DNA, 601 bp, Human
tgttacattatctctctgtttacacttctgatctgtggaaaataccaaaatcatattaagaaaaaacacatctattttctatagtattattaagtgctttatataactgccaactctttattccaaatgaaacctggaagagaaaaaatgttttaaacttgtaattgtgaattttagaaaagcactagaagttaaaatttcaagcttacaacttccacataattaaaaatatatcctttaagaaaaatatattatttctatatttatggaagaacatctcttaagaattcataaaaaggaygaaattatgttttaattatgtttttatgttttccccatacatacctcacaaggcaactataaatcaatttagtcagtccatgaagttgtgattcaggaattggtttcattataataacttctaaagttttacaatttctatcagatgccttctaattacaaagaaatctgcttgaaattctaactatatcatgctaggaaaaataaatatttgctgatatccctagggcaaaaacatagtaaaacagtcttaatagaaataaggcaaaaaacaagttaaattgagcagtcacaaactctt

SEQ ID NO: 149300 - DNA, 601 bp, Human
tgttgcttatagcccacagtgctttatatcatcccatttgaaaaagtaacgctagtagaaagcacaatttagattttacaccagaaacatagtaccctgtttctaattcatgctcccagatcactatatccttgtgtcattatctcttccaaatactgttacattatctctctgtttacacttctgatctgtggaaaataccaaaatcatattaagaaaaaacacatctattttctatagtattattaagtgctttatataactgccaactctttattccaaatgaaacctggaagagaaraaatgttttaaacttgtaattgtgaattttagaaaagcactagaagttaaaatttcaagcttacaacttccacataattaaaaatatatcctttaagaaaaatatattatttctatatttatggaagaacatctcttaagaattcataaaaaggacgaaattatgttttaattatgtttttatgttttccccatacatacctcacaaggcaactataaatcaatttagtcagtccatgaagttgtgattcaggaattggtttcattataataacttctaaagttttacaatttctatcag

SEQ ID NO: 149301 - DNA, 601 bp, Human
cccagcattttgggatgcaaaggcgggcggatcacctgaggtcaggagtttgagaccagcctggccaacatggtgaaacatctgtctctacaaaaaatacaaaaattagccaggtgtggtggcagatgcctgtaatcccagctactcgggaggctcaggtgcttgaacccaggaggcagaggttgcagtaagccaagatcatgccactgcacccagcctgggcaacaagagcaagacttcatctcaaaaaataataataataataataataataataataaagatcaattggtctatttgyctagcaacccaagattgttgcttatagcccacagtgctttatatcatcccatttgaaaaagtaacgctagtagaaagcacaatttagattttacaccagaaacatagtaccctgtttctaattcatgctcccagatcactatatccttgtgtcattatctcttccaaatactgttacattatctctctgtttacacttctgatctgtggaaaataccaaaatcatattaagaaaaaacacatctattttctatagtattattaagtgctttatataactgccaactctttattccaaatg

SEQ ID NO: 149302 - DNA, 601 bp, Human
ttaatattaaaagaccaactgggaccgggtgctgtggctcacacctgtaatcccagcattttgggatgcaaaggcgggcggatcacctgaggtcaggagtttgagaccagcctggccaacatggtgaaacatctgtctctacaaaaaatacaaaaattagccaggtgtggtggcagatgcctgtaatcccagctactcgggaggctcaggtgcttgaacccaggaggcagaggttgcagtaagccaagatcatgccactgcacccagcctgggcaacaagagcaagacttcatctcaaaatataataataataataataataataataataaagatcaattggtctatttgcctagcaacccaagattgttgcttatagcccacagtgctttatatcatcccatttgaaaaagtaacgctagtagaaagcacaatttagattttacaccagaaacatagtaccctgtttctaattcatgctcccagatcactatatccttgtgtcattatctcttccaaatactgttacattatctctctgtttacacttctgatctgtggaaaataccaaaatcatattaagaaaaaacacatctatttt

SEQ ID NO: 149303 - DNA, 601 bp, Human
tccagacccagtaatagtgcacaaatttaatattaaaagaccaactgggaccgggtgctgtggctcacacctgtaatcccagcattttgggatgcaaaggcgggcggatcacctgaggtcaggagtttgagaccagcctggccaacatggtgaaacatctgtctctacaaaaaatacaaaaattagccaggtgtggtggcagatgcctgtaatcccagctactcgggaggctcaggtgcttgaacccaggaggcagaggttgcagtaagccaagatcatgccactgcacccagcctgggcracaagagcaagacttcatctcaaaaaataataataataataataataataataataaagatcaattggtctatttgcctagcaacccaagattgttgcttatagcccacagtgctttatatcatcccatttgaaaaagtaacgctagtagaaagcacaatttagattttacaccagaaacatagtaccctgtttctaattcatgctcccagatcactatatccttgtgtcattatctcttccaaatactgttacattatctctctgtttacacttctgatctgtggaaaataccaaaatc

SEQ ID NO: 149304 - DNA, 601 bp, Human
taaaatatcaatgttgtgcttcattaaaatgacgcttaaggtgtttcctaaaacctaagtttcataatataatgaataaaaggacaggaaaaaaagaaatatttttattagaggaggaaaagagaaagagaaactctccattgaagaaacaaaagagaatcaccttgataattagttataatttcttacatttaatcagttatttttagaaactatttgaaatcattaactccagacccagtaatagtgcacaaatttaatattaaaagaccaactgggaccgggtgctgtggctcacacmtgtaatcccagcattttgggatgcaaaggcgggcggatcacctgaggtcaggagtttgagaccagcctggccaacatggtgaaacatctgtctctacaaaaaatacaaaaattagccaggtgtggtggcagatgcctgtaatcccagctactcgggaggctcaggtgcttgaacccaggaggcagaggttgcagtaagccaagatcatgccactgcacccagcctgggcaacaagagcaagacttcatctcaaaaaataataataataataataataataataataaagatcaattggtc

SEQ ID NO: 149305 - DNA, 601 bp, Human
gaagtatatttaaaataccaaacgttattattcatgtaaaatatcaatgttgtgcttcattaaaatgacgcttaaggtgtttcctaaaacctaagtttcataatataatgaataaaaggacaggaaaaaaagaaatatttttattagaggaggaaaagagaaagagaaactctccattgaagaaacaaaagagaatcaccttgataattagttataatttcttacatttaatcagttatttttagaaactatttgaaatcattaactccagacccagtaatagtgcacaaatttaatattraaagaccaactgggaccgggtgctgtggctcacacctgtaatcccagcattttgggatgcaaaggcgggcggatcacctgaggtcaggagtttgagaccagcctggccaacatggtgaaacatctgtctctacaaaaaatacaaaaattagccaggtgtggtggcagatgcctgtaatcccagctactcgggaggctcaggtgcttgaacccaggaggcagaggttgcagtaagccaagatcatgccactgcacccagcctgggcaacaagagcaagacttcatctcaaaaaataataat

SEQ ID NO: 149306 - DNA, 601 bp, Human
tcctacaggatgttatgcctcttcaaaaaacagtatctttttccttatcaacataagggaacactcttgtattccccattcatgtcactcaaacttcatgggaggaaatatacaaatttcatgtagggagaacaaaaatcagtcccatctaaatgtcccgatatgttttaaagaggaaaaatcttgtggtatttacaaaaatgatatttaatgacaaagaactgtatgtgttcatcatcttagagtaacagactaaccttttaaaaatggtttcattcctgaagaatgccaaaatgcttcygcactgaacctgaacattatataaactaatggaccaataagtcagtctttcattctatttgtgataccccggctaactggtatgaaaaagagtcctgacacatctatgtaaatcacacatgcacacacatggtcacaaacagtaataacagaatctgtattggtataaaagaatctacacctgaaatgtatcgtgcttaaggttgatggaaaagaaccatgctctgtagttacttcaggaaaacaagatatgtcttggtttctgttttggtttatgtgatatatcacattttaaaaaccg

SEQ ID NO: 149307 - DNA, 601 bp, Human; identical to SEQ ID NO: 27511

SEQ ID NO: 149308 - DNA, 601 bp, Human; identical to SEQ ID NO: 27512

SEQ ID NO: 149309 - DNA, 601 bp, Human; identical to SEQ ID NO: 27513

SEQ ID NO: 149310 - DNA, 601 bp, Human; identical to SEQ ID NO: 27514

SEQ ID NO: 149311 - DNA, 601 bp, Human; identical to SEQ ID NO: 27515

SEQ ID NO: 149312 - DNA, 601 bp, Human; identical to SEQ ID NO: 27516

SEQ ID NO: 149313 - DNA, 601 bp, Human; identical to SEQ ID NO: 27517

SEQ ID NO: 149314 - DNA, 601 bp, Human; identical to SEQ ID NO: 27518

SEQ ID NO: 149315 - DNA, 601 bp, Human; identical to SEQ ID NO: 27519

SEQ ID NO: 149316 - DNA, 601 bp, Human; identical to SEQ ID NO: 27520

SEQ ID NO: 149317 - DNA, 601 bp, Human
tgtgccaaatatatattaagatatttatgaagcacctactagattcgtaaccctctttcttaaatgatgaagcatttcatacttagctttatagaagtctttataaaatttgacgctaaaacaagcatgaattgtaaataactcaagacaaacatacatactaaacacccacacatatcatataataccagagttcactatatctttattccttctaattcagtggagatgattccctccttgtctcgccccagggacatttgacaatgtctgaagaacatttttggttgtcacaaggggrgcttgggaatatcacccacaattaagaatcatctggtccaaaatgtcaagttgacattatccaagtccctaaataaggcaaggttgattacccaatctatagagcaagttccaacctttgaacgaaaacatcaaagttaaaatacagtctaccaaaacatcattaacaataatagaaacccatctcctgtacccactctccatgatctacctgactgaagaggttaaccctcttatttaactgcttcagcagttctcttcttcatgaagtttcactttggaaactaagagtctcaacttt

SEQ ID NO: 149318 - DNA, 601 bp, Human
agcaatcgggcttggcatgatctgcagtttcaggcatacactgggggtcttgaaatgtactccgttcaggtaagaggtgactactgtgaagagaaagcactaaaaaaggtttcttatatatttattataacctcaaatacaaaaatgaggagacatacctcacctctcatggagtcaagactaaatgagatgcaagatgtgaaagcacatggtatatacactttgaatagtttcttccttgcagttgctaataaatgcttactgagtggtacttcctggaagaccagaggacgtgtctcattttttttttctcccacttagtaaaatgctcaggtatagaataagataatcattttgaatgagtgagaataatgaacctaccaccaaacatattagtcacacaacaatgcccagcttcatgggttctctatagcatgggttcaacctacattaccttagtttcatctctcattgctctacttctgggcacacaactctaaccacgagttagtcaaaggcaccctgccttccctgttccttatctttgttcacacgtacaactttcctctccattcccaaggtcaacttgaattggtagtac

SEQ ID NO: 149319 - DNA, 601 bp, Human
ttaaaattgcatgctgttctgagtagtgtgatgaaatctcatgtcatcctgctcactcctgcccgggatgtgaatcatccctttgtccagcatatccacactgtagatgctcccagaaccttggcccattagtcactagcagccatcttggttatcctatcaactgttgcagtatcattgtgcttgtgcccaagtacccttatgtgacttaataatggccccaaagcccagaagtagtaatgttggcaattcaaacatgccaaagagaagccataaagtgggttcttttaagtgaaagctytttactcaaggaaagaaaaaaatcatatgttgaggtttctaagatctatagtaagaacaaatcttctatatgtgaaattgtgaagggaaaagaactttgtgctggctctgctgtcaaacctcaaactgcgaaagttatggccacagtgcaggataagtgcttagttatgatgaaaaaggcataatttgagggtgggaaacgtgaacagaaacatgtcccaaatgacagcaatcgggcttggcatgatctgcagtttcaggcatacactgggggtcttgaaatgtactccgttcaggtaag

SEQ ID NO: 149320 - DNA, 601 bp, Human
tgtggacccagctactagggtggctgtgccacgagaattgctgaacctgggaggtggaggtggcagtgagtatcgatcgtgccactgtaccccagcctgggcaacaaagcaagactctgtctcaaaaaagaagaaagaataatacggcagtctccctttatctatggtttctctttctgcatgtggtttcaactacctgttgtcaaccatagtctgaaaatattaaatggaaaattccagaagtaaacaactcataaatttaaaattgcatgctgttctgagtagtgtgatgaaatctcaygtcatcctgctcactcctgcccgggatgtgaatcatccctttgtccagcatatccacactgtagatgctcccagaaccttggcccattagtcactagcagccatcttggttatcctatcaactgttgcagtatcattgtgcttgtgcccaagtacccttatgtgacttaataatggccccaaagcccagaagtagtaatgttggcaattcaaacatgccaaagagaagccataaagtgggttcttttaagtgaaagctctttactcaaggaaagaaaaaaatcatatgttgaggtttcta

SEQ ID NO: 149321 - DNA, 601 bp, Human
catacaggctacactgcctgctgattcctagattttgaattattggagctatatacagtaaaggcaggaaccagacaaagcaatcaacaggacaattcctccaattatcaagtttttaatagcttttagttttaagttctgataagcacaagtggatttatactcattaactttcttaaagctattgcttaaaatcaaattttgatctaaatcaggaattctagagagaactctgaagatagaagtacataaacaagaagctttagaaagaataggaagccatgcacggtggctcaacccygtaatcccagcactttgggaggccaggagttcgagaccagcctggcaacatcgtgaaaccccgtctctacaaaaaattagtcaggcgtggtggcatgcacctgtggacccagctactagggtggctgtgccacgagaattgctgaacctgggaggtggaggtggcagtgagtatcgatcgtgccactgtaccccagcctgggcaacaaagcaagactctgtctcaaaaaagaagaaagaataatacggcagtctccctttatctatggtttctctttctgcatgtggtttcaactacctg

SEQ ID NO: 149322 - DNA, 601 bp, Human
tgacaaggcaagttaaacaatgtcccctttaattttacatgaactttcaaatcttcattactttcattcctcccctgtacttaggaaaaccccactcatgattctaaacctagcttaacaattacctcctctaaatctttcacaataccatcaatttgattaatccatactctcaaagtacttggcctgcaattcattatccctactttatggaaggtattgtgaagctgtaagaacaagggtgttacagccaaacatcctgattcctgagcacctgtatatgtttttgaagctccagagstgactcatctagctataccacataaaatgaaaagcacatttatggactagatttgtcaccaagacttttctttgaagtgccagatagtaaatattttcagctttcccggctacatataatctttgttgcatattcatttttttaaacaatcatttaaaaatggaaaaaccattctgagcttgagggctgtataaaaacaggctgtaggctggacttggcatacaggctacactgcctgctgattcctagattttgaattattggagctatatacagtaaaggcaggaaccagacaaagca

SEQ ID NO: 149323 - DNA, 601 bp, Human
atgcttctaaaagtaagtacatgaatttcccatggacttttgcgatttacaggccattttaacttacttcctaatcctaagagatgttctagatggtgtggggctatgggacaagtatcaatgatttgtcgtttttttatgacgaacttaaactaagttttaaggttcattaagtgtccacccagttcatgtgaactatatattaggctctgaaagggaatcctaaaaattcttaagttctttagcacacttaatacacagaatacaataatcatgattatatatcattttttagttaaasggtaataaaatctggacttgcaggtacaagaaagtaagttattactgaaagggttgaaggttgagcaaaagaaacaatatcatcaataattactcaatctccattcaaattagaaaatcagaattagataactaaaatacttccaaagccttttaaggcttgccattaaaattttagatgtgatacacaacatgacatcattttaaaacctgcaaattgtgagtagtgacagtttgtcaaagcataaacatttataataataaataacaagccatctccataaaatcttacttctgtata

SEQ ID NO: 149324 - DNA, 601 bp, Human
gattttagtgtttgtctttctttttgctaatataccatcactgtacctatttatacaagcctatcatcaccctgcactacctcaataatataccactggctgggaagcatgtagtttaactgctactaaaaaatacatttttaaggtgtcaaggggctgacatgcttctaaaagtaagtacatgaatttcccatggacttttgcgatttacaggccattttaacttacttcctaatcctaagagatgttctagatggtgtggggctatgggacaagtatcaatgatttgtcgtttttttaygacgaacttaaactaagttttaaggttcattaagtgtccacccagttcatgtgaactatatattaggctctgaaagggaatcctaaaaattcttaagttctttagcacacttaatacacagaatacaataatcatgattatatatcattttttagttaaacggtaataaaatctggacttgcaggtacaagaaagtaagttattactgaaagggttgaaggttgagcaaaagaaacaatatcatcaataattactcaatctccattcaaattagaaaatcagaattagataactaaaata

SEQ ID NO: 149325 - DNA, 601 bp, Human
gagtagctgggattacaggcatgcgccaccacacccggctacttttgtatttttagtagagacggggtttctccatgttggccaggctggtcaggaactcccgacctcaggtgatccactcactttggtctctcaaagtgctgggattacagccgtgagccactgtgcccggccaagtcaacctgtttttaaagacataagcactgtgttgaacctatcctttagattaaagtatacacatcaatctgttccaaaagtggcctcaagctattcattggattttagtgtctttttttttttytttttttttttttaaaaaaagagatggtctcgctatgttacccatgctagactcaaacaatcctcccacctcaggctcctgagtagttgggactacaggcacacaccacctcacctggctggattttagtgtttgtctttctttttgctaatataccatcactgtacctatttatacaagcctatcatcaccctgcactacctcaataatataccactggctgggaagcatgtagtttaactgctactaaaaaatacatttttaaggtgtcaaggggctgacatgcttctaaaagtaagt

SEQ ID NO: 149326 - DNA, 601 bp, Human; identical to SEQ ID NO: 27521

SEQ ID NO: 149327 - DNA, 601 bp, Human
ggaagaaactcaaactctaacatggcatatttaagatctgcaaaactctaatattttctcctaacttctgtgaggacttctttccaatcctagtcttgagacatgttgaactaatactattcctttcaattattgttttggttaatgtgttattgttcctcaactgtatagaatgggtgatgctccactaggaaattcagttaagagctcttccaagatgcttttccagattcccccagcctcaagtagggtgcttgttctgtggcactgcagtaccttccatattctaacacagccctcrcttacaatattttaattactaaaatatttatctctttccatcccactagactgtaagctcctcttgaaagctaagtaatggcttctctggttccacctgtaacattaaaaaaaatttttttttggtagagacgggatctcactatgctgcccaggttggtcttgaactcctggcctcaagcagtcctcctgcctcagcctatcaaagtgttgggattacaggcgtgagccaccacatctagcttctacctgtaacatttagcccagtgcctgaaatgtagtagagaatcaatgaatggtg

SEQ ID NO: 149328 - DNA, 601 bp, Human
tgtagtggcaatgctgccatagacaatagttaaataaatagatgtggctgtattacaataaaattttgcttacaaaaccaggtgactaagatagaatggatttagcccacaggctgtagtatgccaaccctctaaaatatagttcatcatttaaattactctaattgtttgccccgggaggttccaagatggccgaataggaacagctccagtctacagctcccaccgtgagcgacgcagaagacgggtgatttctgcatttccaactgagataccaggttcatctcactggggcttgtcrgacggtgggtacaggacagtgggtgcagccaaccgagcgtgagctgaagcagggcaaggcatcgcctcacctgggaagcgcaaggggtcagggaattccctttcctagccaaaggaagctgtgatagacggcacctggaaaattgggtcactcccaccctaatactgcacttttccaacaatcttagcaaacgggacaccaggagattatatcccgcgcctggctcggagagtcccacgcccacggagcctcgctcattgctagcacggcagtgtaagatttaactgcaaggtggcagca

SEQ ID NO: 149329 - DNA, 601 bp, Human
gtcagtttctactcaactatgcgttgtagtggcaatgctgccatagacaatagttaaataaatagatgtggctgtattacaataaaattttgcttacaaaaccaggtgactaagatagaatggatttagcccacaggctgtagtatgccaaccctctaaaatatagttcatcatttaaattactctaattgtttgccccgggaggttccaagatggccgaataggaacagctccagtctacagctcccaccgtgagcgacgcagaagacgggtgatttctgcatttccaactgagataccrggttcatctcactggggcttgtcggacggtgggtacaggacagtgggtgcagccaaccgagcgtgagctgaagcagggcaaggcatcgcctcacctgggaagcgcaaggggtcagggaattccctttcctagccaaaggaagctgtgatagacggcacctggaaaattgggtcactcccaccctaatactgcacttttccaacaatcttagcaaacgggacaccaggagattatatcccgcgcctggctcggagagtcccacgcccacggagcctcgctcattgctagcacggcagtgta

SEQ ID NO: 149330 - DNA, 601 bp, Human; identical to SEQ ID NO: 27522

SEQ ID NO: 149331 - DNA, 601 bp, Human; identical to SEQ ID NO: 27523

SEQ ID NO: 149332 - DNA, 601 bp, Human
ttaagtccttcaaaacctttaagaaatgcaatcagaaatgcccaagataaaactaggcaaatgctaaagtttagtttgtgaaaaagtacctaaacctaaacacttaaaaatacctaaaaaattgcttagtgtaggaagtgactaaatctgttagttgtaaaataaaatttttgtttgagatgattcctattatagacttttaatttttcaaaaacatgattcttccaaaaagtttattttatgcatactataatcatatgacgaaaccaaatgtatattttatctgtatgtgtaaataaartgtgctttgtagatagaggaattggaatagcaggtctaggaaattcacaactggatagatgttctgtaactctgagtacatttatctgcacatttagcatggaaaggatttttaaagcccaaaacgagataaaatagacacatgtttttgttcttcatttaattagaaacacattttatggttgttactaatttattttccttgcaaatgtcaaccaagaaagtaaaggtgattagttattactaggcagtctgtttttccttttgaaatgtcatttggcttgaaccaaattgacaaaga

SEQ ID NO: 149333 - DNA, 601 bp, Human
ttaatgtcttgggagtttctgcagattttcagcagtcaggctgcccagcactttgtaattttttttttaactaggtgtgtctgataatttacattgtagacactgatataacaaaaacagtacagtcgatcctttcgatttatcatcctgcctgataagaataaacacacgattgtttgattgctaatactgagtttgaaaagaattctaacataaaaataatgctgtagtttagatctgctaactcgtaatagtcccatgcatgtgtttgacacttcgccaaaaacattaaatttttttcatatttgagcttcataataaccttgtgagatacactgggcctttgtaattatcatcaaattatactgatgaaacagatggcttagggaggttaagtgattttccccaagtcgtatcattagtgggtgagagaggcatgatgccaatactgtggtctttgcacgtcgtcttgtcacatcgcgtacacctgtgggctgtcaatctgcatctgtgtaatgggggccgcatgagtagccgtgatggctcagtgtttacataggttgttgctgtcacttttaaagaataacaagttctttgcctt

SEQ ID NO: 149334 - DNA, 601 bp, Human
tattgtaattataaacccatatactgaaatctcagagaaatgatttctagcattttggggtttttgaaaagttattatttgtatattttccccaccatggattcagctcagtttaattctattcaatccacccaatttgctgcagtgcagttcttcattattggatatctattccgtgctaagtaaagaatgcctgtggagtctgacctctacattcaagaacaagaaatcaacactcttccttctcctcagccccacctaaacatgctttaggtcaggtgtttaaatttttttatttttwaaaaataaagtgaattaaagaaaaaatttaagtcattacattctttgagaatctttgagatttcatggcactgtccctttcttcttgttccacatcttatgagctggtgtcttctttcacatgttaaaatgtatcgtttgaaatttggctcgggaggttttctaggttaacatgtagcagagcccagtagttcatgtgaaggctccttcagggaggaagccagaagcatggtacttacgaattcgctgaacatttctgaggagaggttatggatgtagtgggacaggacgacggcgcggt

SEQ ID NO: 149335 - DNA, 601 bp, Human
attaccactagctattacagcacctatcaccatgataatacccatatactgccttggttgttttggtgcaaagcctggatgaaggactcacattcatctgttgggcttgctccttgtcttcgggggtggcaagggaagaagtgtggcagctgttgatggccttggtaatgaacccccggccatgggtataccgtttatcctggaaatgatgagacaaattcaattagttggggttgtttgggcattgaataaatgaatccattagcagaatactaatacctttggcagatgtgtaattttwaaaaattagagctacataaaaatgaaaactaaagaattaagaaagtaaccctttcgcctacttcccccccattatctctgtaaactcattttttcatctagttttcataaatatcaatgtttttccttctttgcaattcccttgttgtttacttttaccattcacacaagtcacacgagttgctatttggaaagcaaatgctaaaaatagcaaaaatatgcaacattaaatgttgtattgagaatcatctttcttcagcatttgagccaaatgccacagtgcaaatgtatttacatgtat

SEQ ID NO: 149336 - DNA, 601 bp, Human
gtggcaactgtagctgtgaaaagcaaaatattatgttttacaggatctgtattttttgtgaggggagtggtgacttttaactaagaagtaagagagggcagaagagtcagtgaagaatgaaaaagtgggtgtcagagtagcagaaatagaaccagagtagagtcttgaaagtccagaacagatggctccaatagtgcaggggtcagtcatgtaacatgctgttgatgtaggagtcacgagtaatatgtaataaataaaactgcatttctttttcttacagatgcataaatgtatatttacycacagaagtccaattcagttcaaactttcataaactgtatatacaatcctagcgacaaggcattggttaaaataatgttatctgcaaggacaatgtacggatctgctatttagattgctgccaccatctttacttagcatttgatttgactcatatttcatcaactacataatgtaattttttgactgcttattcttcctatatttttctctgcatgtacaattaccactagctattacagcacctatcaccatgataatacccatatactgccttggttgttttggtgcaaagcctgga

SEQ ID NO: 149337 - DNA, 601 bp, Human
gttatcttgaataaccatggaattcacaatggagttctgcctgcctaggttttgcttactaccacgatcgtgtaggagactccaagtagctgattatctctgatttaaaatgcttactttgtagatgtccgtgaactagtctagtggtaacaaaatgaagaataaagaagaaataaatggacattgcaatggaaacatgtaagaggatatgaaagaaatgagctataaagaggtacaggtcataaagtgagtgtcagtgtagtttttctgggagcattgcaacacaacgattaagagtaarggttttgaatagaatgaagcccaggctcgctgcttacttgccatgtgactggtgcaaattccataacctttctgagcctcagtttccttatctcagtgagtgtaatgacagtaccttgtgttataggatttttatgaggattaaatatagtaatgcccacaaagtgtctgacaatgtagtacaagttgagcattcctaattagaaaatctgaaatctgaaatactccaatgagcattttttttttagcatcatgtaggtgctcaaaaaacttaggattcttcagtatttgggatttctgg

SEQ ID NO: 149338 - DNA, 601 bp, Human
ctattcatttttgatttgtagttttattttgggatcctagaacgaagagacaatgaagatgacatggaattcatcaacatgctttccttgatctacacaaccgcctgccccatgctgctggcagagcagtctgttctcttggcctatgcaggtaaataaaatggaaccaatgttatcttgaataaccatggaattcacaatggagttctgcctgcctaggttttgcttactaccacgatcgtgtaggagactccaagtagctgattatctctgatttaaaatgcttactttgtagatgtcygtgaactagtctagtggtaacaaaatgaagaataaagaagaaataaatggacattgcaatggaaacatgtaagaggatatgaaagaaatgagctataaagaggtacaggtcataaagtgagtgtcagtgtagtttttctgggagcattgcaacacaacgattaagagtaagggttttgaatagaatgaagcccaggctcgctgcttacttgccatgtgactggtgcaaattccataacctttctgagcctcagtttccttatctcagtgagtgtaatgacagtaccttgtgttataggat

SEQ ID NO: 149339 - DNA, 601 bp, Human
caaaaggaggctgaacagcacaacagagggcatgctatgtttcttcacactctataagcctttgcaaaccaggaaagcccagaggtcttagagaccaagtaaccattttagcaactttagggatgtcagctagtttggagagttattaggtatatatctggatgtagacgccgatctgctaaaccttttcctacaaagtgagaatatttttcaaatctgggattccctattggaatttaaagtgtgtgtgtgtgtatgcgcgtgcgcgtgtgtgtgcgtgtgtgcgcgcgcgtgtgtgtgygtgcgcgtgtgtgtgcatgtgtgtgtgcgtgcgcgtgtgtgtgcgtgtgtgtattcattgactggctttatgtttttatttttaatttttggtacttgagccctaagacaaaatttactgtgtaagggataatgatatgaacaagaatacttaaataagtggtagagaaaaaagaacagaaaatgaagtactatagaacaaattagtgacctcagaaatgaggtttacagtaatgaagaaaataactggaaaatcaaggtatttatttcacacattccaaggttaaaatgtgctttgtgt

SEQ ID NO: 149340 - DNA, 601 bp, Human
ttcatttcctcaaatttctaggggaaacaattgctttcttttgaggtccctgggctgggaggtgccgggaaaagcacctacaaggaaagggtacaggccgggtgtggtggcttacactggttcacgcattttgggaggcagaggcaggtggatcacttgaggtcaggagttcaagaccagcctggctaacatggtgaaatcccatctctacaaaaacatacaaaaatcagccgtgcctattggtgcacgcctgttgtcccagctacttgggaggctgaggcatgaggatcgcttgaacccrggaggcagagattgtggtgagccgagatgacaccactacactccagcataggtgacacagtgagaacttgtctaaaaaaaaaaaggtcagggggttgctggcagcaacccttcagtggtgagggctgtgtggtagggttgggggcatggctgtgataacaaaaggaggctgaacagcacaacagagggcatgctatgtttcttcacactctataagcctttgcaaaccaggaaagcccagaggtcttagagaccaagtaaccattttagcaactttagggatgtcagctagtttggagag

SEQ ID NO: 149341 - DNA, 601 bp, Human
atgttccaaaaactttaaaaaagatgaagattgtactcacacttgatgctttggggtacagataatttagtgatgaccatgactaagaaaagctgcttacatagtcaggagattttcatttcctcaaatttctaggggaaacaattgctttcttttgaggtccctgggctgggaggtgccgggaaaagcacctacaaggaaagggtacaggccgggtgtggtggcttacactggttcacgcattttgggaggcagaggcaggtggatcacttgaggtcaggagttcaagaccagcctggcyaacatggtgaaatcccatctctacaaaaacatacaaaaatcagccgtgcctattggtgcacgcctgttgtcccagctacttgggaggctgaggcatgaggatcgcttgaacccgggaggcagagattgtggtgagccgagatgacaccactacactccagcataggtgacacagtgagaacttgtctaaaaaaaaaaaggtcagggggttgctggcagcaacccttcagtggtgagggctgtgtggtagggttgggggcatggctgtgataacaaaaggaggctgaacagcacaacagag

SEQ ID NO: 149342 - DNA, 601 bp, Human
tattagtatttgtatgtccttgttctttctaactgttgaattaagaattgagaatgagatatgaatgcaaagttttagacaaaggcaatgatttttgtatatctgggccagtgtatcagaaacctattaatctaaaaactagaagcagaatacctgtttaggttctctgacatctatgggatcacagatgaagtatgtttttgcaggagtagacagatgaagaactggaaaggtactatgtaaatattgacatagatttgacgaagagacaatggagtagctagcttcggtgctctcactygaggaactatttcatttctccagtcttgtccctgatgtatcccttgtgctttattcttcctgacatcatttattttcttcctgctttgaactcaatctattgcctatctagtgtatgttccaaaaactttaaaaaagatgaagattgtactcacacttgatgctttggggtacagataatttagtgatgaccatgactaagaaaagctgcttacatagtcaggagattttcatttcctcaaatttctaggggaaacaattgctttcttttgaggtccctgggctgggaggtgccgggaaa

SEQ ID NO: 149343 - DNA, 601 bp, Human
gactagggtctgccagcaggggggaaacggagcacagtacctgcttagacataacagtatccggtgtgctgggttttcagtcgcaagaatattccatgcttttattagcttcagatactcttactgacttgacctaagcatgtttggacatattttaagcatatttgacccctgcacagttctgttactatttcataaacctaaccttaaacaaccagctattgacatacttcttggattagattcacagatttgcagggggtagttttgataatgggaaattatgagagcttcaagttgmtttttaaaaaattttaacagtgtttgttgggccaggtccctaagactatctttcaagccaggtttattatatctagttcattgtatttaagtatttaaagtatactaaattaccctcaccatcttccaagttatttcaaaactttattctccttgacatgaaattattattccaggaataataatatccttttgagtttatgtgcacacaaaaggtttttcattacaggaatataaatgttactcatatacatattcagaagcattttttatgtgattgcaatgtatgctgaatcattgg

SEQ ID NO: 149344 - DNA, 601 bp, Human
atttattatacaaatgttaatttttttctgacttagtgaaatagtgtaaggccaggtgcacattgtccctttgtttacatatatgaagagaactgttaaaagtctttaagtgatctgtaattaattatttatgcccaattaatttgggcttttaaatatataaaacatggccatcctaggggtaaaatagggacatttcagtaagacacgcctatatagagatagtggtgttgaactgccaagcatatgccttgaattgtgacaattcaaggccacatcatcctcacttttttgcctgagwtccactccgtccatgattccacagacctgccaacttttgggtgcagtttatgcttagcggcttttgttagacctgaactctcaatcttcaccatgtcagagacatgcattagacaaattccatcttagttggtgaactgttggaaatgtaagaactccagagaaaccatagtcagaagtgctactcaatggagcagacaaggcttcatcattttctgctgctgcttctaaaaagaagctgaaattattttattctagaaaatttgggatttaataatgtaagagactatgtcctgtcaca

SEQ ID NO: 149345 - DNA, 601 bp, Human
gcagtttatgcttagcggcttttgttagacctgaactctcaatcttcaccatgtcagagacatgcattagacaaattccatcttagttggtgaactgttggaaatgtaagaactccagagaaaccatagtcagaagtgctactcaatggagcagacaaggcttcatcattttctgctgctgcttctaaaaagaagctgaaattattttattctagaaaatttgggatttaataatgtaagagactatgtcctgtcacagtcatagcaacctactgattctactttgggaaagagccctcartgcttgaaattttcatctaagaatggagaaccataggtgctatttcagcagggtctcttttcctgtacaattataaaaagaaaagtgccgggttcctgtggttctatactcaataatcttgcttctgctgagatatatggttgatgccaagtttaagctgggagacaatttttagtcactacataccccaaaatggaagttttaatataatgcagtgcccagacttgggcactacaggtagctccactataatcagtaccaagggcgccactctaatcatcctctgaaacaaagcaccct

SEQ ID NO: 149346 - DNA, 601 bp, Human
tggtttatattctgttcacacttgtttcaaaccctctcctctaaaagcaatgtgtttttggaattcaaggaatgtacgttctttccccaaccttaactgggggtcagtcttatggccaccatatttgtctacaatataacttttaaaaaatataatttttgccctcaaatactctcctatccaatgcaatgtaactttgaaggagaagtgatgaaggccactggttgccagattgtatcacacagccagatgcactttgctttgatgaagaatctaagtgatgcaggcccccacttagctytgtaaactaaggcaggggtttatgtcagctcgaggtagaaagcagtgagaattggcagctgatggaatagaaaggggacaaaaagaataaaaaataattgactttagtctgctttccattaccgtagcccaactctctggggccatttgtgtggtctagacaacattcttagaacttgacagtccctgagaacgatattctaggttggcatgggcaatagttggcatttacactggtcttggaatcataacatttgagaagtgtaaggcacaagagtcctcatctgcccaatccccttca

SEQ ID NO: 149347 - DNA, 601 bp, Human
ttggctgtgggggtaatgacttattcccaaagatacaaaataagcaaggctactttggatgttaaatgaaagggaattatttaaaaaaggaaagaatgactcttcaaaacgtgatagtaatatttttaaagatttatttgatattcgcaaatttgtcttctgtggttatatcaattctgttgctcaaaaagtgacacatgcttcatagagaatagaatctaaaaggatttttgagactttcttggggagaaggacacacagtgcccctctggtagtaacggagttttgtcctgggccaccmacatcctgagtgactgtcatgctttcagaggtccccagcccttgcccagtaacattgaacaaggtgttcttcctctgtggttagctccaagatttctggtttagcaaagtggctaatcagttaactctttaagaggaaattgtcattcctttagccaacgctaatttccttaaaatgccttcttttcctttttggaactgagaaagcttaaaaatagaattgcttcaagccctgaggcctgaaagtgaaacataatctaacgtggctgtagtgcactgactcgttaggggcagcgatata

SEQ ID NO: 149348 - DNA, 601 bp, Human
gtcaaaaagaaataatccagtgtttttcaagtttacctgattgcctgtagcacttgttacagattcagattcccaggctccatccctatcctctgtcagaagccctaagatcttctgatgaaacattctggaagcacggctagttgagcacagggaaaagttactgaaactagattgtccaggtgaaggcaggagccttctgccacatccattcacataatgcttatctcagctcttcctcgtttggaaagaccccagggccccaagcctcatacctgctctcgtggttccaaaacttgcrgactcccaggttgtagcccaggcaaaccatacaaagatgggtctcccaaaacttaaaagatgtgaaacaagaagtggtttcttggattctcaagcggttgagaatccgagctcaggaggtcaaagtgggcttggtggctagacgccaggcaccagcaccagctgggtacccttgagtggtttttctgccttaacagtaggaaggcttttcattctgtctggtctggacctgcctgaaacacagctaaccaagtggacagagcgagaaatgtgaatacgaggaccagagcacaccatttag

SEQ ID NO: 149349 - DNA, 601 bp, Human
cagaagccctaagatcttctgatgaaacattctggaagcacggctagttgagcacagggaaaagttactgaaactagattgtccaggtgaaggcaggagccttctgccacatccattcacataatgcttatctcagctcttcctcgtttggaaagaccccagggccccaagcctcatacctgctctcgtggttccaaaacttgcagactcccaggttgtagcccaggcaaaccatacaaagatgggtctcccaaaacttaaaagatgtgaaacaagaagtggtttcttggattctcaagckgttgagaatccgagctcaggaggtcaaagtgggcttggtggctagacgccaggcaccagcaccagctgggtacccttgagtggtttttctgccttaacagtaggaaggcttttcattctgtctggtctggacctgcctgaaacacagctaaccaagtggacagagcgagaaatgtgaatacgaggaccagagcacaccatttagagtacgggcgctattgagttgatgagtctggaagcaggatggcaacaatgatggtgtgaaaaggcaggtggaagtgaagggcagattaagggagaa

SEQ ID NO: 149350 - DNA, 601 bp, Human
agtttaaacatatgagcctttgaatactcctgtctaggaaagagccgtgtaaattctaagtatctctataattgacttttgatatgttacttgtgtttaaacccaatttgcaacaccccttttgttggctaattttgtcgctatgttgggtagcagaacttgtgacgatcacactaataacataaagtttcccacctttcttgttgctgttttccttgttagcatctcagacttcccaattctgggaatagtctctaggaggcaaggttttcagctttggaaatgcatgcgtgacacagtrgtgtggtatggaaggcgtgtggacttgaagatccggctccagaaacacgctctgccaattaccgtgtgtgaccttttataaattacatccatgagctgtagttacctaaaatagtgatcctctctccttcactggctggaaggattaaatgagatagtgtttataggaaatgtactttgtgttccttagttgcctccccccgccactccccgtggtaggaactcttgagtacttgtcaaatctgaactctcggcatttttacctccttcagggaaaactattggacaggctcttactgaa

SEQ ID NO: 149351 - DNA, 601 bp, Human
tgatattaattggctgctggaagcctctctaacttgcagaagaaaggatcaaagtctgcagttcagggaaggaagttttgcatttatcattgacccaactgggtaatttaagagcgactttctgctcagggtcaacttctcagtgtggtttttaatcccacttcatagttagatgatttggtcacatcactttccctccaaaccccatttcctcgtctgttaaatgaggaaaatcatggttcttacctcacagagttactgtaaggattgaatgcaataatgcctgtaaagtgctggctcygtccctggccatgtgctaaacactctgacatttgttgtcttcctcatgtatatcattattgtggttgtcattaagttgggcttccgtttcaggacagttcaacagtaagcagccattccctttgttgctggtgcttctgcagctattttccttgctcacctatacccacgctggccccagtttcaaccacagggccggctgacccatttatttagcagataggtgttaagcacctagcatatgccagccaccattctaggtaccaggaatacagcagtgtcagaacagacaaaattccct

SEQ ID NO: 149352 - DNA, 601 bp, Human
aatagaatccaaaatcttaagtaatgactttgaataaaaataagtgttttaaaagttagtaactttttaaaaaataagtgtaattaaataaacttttaaatttaaaaagatgttacttgatttttatttcctgataatggatttaaaaaaaaaaaaaaaggcccagatcagactggcagaaatacttttatttctgcactagcccaaagcctggatatgcttataaggcatataacctgtccatttaacagctgtcatttaattcacaaacactaattaattacagccatgttaaaagggktgtttgggacggtttggtagttccttttgaagaaaacctgtgtcttgaaaatgcatatgaaagattaccaggttctgttatatatagtccaggttcgtcttggtggttctattcgaaaaatatctctctgaccatcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaagg

SEQ ID NO: 149353 - DNA, 601 bp, Human
gcatatgaaagattaccaggttctgttatatatagtccaggttcgtcttggtggttctattcgaaaaatatctctctgaccatcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaaggatcagcttctctaatcccttgacttttcactgctctatgtagtcagggtagayaaggggtggccctcaaacaacagccacctctggaggtctagcgtgactaaaccactgtcttcttttccaaatccagcactggggaccgacgtgtgggcctcccatctgacttgtggagtgaaagaaatgggaatagagcagcgctgtccatatagtcgagttttgtaaatatttgtcagatggaactagagatgcattatcacattcgacagtaacaagtggcaagtgttgagctcttttaagtcttgctttttatttcttataatatgcaaataactgttaaaatggccagccagttgg

SEQ ID NO: 149354 - DNA, 601 bp, Human
tctgaccatcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaaggatcagcttctctaatcccttgacttttcactgctctatgtagtcagggtagacaaggggtggccctcaaacaacagccacctctggaggtctagcgtgactaaaccactgtcttcttttccaaatcsagcactggggaccgacgtgtgggcctcccatctgacttgtggagtgaaagaaatgggaatagagcagcgctgtccatatagtcgagttttgtaaatatttgtcagatggaactagagatgcattatcacattcgacagtaacaagtggcaagtgttgagctcttttaagtcttgctttttatttcttataatatgcaaataactgttaaaatggccagccagttggctgtctgttttagctaaggtaggtctcttgcaatttttgcaccctagggagatctcaataggagtaggtctagc

SEQ ID NO: 149355 - DNA, 601 bp, Human
ctaaaggcggacaaactagactgtgaacttaatacttaccctgagaagtataactgccaagtggacagttgcagaaattggttattgcctgtgttctcgatcagaaggttattagctgtgtcagagtaaaggcattgaatgatcccattagtaccttccagctgtggtctcctctctagagcgtacctgcaggggagggagtactgctagccacttatggagcatatggacactgtcattcacccacccaggtgtccagttccatgactctggtgtgaaacactgaatttgtttgttaccttttttttttttgtaagaaaatacttgtttttagtacctgcttattatttttttaaaataaaaaatatataaggaagtggagtgaaaatgaaaatactttcttcattccctcttgatcttgcttccttcccagagataaccacaatcacagcttggcctttcctttttataatcatttgcaaatctatattttatttatataaaagtaaaaatgattcaaaaatacaaaagtgcacatcgtggcttgcccttttgcttagtatttccagagacgtaattccctatctgtatatattgttgc

SEQ ID NO: 149356 - DNA, 601 bp, Human
cagagataaccacaatcacagcttggcctttcctttttataatcatttgcaaatctatattttatttatataaaagtaaaaatgattcaaaaatacaaaagtgcacatcgtggcttgcccttttgcttagtatttccagagacgtaattccctatctgtatatattgttgctcattattctttgtaatagctgcgctgccactcgttatatagatatgccagaatgtgtttagttattcccatttgatggtcatttctgtcatttttcattttaactattgctattatgaacagtgctacrttggatatctatgtacataagtttttgtgcttgtgtgtatttctgtaggctgcatttctaagcgttgaatttttatatcacagggcatgtatattaaaatgctgatagattagataggtccaaattaccctccaaaaaggctgaacaaatttatattcccaccacaagtgtagagagttgcctgttttctcatactttttccaacactaggtaacattagtctttttgcagttgctgctcatgctagatagtacctccttttatttatttatttatttatttatttacttacttacttac

SEQ ID NO: 149357 - DNA, 601 bp, Human
tttatattcccaccacaagtgtagagagttgcctgttttctcatactttttccaacactaggtaacattagtctttttgcagttgctgctcatgctagatagtacctccttttatttatttatttatttatttatttacttacttacttacttacttattttgagatggagtcttgctctgttgcccaggctggagtgcagtggcatgatctgggctcactgcaacctccatttcccaggtgttcaagcaattctcctgcctcagcctccccagtagctggactacaggcgcacgccaccrtggctggctacttttttcatattttagtagagttggggtttcaccgtgttgcccaggctggtctcaaactcttgagctcagtcaatctgcccgcctcagcctcccaaagtgctgggattacaggcgcaagctactgtgcccagccaatttttatttatttattgagacagagtctcattctgttgcccaggctggagtgcagtggtgcagtcttggctctctgcgacctctgcttcccgggctcaagtgattcttcctcctcagcctactgagtagctgggactagtggcgcatgccatc

SEQ ID NO: 149358 - DNA, 601 bp, Human
tacagtagctttgtgatatgatttgctatagataaggaaaatctgcttcctgttacatacttttttttttcattaaaattacagtttttatgttcatgcttacttgcatttttacaaattgagcttcttctcccccatccactgtgagtttagggttataagaaaaaaaactctctgcacttattagatagtctactgcactgggaatagcagtaagctgtttacattttttctttcatctgatacaacaaaccttgagagttggtgccaatatcctcatctgtagatgaggaaagtgagsctcagtgatgaagcagtttgtccaaggctgcatttctggacattggcagaaccagggttccagaccaagtccaggaaatttcgaaacctctcttaaccattatgcaacccagacacgtggggttttctcacatgacgagggcaggccattgtctagggcgggttatcaggtgtttctccatgtcctgcagggcggtcagtggcttttacagagtagagtgtttattgcatgaagggaagacctagcaagatctctctaaaggatttatccattggggcagcaagagttgaaaaatttggc

SEQ ID NO: 149359 - DNA, 601 bp, Human
taaccattatgcaacccagacacgtggggttttctcacatgacgagggcaggccattgtctagggcgggttatcaggtgtttctccatgtcctgcagggcggtcagtggcttttacagagtagagtgtttattgcatgaagggaagacctagcaagatctctctaaaggatttatccattggggcagcaagagttgaaaaatttggctttgccaagggtatttgttcagatttaggatacaagtcaagttgggaccacaggctaaagtttaagtgagtggggagagaaattatttacccartgcttttttttaatgccagacactgtaacccttcctcggctcttttctagagttgggtctgtggtttggaatacaaaggtgaggaatacacagccctggacattcagaatggggcagtaggctgggaggagctgtgcgcacaaccccaggaaccttctactttttttttttttttttttgagacaaagtctcgctctgtcacccaggctggagtgcagtggcacgatcttggctcactgcaaactctgcctcctgggttcaaccgattcttctgcctcagcctcctgagtagccaggact

SEQ ID NO: 149360 - DNA, 601 bp, Human
aagggaagacctagcaagatctctctaaaggatttatccattggggcagcaagagttgaaaaatttggctttgccaagggtatttgttcagatttaggatacaagtcaagttgggaccacaggctaaagtttaagtgagtggggagagaaattatttacccagtgcttttttttaatgccagacactgtaacccttcctcggctcttttctagagttgggtctgtggtttggaatacaaaggtgaggaatacacagccctggacattcagaatggggcagtaggctgggaggagctgtgcrcacaaccccaggaaccttctactttttttttttttttttttgagacaaagtctcgctctgtcacccaggctggagtgcagtggcacgatcttggctcactgcaaactctgcctcctgggttcaaccgattcttctgcctcagcctcctgagtagccaggactacaggcgtacgccacaatgcctggctaatttttgtatttttagtagagacggggtttcaccatgtcggccaggctggtcttgaactcctgaccctaggtgatctgcccgcccgccccgcctcggcctcccaaagtgct

SEQ ID NO: 149361 - DNA, 601 bp, Human
acggtgttgcttttcgtgctttcagttacctaaggtccaaaaatattacatgaaaaattccagaaataaacaattcataagttttaaattgcactcggttctgagtagcatcattaaataccacctgggacttgagtcatcccctttgtccggtgtattcgcactatgttacactattccccaaccctcattccttactgtataggaaaaaacagtatgtatagggtttggtactatctgaggtttcaggcctgcagtaggggtcttggaatgtatcctcggaggatgaggagagactacygtattttttccggaaagtctaggaccatttctcaaactaagagaaggacaaagttggagaggaaactgtttctgttctgcatagtttgagatatgtacaattttgagacccaatccaatttttttccaaccactttcttgtgtgttttttttttcagtatcttaacccacattgatgttttatcttctgtaagcactaaacagtggcaagttacacaaataaaatgtgtgcttactacattttaattgctcttttttatgcaaataataatagatggtttttttgttcttacacattgat

SEQ ID NO: 149362 - DNA, 601 bp, Human
caggcatgtaccaccacgcccagctaatttttgtattttcagtagggatgaggtttcaccatgttggccaggttggtctcaaactcctgacctcaggtgatccacctgcctcggcctcccaaagtgctgggactataggcgtgagccaccatgcctggtctaaagaattgtctttacgatagaggaatgtttgactttagcacatttctggtaaaatcaagattctagatcggggtgtccaatcttttggcttccctgggccacgttggaagaagacttcttgggccacacataaaatacmctaacactaacaatagctgatgagctaggaaacacacacacacacacacacacacacacagagagagagagagagaaattttgtaacgttttaagaaacttcgtgaatttctgttgggatgcattcaaagctgtcttgggccacatgcggcccgtgggccggaggttggacaagcttgttctagacgttcttcctctgtctctctatgttagatgctttcccacgttagcagtccttttcccctcctctcttaaatgaccaagcaggactaggaaagcataaaggcaatgagaacacgct

SEQ ID NO: 149363 - DNA, 601 bp, Human
taccttaatttcatatcaagtactttcatactttttagcttttaaaatgacagaggctgggctcagtgtctcactcctgtaatcccagcaccttgagaggccgaggtgggaggattactgaagcccaggagttcaagaccagtctgggcaacatagtgaaaccaggtctctacaaaaaaaaattagtcaggcatggtggtgtgcgcccatgttcccagctacttggaaggctgagcccaggaggcagaggctgcagttagctgtgtttgtgcctctacactctagcctgggcagcagagcragacctagtcttgaaaaataaatataaaataatagaatgctcttcccagctagattgtaaggtttttatatgttagtgtccccatggtatattgtaagttgtaggtacatacccctatttattatatgttatggtgtttttaggcaatgagatttttaatattagctactcatgattcgcaacaagttcggtctttatgaaataaacttcattcaaatctttgaattccatttttaagtgcagctacagttgataccttagacaaatgaaagatttgtctacttcttagttcattcctac

SEQ ID NO: 149364 - DNA, 601 bp, Human
aggccgaggtgggaggattactgaagcccaggagttcaagaccagtctgggcaacatagtgaaaccaggtctctacaaaaaaaaattagtcaggcatggtggtgtgcgcccatgttcccagctacttggaaggctgagcccaggaggcagaggctgcagttagctgtgtttgtgcctctacactctagcctgggcagcagagcgagacctagtcttgaaaaataaatataaaataatagaatgctcttcccagctagattgtaaggtttttatatgttagtgtccccatggtatattgtawgttgtaggtacatacccctatttattatatgttatggtgtttttaggcaatgagatttttaatattagctactcatgattcgcaacaagttcggtctttatgaaataaacttcattcaaatctttgaattccatttttaagtgcagctacagttgataccttagacaaatgaaagatttgtctacttcttagttcattcctacagaaaataagaacatctagtatctaatatgatccctcgtgggccctcaagaaatactagtcttttttagaaagtctagtcgtgggtctgtttctctt

SEQ ID NO: 149365 - DNA, 601 bp, Human
ggattactgaagcccaggagttcaagaccagtctgggcaacatagtgaaaccaggtctctacaaaaaaaaattagtcaggcatggtggtgtgcgcccatgttcccagctacttggaaggctgagcccaggaggcagaggctgcagttagctgtgtttgtgcctctacactctagcctgggcagcagagcgagacctagtcttgaaaaataaatataaaataatagaatgctcttcccagctagattgtaaggtttttatatgttagtgtccccatggtatattgtaagttgtaggtacatrcccctatttattatatgttatggtgtttttaggcaatgagatttttaatattagctactcatgattcgcaacaagttcggtctttatgaaataaacttcattcaaatctttgaattccatttttaagtgcagctacagttgataccttagacaaatgaaagatttgtctacttcttagttcattcctacagaaaataagaacatctagtatctaatatgatccctcgtgggccctcaagaaatactagtcttttttagaaagtctagtcgtgggtctgtttctctttattccattgtgtc

SEQ ID NO: 149366 - DNA, 601 bp, Human
tgcccggccctctgtatttttgatgggatggatggttcaacatttaaagagaacctaaaaagttaaaagtaaaagcaaagaagtcttaataacaaaaagcaccttcatgcaatgtcactgttttactgcatcttaataaagaaatgtggccaccttagacccagaatataatcaatttttaattgtctttcttggataatatcaggatagagtgtaataagttaggttaacatattagcttgcatcttgtcagggaaaataggtagatcctctgaacacagaggaaggagggacgtccacrtttgtcctgtttagtgtcatactgaagaagagtatgaccagccagtgctgggcgttctgcagcttgggacagatgttggggggaagggcactgcctttcttgtgaactttcttgcccaagggacaaatgagctaagcagtactacgttattagtgggatgtgtatgtgtgtgtgtgtgtatgagagagagagagagagaaagagaaagagaacagagcctgtaagtcttgccattttgccttttcagacaacccacccccacccctcagcataggaatgtagtcctaaccccaagccact

SEQ ID NO: 149367 - DNA, 601 bp, Human
ctgtttttgtaccagtaccatgctgttttggttactgtggccctatagtatagtttgaagtcaagtagtgtaatgcctccagctttgttctttttgcttaggattgcctttgctattcaggctcttttttggttccatatgaattttaaaatagttttttctagttctgtgaagaatgttgttggtagtttgataggaataacattgaatgtgtaaattgcttatgttttcccatttgtttgtgtcatctctgatttctttgaagagtgtttttaattcttgttgtagagatctttctagwgtattcctaggtgttttattctttttgtggcagttgtgaatgggattatgtttctgatttggctcttggcttaactgttggtatatgggaatgctagtggtttttgtatgttgcttttgtatcctgagacttcgctgaatttatgtatcagcttaaggagcttttgggctgagactatggggttttctagatatagaatcatgttgtctgcaaacagagggtagtttgacttcctctctttttatttggaggcactttatttctttctcttgactgattgctctggccagggcttccaat

SEQ ID NO: 149368 - DNA, 601 bp, Human
ttcagagatgaagagagtatttctcctccgcaccccctttgcctacacctagaaataagtttagcctagggaaaaaatgttccctgacttgtcaggttcagctagtgtaccctttgagatccttcattctctctttttctttttgagaagaagtcttactctgttgcccaggctggagtacagtggtcccatcttggctcactgcaccctccgcaccccaggttcaagcgattctcccgtctcggcctcccaagtagctgggattacaaaagcacaccatcatccctagcttattttttcyttttttttttttttttttttagtagagatggggtttcaccatgttggccaggctgctcgatctcttgacctcaggtaatccgaccacctcggcctcccaaagtggtgggattacaggtgtcaaccactgcacctagcccgttctctctttaatctcccaattaacgaacatctactgcgacagcatccattacctagaattgtaggaaggtatataggatagacgtagcaaagaggtaagtgggtaagaaaataaacactcataaaaaggagacaaactgtcagagtggtcccctagcta

SEQ ID NO: 149369 - DNA, 601 bp, Human
tacgtatttattaatctaatgctatttagtaatgttttcaatgtttttaaaattttataaaaagatgccgtatacattctgaggtttttttgtttgttttttactcactactatatttgtgtgattggcctgtgttgataactatagcctggtgctaatgctgctctacaaattcttgtgtacacatccttgtgcatatgcgcaagagtttatggtgcatattgagaagttgatggttttcactaaatattgataaaactcttctcccgaggggccctccccgtcaacccctggcttcaarcatagtatcagtttctcatattttcagcacttggtatttttagactttgtcatttttgccaaccttgtaagtgtgagaaggctatttcattttaatttatatttctctgacttcgtattttaatattttcaaccatttagtagtctcttctaggaatcccctattcctgtcttttatctaatttttctcttgggttatatgttcttttcttactggctactcctaattctttacctattctggataataatgctgaggtagcttacctttccattgttttactgtggccttttgttgaca

SEQ ID NO: 149370 - DNA, 601 bp, Human
atgctatttagtaatgttttcaatgtttttaaaattttataaaaagatgccgtatacattctgaggtttttttgtttgttttttactcactactatatttgtgtgattggcctgtgttgataactatagcctggtgctaatgctgctctacaaattcttgtgtacacatccttgtgcatatgcgcaagagtttatggtgcatattgagaagttgatggttttcactaaatattgataaaactcttctcccgaggggccctccccgtcaacccctggcttcaaacatagtatcagtttctcrtattttcagcacttggtatttttagactttgtcatttttgccaaccttgtaagtgtgagaaggctatttcattttaatttatatttctctgacttcgtattttaatattttcaaccatttagtagtctcttctaggaatcccctattcctgtcttttatctaatttttctcttgggttatatgttcttttcttactggctactcctaattctttacctattctggataataatgctgaggtagcttacctttccattgttttactgtggccttttgttgacagatagcacgtgtgatttg

SEQ ID NO: 149371 - DNA, 601 bp, Human
gggcagggcaggtctctctatcttgttctttttgttttgttctctttctctctctctctttttttttttttttttttttttttttttttttttttgagacagggtctcactgtatcacccagcctggactcaaactcctgagctcaagcaatccttccacctcagcccccattcactctttagtgcagtcatagctcactgcagcctcaaattcctaggctcaagtgatcctcccactttaacctctaagtggtgggattacaggtgtgcaccaccagacttggctaatttttttattttsgtagagaccgggtcttgctgttgcccacgctgttcttgaactcctggtctcaagtgattctcctgcctctgcctctcaaaattctgggattacaaggcatgagccccactgcaccaggccaaatctctttaaaagataatcaattttaaaaattagtaaattgtggccaggtgcagtggcacacacttaaaatcccagtgctttgggaggctgaggtaggaggatagcttgaagccaggagttcgagaccagcctgggcaacatagtgaagtcccctatctgtaaaaacaaagagagaga

SEQ ID NO: 149372 - DNA, 601 bp, Human
tctatcttgttctttttgttttgttctctttctctctctctctttttttttttttttttttttttttttttttttttttgagacagggtctcactgtatcacccagcctggactcaaactcctgagctcaagcaatccttccacctcagcccccattcactctttagtgcagtcatagctcactgcagcctcaaattcctaggctcaagtgatcctcccactttaacctctaagtggtgggattacaggtgtgcaccaccagacttggctaatttttttattttggtagagaccgggtctygctgttgcccacgctgttcttgaactcctggtctcaagtgattctcctgcctctgcctctcaaaattctgggattacaaggcatgagccccactgcaccaggccaaatctctttaaaagataatcaattttaaaaattagtaaattgtggccaggtgcagtggcacacacttaaaatcccagtgctttgggaggctgaggtaggaggatagcttgaagccaggagttcgagaccagcctgggcaacatagtgaagtcccctatctgtaaaaacaaagagagagatttaaatgtaacatat

SEQ ID NO: 149373 - DNA, 601 bp, Human
aagtggtgggattacaggtgtgcaccaccagacttggctaatttttttattttggtagagaccgggtcttgctgttgcccacgctgttcttgaactcctggtctcaagtgattctcctgcctctgcctctcaaaattctgggattacaaggcatgagccccactgcaccaggccaaatctctttaaaagataatcaattttaaaaattagtaaattgtggccaggtgcagtggcacacacttaaaatcccagtgctttgggaggctgaggtaggaggatagcttgaagccaggagttcgaraccagcctgggcaacatagtgaagtcccctatctgtaaaaacaaagagagagatttaaatgtaacatatttacccacatagttaccatttctagtgctcttaattccttcgcctagatctgttttccatttgacatcattttattctgtttgaggcacttcctttaatattttctctattctactggtgaagaattctttcggctttcgtatctctgggaaaaagtccctattttgccttgagattttaaaaggttttcgctgggtatgtctgagaatatagaggaactaaaaacctcag

SEQ ID NO: 149374 - DNA, 601 bp, Human
ctcctggtctcaagtgattctcctgcctctgcctctcaaaattctgggattacaaggcatgagccccactgcaccaggccaaatctctttaaaagataatcaattttaaaaattagtaaattgtggccaggtgcagtggcacacacttaaaatcccagtgctttgggaggctgaggtaggaggatagcttgaagccaggagttcgagaccagcctgggcaacatagtgaagtcccctatctgtaaaaacaaagagagagatttaaatgtaacatatttacccacatagttaccatttctastgctcttaattccttcgcctagatctgttttccatttgacatcattttattctgtttgaggcacttcctttaatattttctctattctactggtgaagaattctttcggctttcgtatctctgggaaaaagtccctattttgccttgagattttaaaaggttttcgctgggtatgtctgagaatatagaggaactaaaaacctcagtttctcctactgtagtttcacatcacgcttctgacaccagatgtgctgagtcagggggtactttccctagacatcaagcaagcaattcattctg

SEQ ID NO: 149375 - DNA, 601 bp, Human
ttcccacaacccccttcttgggtttgattaatttgccagagcaggtcacagaactcagggaaacagcatttactggtttattataaaggatattacaaagggtacagataaagggatgcacagggcgaggtatgggggcaggagtgtggagcttccatgccctccccaggtgtgccaccctctaggaacctctgtgtgttcagttattcagaagctctccaaacccagtccttcgggggcttttatggaagctgcattacataggcatggttgattgcatcattggcctttggtgatcagrtgggctgttgtctgttcaccttgaaactgccttgaaatgcatcataaacacagcagttctttgtcagtcaatcagagagctgtttatcagacactgaagaatccagcagctcctcacacagttccagagtcaggcctaagggggaggttatctcctccttgcattcctcaggtaggtagcatgatctcttataaaccatttccattttatgatagaactcttctgggcactgccatccccattacagtgttcctgtgacatcacccccagacagcatggttatttcaggtttcagggtca

SEQ ID NO: 149376 - DNA, 601 bp, Human
gggaaacagcatttactggtttattataaaggatattacaaagggtacagataaagggatgcacagggcgaggtatgggggcaggagtgtggagcttccatgccctccccaggtgtgccaccctctaggaacctctgtgtgttcagttattcagaagctctccaaacccagtccttcgggggcttttatggaagctgcattacataggcatggttgattgcatcattggcctttggtgatcagatgggctgttgtctgttcaccttgaaactgccttgaaatgcatcataaacacagcagytctttgtcagtcaatcagagagctgtttatcagacactgaagaatccagcagctcctcacacagttccagagtcaggcctaagggggaggttatctcctccttgcattcctcaggtaggtagcatgatctcttataaaccatttccattttatgatagaactcttctgggcactgccatccccattacagtgttcctgtgacatcacccccagacagcatggttatttcaggtttcagggtcattttgtgttcttcagtctaggctccacacaggactatgcctccaggatatgtctcca

SEQ ID NO: 149377 - DNA, 601 bp, Human
ttgcattcctcaggtaggtagcatgatctcttataaaccatttccattttatgatagaactcttctgggcactgccatccccattacagtgttcctgtgacatcacccccagacagcatggttatttcaggtttcagggtcattttgtgttcttcagtctaggctccacacaggactatgcctccaggatatgtctccaccagcagtcagcttctgctctacgccctgtggccttgggcaaccttgctggctcccatttagcacgtccaattaatattgctcaaagggtggatttgcatgycttctgttttacagtactatgtagggggagcatttcccactcagatgtaatgtccattgcatgataaagagacacagctatttcttatgaagtgtgttcaaatataccacctctctctaaacttttaccttagttccatcaacccttactttcctaactgtagccttcattaggcctttaccaacaggtttcggtcgtacaattcagtactagctaggggaagtgttccctggacagacataatatccattcctataaatcatttaggtaaagaggcacaacttccttatataaagccta

SEQ ID NO: 149378 - DNA, 601 bp, Human
attgcatggtggttttgatttgcatttccctgatcattagtgatgctgagcactttttcatgttcttagctgactttttggtgggattttttgggttttttcttgctaatttgttttattcatcccatttcttaatagccatctaaagatttccaccatactgggaaaagtcccatgactcttctctttgtttttcctctgtttcatccctatcggtgtgttcttttttttttttttgagacggagtctggctctgtcgcccaggctcgagtgcagtggcgcaatctctgctcactgcaayctccgcctcccgggttcaagcagttctctgcctcagcctcccaagtagctgggatttcagctgcctgccaccacgcccagccaatttttgtatttttggtagagatggggtttcaccgtcttggccaggctggtcttgagctcctgacctcgtgacccacctgcctcggcctcccaaagtgctgggattacaggtgtgaacaaccgcgcccggcccagtgtgttcttattcaccttatttcttaacaaccataaaaaatttccaccttcctgtgaggagtcctgtgactcttccccccta

SEQ ID NO: 149379 - DNA, 601 bp, Human
aagtcccatgactcttctctttgtttttcctctgtttcatccctatcggtgtgttcttttttttttttttgagacggagtctggctctgtcgcccaggctcgagtgcagtggcgcaatctctgctcactgcaacctccgcctcccgggttcaagcagttctctgcctcagcctcccaagtagctgggatttcagctgcctgccaccacgcccagccaatttttgtatttttggtagagatggggtttcaccgtcttggccaggctggtcttgagctcctgacctcgtgacccacctgcctyggcctcccaaagtgctgggattacaggtgtgaacaaccgcgcccggcccagtgtgttcttattcaccttatttcttaacaaccataaaaaatttccaccttcctgtgaggagtcctgtgactcttcccccctacccttcatcattctcttgttaattaacctaatgtttgtattagcatctgtaagactcatgaggggaagctgagcaagtacatctcataaggcttcttgaactatctctcgattttgtggcaacaaggttaaatggggcatccacattaaaggggcgcccctaatcgc

SEQ ID NO: 149380 - DNA, 601 bp, Human
ttttgagacggagtctggctctgtcgcccaggctcgagtgcagtggcgcaatctctgctcactgcaacctccgcctcccgggttcaagcagttctctgcctcagcctcccaagtagctgggatttcagctgcctgccaccacgcccagccaatttttgtatttttggtagagatggggtttcaccgtcttggccaggctggtcttgagctcctgacctcgtgacccacctgcctcggcctcccaaagtgctgggattacaggtgtgaacaaccgcgcccggcccagtgtgttcttattcaycttatttcttaacaaccataaaaaatttccaccttcctgtgaggagtcctgtgactcttcccccctacccttcatcattctcttgttaattaacctaatgtttgtattagcatctgtaagactcatgaggggaagctgagcaagtacatctcataaggcttcttgaactatctctcgattttgtggcaacaaggttaaatggggcatccacattaaaggggcgcccctaatcgcatcatttaccatgacttgggtagcaaggcatattcagtgcttgaataatctggtggtcataaaccc

SEQ ID NO: 149381 - DNA, 601 bp, Human
ccaccacgcccagccaatttttgtatttttggtagagatggggtttcaccgtcttggccaggctggtcttgagctcctgacctcgtgacccacctgcctcggcctcccaaagtgctgggattacaggtgtgaacaaccgcgcccggcccagtgtgttcttattcaccttatttcttaacaaccataaaaaatttccaccttcctgtgaggagtcctgtgactcttcccccctacccttcatcattctcttgttaattaacctaatgtttgtattagcatctgtaagactcatgaggggaarctgagcaagtacatctcataaggcttcttgaactatctctcgattttgtggcaacaaggttaaatggggcatccacattaaaggggcgcccctaatcgcatcatttaccatgacttgggtagcaaggcatattcagtgcttgaataatctggtggtcataaacccaggccccacatggcatgaatacaaagtgtatcagctgtttcagcttgacatttataggtggagtcaggcagtcccccttcttccaacattcaaaaccaaagacactgctcctaaattactctcacagtgcatttt

SEQ ID NO: 149382 - DNA, 601 bp, Human
cataagcctactatccaaagattaatgcttttcaactatttggtgtgtggtatgtatccttagatacttgctttctatgcatataattttcttacaaaaatagttttactattcacacctgctttttttaagttacatatgtcgctgtacatcattattaattacataacatttcaagatataaatgtataataacttactgaatttttcttctgaggttgggcatttatgttgcacatataggccgggcacggtggctcacacctgtaatgccagcactttgggaggccgaagcgggtgyatcacctgaggtcaggagttcgagactagcctggccaacatggtgaaaccttgtgtctattaaaaatacaaaattagccgggtgtggtggtgcacgcctgtaatcccagctacttgggagctgaggcaggagaatcacttgaacccaggaggcagaggttgcagtgagtggagactgcaccattgcactctagcctgggcaaaaagagcgaaactccactcaaaaaaataaaataaaaatatgttggacatatgtggaaaaatcaaatattcaagaaacaggctgtgctgtttttaatag

SEQ ID NO: 149383 - DNA, 601 bp, Human
taataatgtatatgtagacacattgctttttcaaataagatcaaaaattgcagaaatgtaaacatgaagtcattactcatttaatttgacttcccagagataaccaccattaacatttggtgtggatctattttcaggcctttttctctatggatttaggaaaaattttagtgaagtctgtggtttcatatttttttatattacacatatctctgcaactttaatttttctcctttatatttcttgaaagtcttttgaagtcatctatagagattaaactccagcctgccccccctccaacacacacacacacacacacacacacacacacacacacacacacacactcacatctatcccttctgcaggttggtaacattggagctttgtaatttacctgccaagggactttgggaatttattccttggttcattcaaaataagtcaatttgactgagtgcatgccatatgcaaggctctggggaaactaagctgcttatgacctgagcttagagtccagtgaggaagcctggagtatgcatttgtcatggtggtaaaatcgtgcagtggcagcatggatgttgctatggaagcagaggaa

SEQ ID NO: 149384 - DNA, 601 bp, Human
ggcatgttttgttctttttcatttctttctgtgcttatccaaaaaaataaatacaatgtcagcagacaaccagtgaaaggctacagagtcacactggtaccataagggaagacttcttttaactgtatgtagtttcatttttcaactcggaatacgaacttttggcaccattctatatcaaatttaattttaacttcccttaatggacattgcttcagagtctgaggcaaactggatgtccacgaactatgccagagtcaccagtgtctgtgccgacctcaatctccagctcagcatatgrtagcgtaagaattgattgagcccgataaattgcaggctgtttctctttctatcaaatactattaccgtttcttgtgggagagagagaaacgtaggttagaaatagccaactagtcccattatgtatgtgtttgcatttaacataagggctaaattagactttgttctctctcttcctttagttcatgcattaggcaatccacaaattgtgtgacactaaattaaaaccttgacctgtgcacctatgggggaacaagtacaatattaagtaaggaaatttcctttaagagagatggggaga

SEQ ID NO: 149385 - DNA, 601 bp, Human
cgatggggtattggatttgaacaaggcagcagaagtgctaaaagtgcaaaagagaaggatttatgatatcaccaacgttctggaaggcatccacctcattaagaagaagtctaaaaacaacgtccaatggatgtgagtaggagtcctccccatgccccggctctgagggggtcgtttcaaactgcctggtttcttagttcctcactttcacatccacgcccacacgttcttttcttttctctcctactgttttcttctctctcattctctcttccctcctcagcttctaagccagaagttygaagtctctttacaaagagactttgtttagatactgtcagagataaaaggatttatatttgatgagcatccagcaacggcatccttaaagaggtccctgcagttggaaagtggactgctgttcatctgttacatagatgtctgtgtgcacccacgtgtgtatctgacagatgtgtacacgtcttcagcttgtttctaataagaatctggaaatgatggcttatgggttatctatgtgtatacgtacaactgcatagttacagaatatctttatccatggttctaatagcagattaactca

SEQ ID NO: 149386 - DNA, 601 bp, Human
caccctggacctcaaactgttaaccgaggattcagagaatcaaagatatcctttgtgccgccagttctctgggggttagtgcttcctagactatttccagagttgacaatctgacttatgcacaaggtagattattattctgatgtcatgcaaatgagtacctgtgtgcctgtgtgtgtatgtgtgtgtgtgtgcacgtgtgtgtgtaaacccagttagctttgcctaaaaagtcagtatttatggtaagatagtcaccaactcgatcctattattatctattttgataccaggtgggaaytgttttttaaagcattttttcatgtgtggttgagacatgggtatactcgtagcgtaaggccacactattaaaagatacataaggtgtcggtattaatattaatgacaacactaagcagattcgtctttggcttcccagatttttggtgggtgttagctgtcactgttggggttctcacattctattttcttctcaccagatatcgtagcaattgaaattggttgaatctatctgattgggctatagttgaagggtttgaaagagtagagaaaaatcatactataactcttaaagtgcatt

SEQ ID NO: 149387 - DNA, 601 bp, Human
attggtttgttacttgctgttttatcctaggaattttttgtgggtacatataaaaaataataacgggctaaagacattgtacattaattgaatacttttgtcatatcgtaagtaccatattctttcatgatagccttttaggcttggctgtcaggacatttaaaagaatggttcagtgcttagaaaaaatgaccaaggccgggcgccgtggctcacacctgtaatcccagcactttgggaggccggaggcaggcagatcacttgagtccaggagttcaagaccagcctgggcaacagggtraaaccccatctctactaaaaataaaaaaaattagccgggtgtggtggtgcacgcctgtagtcccatctgtttgggaggctgaggcacgagaatcatttaaccccagagacggaggttgcagtgagctgagattgggccactgaactccagcctgggtgacagagcaagattctgtctcaaaaagaaaaaggaaataactaccaagagtactgagatattatacttttctcttttcctaaatcagtgtttctcaaattcattcaagtcgcagagcacctggaaactgctttcttcctcatg

SEQ ID NO: 149388 - DNA, 601 bp, Human
tttgggaggccggaggcaggcagatcacttgagtccaggagttcaagaccagcctgggcaacagggtaaaaccccatctctactaaaaataaaaaaaattagccgggtgtggtggtgcacgcctgtagtcccatctgtttgggaggctgaggcacgagaatcatttaaccccagagacggaggttgcagtgagctgagattgggccactgaactccagcctgggtgacagagcaagattctgtctcaaaaagaaaaaggaaataactaccaagagtactgagatattatacttttctcttytcctaaatcagtgtttctcaaattcattcaagtcgcagagcacctggaaactgctttcttcctcatgaacactgaaatattgatagagttaatatagtatcacgcaaagcataatttttctaacagaaataatgacactcttttctgtaggcagtacataatcacaaccagcccaggtgcacttaagaaaacaagctgtctgcctgagcagtattctgagttcctccactaatgtatttgttacttatttatttacttggtggctgctgacacttgcttgtagatagaagtaactggagt

SEQ ID NO: 149389 - DNA, 601 bp, Human
ccaggagttcaagaccagcctgggcaacagggtaaaaccccatctctactaaaaataaaaaaaattagccgggtgtggtggtgcacgcctgtagtcccatctgtttgggaggctgaggcacgagaatcatttaaccccagagacggaggttgcagtgagctgagattgggccactgaactccagcctgggtgacagagcaagattctgtctcaaaaagaaaaaggaaataactaccaagagtactgagatattatacttttctcttttcctaaatcagtgtttctcaaattcattcaagtygcagagcacctggaaactgctttcttcctcatgaacactgaaatattgatagagttaatatagtatcacgcaaagcataatttttctaacagaaataatgacactcttttctgtaggcagtacataatcacaaccagcccaggtgcacttaagaaaacaagctgtctgcctgagcagtattctgagttcctccactaatgtatttgttacttatttatttacttggtggctgctgacacttgcttgtagatagaagtaactggagtttcaaaaaaattatggctaatagagattacattt

SEQ ID NO: 149390 - DNA, 601 bp, Human
ctgcaaattggaatctgccatcattcagtttgagtgacagaacactttattggagttcatggaatgcctgtgctgcaaaggaccctggcttcaagataaaatttctgaccacttagttttttattttcttatgatcatttattttaactgttctgtttctatgtttaatattttaaatagccatagtctttttagaaatgggcgggataaagctattcatttctttagttgtttagagtgtcaaccagaaatgaagattcatgggagaccctaaacatttgcacatccagaaggggagacrtacacatacttttttgagaaggagtctcgctctgtcgcccaggctggagtgcagtggcgcgatctcgtctcactgcaagctccacctcccgggttcatgccattctccggcctcagcctcccgagtagctgggactacaggcgcccgccaccacgcctggctaactttttgtatttttagtagagacggggtttcaccgtgttagccaggttggtctccatctcctgacctcatgatccacccgcctcggcctcccaaagtgctgggattacaggtgtgagccaccgcgcccggccacat

SEQ ID NO: 149391 - DNA, 601 bp, Human
tggaatgcctgtgctgcaaaggaccctggcttcaagataaaatttctgaccacttagttttttattttcttatgatcatttattttaactgttctgtttctatgtttaatattttaaatagccatagtctttttagaaatgggcgggataaagctattcatttctttagttgtttagagtgtcaaccagaaatgaagattcatgggagaccctaaacatttgcacatccagaaggggagacatacacatacttttttgagaaggagtctcgctctgtcgcccaggctggagtgcagtggcrcgatctcgtctcactgcaagctccacctcccgggttcatgccattctccggcctcagcctcccgagtagctgggactacaggcgcccgccaccacgcctggctaactttttgtatttttagtagagacggggtttcaccgtgttagccaggttggtctccatctcctgacctcatgatccacccgcctcggcctcccaaagtgctgggattacaggtgtgagccaccgcgcccggccacatatgcatacttctaagtcataaaatactttaaaatattccatgcatctattttgtcattt

SEQ ID NO: 149392 - DNA, 601 bp, Human
ccacttagttttttattttcttatgatcatttattttaactgttctgtttctatgtttaatattttaaatagccatagtctttttagaaatgggcgggataaagctattcatttctttagttgtttagagtgtcaaccagaaatgaagattcatgggagaccctaaacatttgcacatccagaaggggagacatacacatacttttttgagaaggagtctcgctctgtcgcccaggctggagtgcagtggcgcgatctcgtctcactgcaagctccacctcccgggttcatgccattctcyggcctcagcctcccgagtagctgggactacaggcgcccgccaccacgcctggctaactttttgtatttttagtagagacggggtttcaccgtgttagccaggttggtctccatctcctgacctcatgatccacccgcctcggcctcccaaagtgctgggattacaggtgtgagccaccgcgcccggccacatatgcatacttctaagtcataaaatactttaaaatattccatgcatctattttgtcattttcatcatacttatatctgaggtaattagatggaagattccttgacactc

SEQ ID NO: 149393 - DNA, 601 bp, Human
aaatgaagattcatgggagaccctaaacatttgcacatccagaaggggagacatacacatacttttttgagaaggagtctcgctctgtcgcccaggctggagtgcagtggcgcgatctcgtctcactgcaagctccacctcccgggttcatgccattctccggcctcagcctcccgagtagctgggactacaggcgcccgccaccacgcctggctaactttttgtatttttagtagagacggggtttcaccgtgttagccaggttggtctccatctcctgacctcatgatccacccgcctyggcctcccaaagtgctgggattacaggtgtgagccaccgcgcccggccacatatgcatacttctaagtcataaaatactttaaaatattccatgcatctattttgtcattttcatcatacttatatctgaggtaattagatggaagattccttgacactctttacgttagcttatgttacatatcaagatattcgaaaaattagtggccttaaagaccaaactgttatagttgtgaaagcccctccagaaacaagacttgaagtgcctgactcaatagaggtaaggagacagcgtctttg

SEQ ID NO: 149394 - DNA, 601 bp, Human
ctctcatactttctctttttcataatttgtcatcaacggttttgatcaatttgaatcactttggaaagtttatattgattatcctgtatatggtccccaccacgaacagatatataaatgttttaaagtctctccctaacttataacattttgagagatcacatggggctttgggttagctgatagactagaatattgcaagaaagtagggggcatatttttgtaattttcagatatacttggataatagaggcctagactacaactataacataaagagttgtagtaaaaagaaaatgcmtaggagataaaaagagaatgaaagttacacgcttccatctagggtagacttcttaccttaaaagataataatagctctttgacctagatgaaaaagatttttaaatgttggtatgctgcattctcttaatagatgcagttcctagcacttaagaatactattcatcagtatacagttcaacatgaaaaagtcctaccataaaggaacaataacatggagatactgaatttggaacacttaaaggaccttgtaataatttgcagaaaaagaatatatccaaagaacacaattcacctcacc

SEQ ID NO: 149395 - DNA, 601 bp, Human
tctttctctagggcaggactcagcaaactttttcattgaagtgccaggtagatagtaaatatttttggctttgcgagccgtacagcctgtgtctagactattcaactgtgcacctctgacattgtgatacgaaaacagccagaggcaataataaacaatgggaatggatgtgactctcttccaataaaactttatttacaaagccacttggtgaactggatttggcccttaggctgtggtttgctgacccctgctctagaggatgacagtctttcatagagttggactagtagggaaaaarcaagtgaaaaacgaacattgttcttactttccatttttagacaagaattactatggcttttatttctaaaagaacttctgattcgaacttctcccacttctgttcatagagcctacaaatacatttggcaagtacccaagggcccattgaggtttacttatgtccagaagagactgaaacacacagtccaatgaaaacaaacaaccaagaccacaatgggaatatccctaaacccgcttccaaaggtaaaaactccacttttgtcttttagaaactatgttaaaaatgagggtgactaga

SEQ ID NO: 149396 - DNA, 601 bp, Human
catgttttaaaagacattctgactggtttgcagaagaaaataatgatttgggaaaaacggctccttcacccacttatggagtcgcttcaggcttttgctattggcagagaatgtttccttacagcatttttgaaaaccagctaaagtgaggagcaaagctgtgaactgtcttgttggatcatcagagacacttggccacacacctttgaatcacactgcagagctcatcagagagggaaatgaaaaaggtttgaggagaaaagcctttgttggagaatttttgtcttattttcccccccartgagatggggagaggatatgggaggagaacgctaggaaagtaagtcttgccgggtgcggtggctcacacctgtaatcccagcactttgggaggccgaggcaggcagatcacgaggtcaggagatcgagactgtcctggccaacacagtgaaaccctgtctctactaaaaatacaaaaattagctgtgcgtggtggcacgtgcctgtaatccctgctactcgggaggctgaggcaggagaatcacttgaaccagggagtcggaggttgcagtgagccgagatccgccactgcactccagcc

SEQ ID NO: 149397 - DNA, 601 bp, Human
acttgggaggctgaggtgggagggtcccttgaacccagaagttcaagactgcagtgagtcatgatcacaccactgcactccagccaagagaataagaccctgtctcaaaaattaaaagggggacgggggtggcaaggaacttttttgtacctgttagcataaaaggtgatctgcatcataaagtcgtctcattgtcattatttgcggaaggtacatgcttttttctaacagcaacatatacattcttccagaaaaattcatttgatttttctaacttattttttgtttccatcaatgtttkcttttcagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaa

SEQ ID NO: 149398 - DNA, 601 bp, Human
tcgcccctcaccctcggacccttcaccgcgacccccgcgcccacccggagcagcacaacaggcggcgagtggcctccgagggcagagcccgcgagggcgggggtcgggggcgggtcgagagcggcgcagcggcggccggccacgtcgggtcagtgccccactcccaccgcaggacacacgcccagtacctttgtagtgcacccgcaggttgttctgagagaggccgatgtagctgaacttgtccttcgggctccaggaccgaggcagcggcgtctcttgttcgtccacggccgggtagagrcgcttcagccgccgctgcaactccttctcctgctcgttcagggccgagtccccgtgagggaagggggccgcggcgctgctgcccgccaccagagctggggtcggggctcctccagccgggccggggcccgctgcaaggcccgggggagcgggcggcccgctggcgggggcagccgctgaggcagggggaggcgggggcggcggcgggggcggcggggccgcggtggccgggggcggcggcggcggagggtggaggagcagggcggccgccgcggcccctaagccttcgccgcccgcaccg

SEQ ID NO: 149399 - DNA, 601 bp, Human
taggttaaataaaaattcactcttcttattctgtgattttaaagtattatctactctctatgatacttctcctttgctactgctactgctactgggacacagttgcccaccacaatcggcgtggtcctctcacaaaacacgcagaaaatcaacagtaacaacggaaaactcacacacacacacacacacacacacacacagtctacagtaacaagacaagaggaagaggcagtagaaagggaaaaagactttctgacaaggggtaagagagagacaaaggaaagatagaagagaggaaaartaaaaggataacaacaaaatctgttcttccagaaataatgatttatgtttataaaacagttatgttcccagaaagtgaaccttagtattacacaacagaaagtaataaagaggccaagaataaaaacaactgagacagcagtgtcagaaatattccaaactccaactaatttcatataaacgtgtatttttctctgacctaatcatcaattttatgtaaaagactaaaactaatcaagacaccttacagtactaaataaacagtaatcacgaatcttagacatcacggaaattcagagct

SEQ ID NO: 149400 - DNA, 601 bp, Human
atcattcttttgaaattctgtaatacgtgaatatatgaatagtagtttttactgttaaaagtgtctcatgatacttaggtaaaaccaatgcagcacaatgataggttaaataaaaattcactcttcttattctgtgattttaaagtattatctactctctatgatacttctcctttgctactgctactgctactgggacacagttgcccaccacaatcggcgtggtcctctcacaaaacacgcagaaaatcaacagtaacaacggaaaactcacacacacacacacacacacacacacacagtctacagtaacaagacaagaggaagaggcagtagaaagggaaaaagactttctgacaaggggtaagagagagacaaaggaaagatagaagagaggaaaaataaaaggataacaacaaaatctgttcttccagaaataatgatttatgtttataaaacagttatgttcccagaaagtgaaccttagtattacacaacagaaagtaataaagaggccaagaataaaaacaactgagacagcagtgtcagaaatattccaaactccaactaatttcatataaacgtgtatttttctctgacc

SEQ ID NO: 149401 - DNA, 601 bp, Human
ccaggcgtggtggcaggcgcatgtagtcccagctactggggaggctgaagcaggagaatggtctgaacccaggaggcggagcttgcagtgagcggagatcgcgccactgccctgcagcctgggcctgggcgacagagcaagactccgtctcaaaaaaaaaaaaaaaaaagaaacatttttatatcacccccgtaatgcttaacagacatttgcacttgtaagcaagcatgctgaaatatctgttcaaacttaaaaagtgcaagaaattagataagcaattatatttaggaagtgttcaagsgctaatgactgggggtacaggtgggaaagacagagtaagtataacaaaagttcaacctatcactcctgtaatcccagcactttgggaggccgaggcgagtggatcactaggtcagcagataagagaccaccttggctaacacggtgaaaccctatctctactaaaaatacaaaaaattagccgggcgtcgcggcgggcacctgtagtcccagctacttggaaggctgaggcaggaaaatggcgtgaacgcgggaggcggagcttgcagtgagccgagatggcgccactgcactccagcct

SEQ ID NO: 149402 - DNA, 601 bp, Human
agaattgcttaaacctgggatccggcctgacaaagcgagactctgttcaagaaaaaatagtaataataaccaggtaggctaatcaattttatttgttaaaatgttaaattttgtatacatttcctggaacaccataccttggactaatataatatagtattttcatttaatttatgtcgcttcagttttacctatacaaccaaattaaaacaagattgactaagaaatgacacagtggtctctaacacaatactttccaaaggaatttttaaggataattttggttatgtaggattttcagcttctatgctgacattagaagctaaacaccaggtaaaacgtaactccactatcagccgttaaaaattagaagaaaaaaaaaatcctaccttaacctccatcctcctctaggaaatgcctcatctcttccttcatctatatttctcaaggataatctctattcactatcctctctacttggtcctttcatttactctttcaacccactgaaatctggtttttgccccatcactcaattcaaactgctctccctaaagtcacaatgatctaatttccaaacgtagtggaaaactatctgtgc

SEQ ID NO: 149403 - DNA, 601 bp, Human
ttgaattctgaaagcattttgaatttcagatttgggatgctcaaacttgtaatatcagcagcaaagggcctatttctaacaatgctcatcacctgaaagtttattattacctcaaattctgtggtaaccaaaaaacaacctcatactaccaaagtttaaacttttaaaactacaaagtcttcagtattaagtgttttctatgtggctttagaagaaaacatatgtaatacttcctaattctaaggctagcaagtttagctctttttattcaaacaatctgatggaaagagtttgaataaaycattctaccctattcccactcccttccagtcgccaacatgcagccagccagtgcctttctggaaatataaatcagccgtccttctatcagtagccctcaatacaactaagattccttccaaagcctcctctttggcctaggaaaaagacacgcttcctgagcaccttgtctggtcttgctctccacctgcactttccacctcctttctgctccagccgcatcagcactatttcaattcttcacattgatcaggccagtctgtaaacatgctattccctccacctttccttcttagcctga

SEQ ID NO: 149404 - DNA, 601 bp, Human
gaaagatgaaaaccttaaacaattcaggaacatataggtttttggaatgatgtattatttctgctcctatcagttcaaatactcaataaaacgtttatcatcaccatgaacccaatatgcaaaatagcccaagttaaccacagaactcttcacactattactagttttattaagattgcagaatccaaatatggaaattgaacctagcagccttttatgcaaattaaataaaagacattatagagtacactatatttttaagaggaaaaaggctgtatgaagaacatgagagaaagatctmaattttatcaggtctaaatttgcatataacttatataatttctgtacactcttgccaaagtcctggctctttaaaccagaagcatctgtattgtatatttctaagtgaaatcttacacaattagattgaattggcaaaacagctttcttaagaatttacagttttgttctttggtatagtcttattaattaaagctgattcataaaatctcttgggccaataatagcttattgagaaatacatctaatttctaaacgtatttttttctttttaaacaacagaagtaacaccatgccactg

SEQ ID NO: 149405 - DNA, 601 bp, Human
taagaaaactgaggcagttacataaaaagctgtcactgaattccaagtttttattttctgttgctcatactgttgacatcgagaatattcagccgataaaggagtaatctactgaatacacttatttggttaattaaacacaggaggaccactaagaggggtttgatttgaggtccatctgactgacctcacagggcaacttatccacacagctcaataagctttgtcttggtaactcaactaaagaccctatgactgctttaagagacctctgatatgcaataaagttatcaggaaatactataggatagatccaatgattctaggtaattagtgcttaaccagggataggcaccaaaattcagtgtggagctttctcaaaatgcctatcttgcccaaagctctacttctgaaaatcctaatttaggaacttttggggtaaggcccaaaaattactatatttttaatagtctcataagtgaattctgatacccatacaaaccacacaccaatcccaagctgaaaagcaatgatataaaatttggttccaggccctaccatggaattctcatttggaaatttctaaaccacatcctaaacc

SEQ ID NO: 149406 - DNA, 601 bp, Human
cataataaattataattctaaaaactttcaaataaaaattttgttctctctcacatttagaattaactgtatgtccactgcctctattaatatgcataatttaaaatttgaatgaaatccctgaactgaaagtacctaagatacagactccttaaagaaattcatctcaacggtcaatgatcactaaaaagaagggaaagtaaacacacacccgttaaatatatgccctaaagaagttatgcagggccaggcatggtggctcacgtctgtaatcccaacactttgggaggccgaggtgggkggatcattttgaggtcaggagttcaagaccggcctggccaacatggtgaaaccccatctctcctgaaaatacaaaaattagctgggtgcggtggggcatacctgtaatcccagctactaggacagactaagacaagagaattccttgaacccaggagacagaggttgcagtgagccaagattgtgccactgaactccaacctgggtgacagagactccgtctcaaaaaaaaaaaaaaaaaaagtcatgtagataaagtgatttaatttttcttgtgaaatgcattagattttatttttaa

SEQ ID NO: 149407 - DNA, 601 bp, Human
tcctcagcatatacatacaacaaggtctctcccacccaaacataaattgcaataatttttccggagagtaatttggccatgtgcatcataagccttaaaaatgtgcataccccttcttgtgatccataattccacttcaagaaatctttcctacggaaataaagacaaatttcatgcaaaaaagagtatttagaatagtgaaagaattaaaacaatctaaataactggcaacaggagaacagctatggatgtgccttaataaacttagactatgccacagccaaaaataaaaagatattcmgagcttttaatctcatagaagaatgcttataattatgtaagaaacatactataactgctacatagaaataaatcaataataatcctctacaaaaaaattcaaaaataagccaggcataggatacatctctgtagtcctagctactcgagtggctgaggcaggaggatcacttgaacccaacagtttacagtgagctatggttacagtgagctatgaatgcgccactgcactacagcctgggcaacagagaaataccctgtctccccaaaaatactaaataaatcaatgataaacacagga

SEQ ID NO: 149408 - DNA, 601 bp, Human
tgttatatgctcataaaatatagatataaaacaattaacaaaaaagagaatttacagaaaaagcaatgacctactgatacactcaactacctggatgagtatcacatgcatcatgctaagtgattacaaaatagccattttcaaaaggttacatttatataacattctggcttcaaaaggcaaaactatagggacagaagacagatcagtggttgtgaggagttgggggtgggaggagggtttgagataaaggggcaacaagagagagtttggcgtggttgttatgtaattttagttgtgtttgttatgtaattctatttgtcaaaactcacaactatacactgaaaaaaatgtattttactgcacattaatcaataatacattttaagtgcaaaaaacccacagacactggggaaagggaagaaaaggtgctgaagaggttactagctaatttcattattgctcacaatacaagagtaccttaaaaggaggggactataggtattagtataaatgtacctctctcaatgtaaaaatatactaaacctctcaaaaaaaaaagagcaaacaaaatagataaaataaaaaaattcaaaagcaa

SEQ ID NO: 149409 - DNA, 601 bp, Human
aacatgagccagggattttacatacaatcaaagcttcaaatataatgagtataatggtcacaagcaaatagtttgaaccaaaaggacttaaaagaatattgttcccatgagctcacttgtagaatgtgagcttcagataaccaaaaaatcctcgaagtatctttgggataaggtctgatgatgagtattgaatataatttaaaattaacactaagtgatcagaataaagataacagtatagtgtatgcaaatgttatatgctcataaaatatagatataaaacaattaacaaaaaagagartttacagaaaaagcaatgacctactgatacactcaactacctggatgagtatcacatgcatcatgctaagtgattacaaaatagccattttcaaaaggttacatttatataacattctggcttcaaaaggcaaaactatagggacagaagacagatcagtggttgtgaggagttgggggtgggaggagggtttgagataaaggggcaacaagagagagtttggcgtggttgttatgtaattttagttgtggttgttatgtaattctatttgtcaaaactcacaactatacactgaaaaaa

SEQ ID NO: 149410 - DNA, 601 bp, Human
ttcatgcgtgtaatcccagcactttgggaagctgaggtgggaagatcatcacttgagcccaggagttcaagacaagcctgagcaacacaatgggaccctgtcccaacaaaaataaaaataaaaataaaaaataaagttagctgagcatagtggtgcgcacctgtactcccagctactcaggaggctgaggcgggaggatcgcttggccccaggaggttgaggctgcagtgagccatgattgtgccacagccctccaacctgggcaactaagtgagagtctgtctcggaaaaaaaaaaaaaagaaagaaagaaaacatgagccagggattttacatacaatcaaagcttcaaatataatgagtataatggtcacaagcaaatagtttgaaccaaaaggacttaaaagaatattgttcccatgagctcacttgtagaatgtgagcttcagataaccaaaaaatcctcgaagtatctttgggataaggtctgatgatgagtattgaatataatttaaaattaacactaagtgatcagaataaagataacagtatagtgtatgcaaatgttatatgctcataaaatatagatataaaacaattaa

SEQ ID NO: 149411 - DNA, 601 bp, Human
aaaatataaatatacaatacctaaaattaaggcctggctatatttactaagatggccttcaaagtacctattcatttatcctgccttttaataattaagacaataaggctctaaaaacaagaaaagcctattagtttgagagttcctctgacgattctttgtcgaataattccatctgtagttaactactacaacaacaacaaaacacaaaataacttgttaaactgttaaatgttaaggaaaataatctatcatatgcataaaacaacatattctacttttcacccaacagacacaaaaytgtttatgtttccaataaactgacatttttggttaataaaattatttatattttaatccatatttaaaatcttgtttttcaacatatccctataagattaataaataaaaagtagcaactttaaatcacacaaataagttcagaagaaactgatttacatttcaattctataaacattacaggttctacttgtaccaaatgagatgtacctataaaactatggagactgagatgcgttttactgttttgtttttcaataatatttctcttcacaagtgctataacttaaaaattacactg

SEQ ID NO: 149412 - DNA, 601 bp, Human
cactgcatttaaaacatgtttcttatttactatattttattatgttttggctttttaaaagcttgctggccagggctagtgctttcttagagataagagggctcacaggagcatgtcttccatatacaaaccaaccaatcctgagtctacagccaaatccacctccttatctaacgctcacatacgaagccagtatttcctgccctaaatcattccagagtcaggtaccaggcaattagagaccacctctacagctcaaagcctggaggaatcatccaaactcttcaatcctcaactgttyactctgccctcccttgcctttcccaggaaatcccaatactctggcctggacttttccgtggctcctgtcttctgcttcctgactaaaacctggtgcttcccctgtgtagcatgcagtgaccctccctgagacctgtgagtataataaaattcttccttctaagccttattctcatatccccctgcagctacccagactttaccacaccgtatccaacacctacattcttagaatagccactattaatatacaaaataaatttaagtatatgcatgctcaaaatattgcaaagtgaaatat

SEQ ID NO: 149413 - DNA, 601 bp, Human
aaggtttacgaaggaaatgggattggaagcacagcatgcaaaaatgtcagtaacacatttttgaaaagataagaacccaataaaaacaattttacaccaattaaattattaaggaataggccaggcacagtggctcatgcctgtaatcccaaaggaaaacaaaactgggaggccatggtgagagaagcgcttgagtccaggagttcaagaccagcctgggaccccgtctctccaaaaaaaaaaaaaaaaaaaaaaaaaaagattggcagggtggtgcattgcctgtagtcccagctactcsggaggatcacttgagcctgagaggtcgaggctgcagtaagacatgatggtactactgcactccagtctgggtgacagaggccttgtctcaaaacaacaacaacaacaaaaaattgttatggaataaatactacaagaaagtgagtattttaccttgaaaaacacctaagtttatgcctgggaaatgggtgtcataagagttaccacttgtgagttactgtgaagtgatgaaaggagggttatctgacaaagggaaatttgtaataccagttgtggctgggtgtggctcatgacacacagt

SEQ ID NO: 149414 - DNA, 601 bp, Human
attttaaaaaaacataaaaataagtatatttaggaatatactaaaagaaaaaaacataatcactaagatataaggacagtggtgtaccaatatttgctgagataatttagatagtaattttccagaattgaaaaacatgttgttgaactgaaaatacacactacatactgaggaagataaaaattaagtcacacataagacacactgtagaatatcaatcacgggcataatcttaaaagctaccagaaagaaaagcagattacctagcaagaaatggcaattagactgacttcagacttcyccccagcaacaactgatgacgaaaaacaatggcacaatatgttcaaagtattgaaagtaaagtaactgtctacctagaacttaggtcccaggtaatgcagcaagaatgagggaaaaaataagatattttaagacacataaaagctaatggtttactatacacagactgtcacaaaagaactatctgacgacatactttagcagcagggagacaagtgaaaatagaagaaaagcatggacaaggaaacaatcagcacagaaaatgacaaaatatatcactaaaagtcattatcaatttaaa

SEQ ID NO: 149415 - DNA, 601 bp, Human
aattttattacaatttattatgtaacaacaacgggcaatattaagtaccagtaatactcagacttcacagcaaactcatatggtaataattcataaatacacacaaagcattaatatacagctatgcactctactgacacctataaaaaatctcgccaacttatttacagataaatgtttgggattaagatttctcacaaaaaaagcacagagggattgcagaaggaaaaaaaatgttaaggaaacaaatgtgtttcccaagggacacagtacaaatttagaccccacacacacacacatacacacacacacacacacacacacacacacacacggaaatatggattcatatttggaaaaaatttcaaactcacataaaaatatcttaataaaattaccccaaggtatgtattttctatactagctttctaaaactgagcaaactgacaaaatctacctaaacagagggttctttattatcaatttataaagttagaacaaaacagtctccacacaatacacaagggaagattattaaggtattcaattatttttcaagtgcttataaaacattaacaacaaaacctgataaatatagttc

SEQ ID NO: 149416 - DNA, 601 bp, Human
aaattttattacaatttattatgtaacaacaacgggcaatattaagtaccagtaatactcagacttcacagcaaactcatatggtaataattcataaatacacacaaagcattaatatacagctatgcactctactgacacctataaaaaatctcgccaacttatttacagataaatgtttgggattaagatttctcacaaaaaaagcacagagggattgcagaaggaaaaaaaatgttaaggaaacaaatgtgtttcccaagggacacagtacaaatttagaccccacacacacacacayacacacacacacacacacacacacacacacacacggaaatatggattcatatttggaaaaaatttcaaactcacataaaaatatcttaataaaattaccccaaggtatgtattttctatactagctttctaaaactgagcaaactgacaaaatctacctaaacagagggttctttattatcaatttataaagttagaacaaaacagtctccacacaatacacaagggaagattattaaggtattcaattatttttcaagtgcttataaaacattaacaacaaaacctgataaatatagtt

SEQ ID NO: 149417 - DNA, 601 bp, Human
taaggtagcaacaaaaattttattacaatttattatgtaacaacaacgggcaatattaagtaccagtaatactcagacttcacagcaaactcatatggtaataattcataaatacacacaaagcattaatatacagctatgcactctactgacacctataaaaaatctcgccaacttatttacagataaatgtttgggattaagatttctcacaaaaaaagcacagagggattgcagaaggaaaaaaaatgttaaggaaacaaatgtgtttcccaagggacacagtacaaatttagaccccacacacacacacatacacacacacacacacacacacacacacacacacggaaatatggattcatatttggaaaaaatttcaaactcacataaaaatatcttaataaaattaccccaaggtatgtattttctatactagctttctaaaactgagcaaactgacaaaatctacctaaacagagggttctttattatcaatttataaagttagaacaaaacagtctccacacaatacacaagggaagattattaaggtattcaattatttttcaagtgcttataaaacattaacaacaaaacc

SEQ ID NO: 149418 - DNA, 601 bp, Human
ctaaggtagcaacaaaaattttattacaatttattatgtaacaacaacgggcaatattaagtaccagtaatactcagacttcacagcaaactcatatggtaataattcataaatacacacaaagcattaatatacagctatgcactctactgacacctataaaaaatctcgccaacttatttacagataaatgtttgggattaagatttctcacaaaaaaagcacagagggattgcagaaggaaaaaaaatgttaaggaaacaaatgtgtttcccaagggacacagtacaaatttagaccmcacacacacacacatacacacacacacacacacacacacacacacacacggaaatatggattcatatttggaaaaaatttcaaactcacataaaaatatcttaataaaattaccccaaggtatgtattttctatactagctttctaaaactgagcaaactgacaaaatctacctaaacagagggttctttattatcaatttataaagttagaacaaaacagtctccacacaatacacaagggaagattattaaggtattcaattatttttcaagtgcttataaaacattaacaacaaaac

SEQ ID NO: 149419 - DNA, 601 bp, Human
tttcaaaacatctctgaaaactggaatgcattttataattgatgacaccttactatggtcaggcagctgtcatgacacagctgtcaatgcctgcacaggagcgatttgttaaagaatgagctcactgaaaaactcttgggactgagttgcttttcctgatgaaattttcattttcgtgatattggttaacatcatgaaagtgacagtatcaaacgtgcacgatgtaatcagcagcttggagattaatcccagagacataataagagtaatcttaaaaaatgttcttgatgacggagaagayagtatcacatagaaaatcatgggcatcagcctcggcaacctggcgaaaccccgtctctaccaaaaatacaaaaaatcagtcgggcatgctggcgtgcacctgtggtcccagctacttgggagtctgaggtaggaggatcccttgagcctgggaagcagaggttgcagtgagccaagatcacaccactgcactccaacctgggtgacagagtgagatcaaagaaaatcatggcatccagtctttaaaaaactgatttaaaaggttagactctgaacatgaaattttaggaataccttaatc

SEQ ID NO: 149420 - DNA, 601 bp, Human
aaaaggaaacctaaaaccaccactgtacccattgttacaacaaagttgcacatgatcattggctacctgagggaaaaaacataactggtgattcaaaagtgggagagaaaataaacaacatgtctacaagcaaccaagctttttccaaatgatctccgctatctatgaacaagaaaacgaaagctaacaacaacaaaagctcacgctgactagttgcttagtgccacaacagaaaaaaaaaaaaaaaaaaaagtcactaaactctttaaccaactccaaatgaaacttacagcattctcascagtctcttaactgttaaagaccaaatcaacccactaaccagaatctgcacctacacactctgcctgtccccacaatgctcttctcaaaagcccatcccctcaattacacatctgtctacctctttctatgcgacaccgacattttcatcagcatactcaatctcctaacttaatttttttttctactgcccccacttccaccactggctactactccatttctttactcctcaccatggccaaagtcctccagagttatccactgcctataactcacctattcctaaaatccattccaa

SEQ ID NO: 149421 - DNA, 601 bp, Human
agaagatttacagtattaaaaatgaaaaatactacactaaaaggaaacctaaaaccaccactgtacccattgttacaacaaagttgcacatgatcattggctacctgagggaaaaaacataactggtgattcaaaagtgggagagaaaataaacaacatgtctacaagcaaccaagctttttccaaatgatctccgctatctatgaacaagaaaacgaaagctaacaacaacaaaagctcacgctgactagttgcttagtgccacaacagaaaaaaaaaaaaaaaaaaaagtcactaaacyctttaaccaactccaaatgaaacttacagcattctcaccagtctcttaactgttaaagaccaaatcaacccactaaccagaatctgcacctacacactctgcctgtccccacaatgctcttctcaaaagcccatcccctcaattacacatctgtctacctctttctatgcgacaccgacattttcatcagcatactcaatctcctaacttaatttttttttctactgcccccacttccaccactggctactactccatttctttactcctcaccatggccaaagtcctccagagttatcc

SEQ ID NO: 149422 - DNA, 601 bp, Human
gcggagggagaaaagggaggaaaatgtctaagaaacagatctgcatcttattttacccaattgttcaaattaatttaagggggaggggaccttttagaatggacttctcaagagttcatggtgaacatcaagtcagtgaagaagtgggtggaaggatcctggttataaggttaagataaatgttttctactatcttgccatgatactcagtggtaaccattttcagagcattaaaacagtgtggccccagaacaacccattctagcttcacttcgtggtgactataggattctgcatcagrgttgtctattctcaactgggctggacaaaaaaactagtgtccaatctctgtaatacagatgataatagctccagggacgaagtgtgatttcagagtcatcatcatgtctcccaatcacttccttttctaaaaaatacccccaacattttattacaattttaaagttaagaatattcaaagcaattataaggacattaaagatgaaatgtgttggaccaactgtatctgaaagtctgctattttcttgacctggattataatagtgaagaggactttttaaatttaatggtatttatttaa

SEQ ID NO: 149423 - DNA, 601 bp, Human
tacaaaggaaatatacagattttctgagacaaatggagtgtccctctgtcacccaggctggagtgcagtgacgtgatctcagctcactgcaacctctgcctccaggattcaagcaattctcctgcctcagcctcccgagtagctgggactacaggcacctgccaccatgcccagctgatttttgtatttttagtagagatggggttatcaccatgttggccaggctggtctcgaactcctgacctcgtgatccgcccaccctggcctcccaaagtgctgggattacaagcgtgagccaccrtgcccagctggaaatatacagattttcaaaaggaaaaaggtttaagattataaagaggaaaaatctaaaaataatgtcataagttaaatctcacctgaaaaatgtgcggtgcttcctttgcctgatgctaaattgtggatattcattccatggctggggctcatacttggactactaaaaggtcgaggactaacaggataactgtcttgagactttggacttcggcctcccaaacatcgtacttcactatctgtaccattcaccatttctataaactgacgcactctaaaggagaaaaga

SEQ ID NO: 149424 - DNA, 601 bp, Human
tttaagaatgttaaatgtacaaagataacatcttgggaaatgcagaattaaagagatgggcaaacagaagactgagaagcatcagaaataaatctgtggctgggcacggtagctcacacctgtaagcccagcactttgggaggctgaggcaggagcagtgcttgaggccaggagtttgagaccagcatcagaaacattgcgagactccaactctttaaaaagaaacaaaaacaaaaccaaaaaaacctgtagaagtgatgtcacaaaagccaagaaaggagagaattttaattaagagaargcccaaagtcacagagagtaagactggtgagccaacaaacggatgggagaaaacgaactaggcagagctgacttttgcaagaggcttggttgggaaaggttgggggtggggggagaggagggaggcagcggcagcccagctagatgtggtaaccagtggcataaggtatcacagccacatcacctttaaatttatattttattaaaacacacaattaccttttcactattaaaaatcaataatttaattctggtgactactcattgtgaatgctgactttcatttaggaaggtctgctaa

SEQ ID NO: 149425 - DNA, 601 bp, Human
ttaattcaaataatgtcacttcatgaacttttaggtttcataaatattaaacctgagtatatcaagggtcatagtacactgactgagatatcatctttcaaacctcttcaaagtgagacaccctacctagcagaatgtttggtgcccaacaaatcctcaaaaccatcctcacaccaatgtttactaaatgacttaaccatctgctatatgcaagctacttaaaggcaggctttcaaaaaagattatttgtaaagttagttttgaacttggaaaacattctacacatttacaccaaaaaaaactcacacacagagaaaaaatcagttgtaaatttatcttatgtcaccgttcaaggttaaatatgctactgtgtcttaaccactgtgaaaacataacaaatggcatttatgtgatcatttgtatagctctgtggctggcaggaagacaatgcatgaagccctgaatttgtccttataactttactagagggaagaaggtagtagagaagaggaagaaactaaggaaagagctcatgtgcataataggagactaaaaagctttggggaactgactccctacgcttttattctctgggggctta

SEQ ID NO: 149426 - DNA, 601 bp, Human
caaaaaccactatgcgtaataccaccagaggtaacaaattctaacaccttgggggtgtgtgtgtgcatgcatacactcctgttagtaaaattgttaaggtaaaaaaaaaaaaaacaagagatctagggaaaagggggatatggccctacgactccagagcagacttactcaaccaggaaagcttgtttataatcttaacaaacttcgaaaattggtaagaaaaaccaaactttaagaataagaaaatccttaccatcacagctttcagtggctttttaaaaaatactaaactttttttttytttttgataactcagtttagtatttggaaggaactcgttcatttaacacacatttaagagcctctgaggtatgatccctgttaggtgctaaggatattatgaaacagcctctgccttcctgtagcaaacaacctataaaaagctaattaagttattatattacagagtaattatgatcagtactatgatggaagttaatcacaaaacatgacatatttgatgggatgtaaatcaaggaaaacatcctggaagaactgacatctgaacttgaattttctcagcctggacagaagttatact

SEQ ID NO: 149427 - DNA, 601 bp, Human
acttaaattactcttcagaaactgaggtggctgatattgaagagtaaaacaaagctgcatttctttttaaaaaacaattttagtaataccactcaatctcaaaataataagaaatctaacattgccatggaattccaacaaataaatgaaaaaatgtattccaacaaataaattttcactctccatttgatgggatagtttgctgatgggacaggcaatttactacttaagttgtctacaaaataaaattatgcatgctaatgtgtcttggagccacataatttttttgttggtggtggggtttttttttttggtgagggaggtcatacttaagcacctactatataccagggatagtactatgcaaagtcacacacgtttacgttaaactcatttaagaaatactgattagaatttgtaaaatcatctaaccatttggccttactgactatactgacataaatataagaagttctatcatctccaacctaaaatagcctagaggctcaacaccagtaagtcagtactgctgcattagtgacagcgctaaacctgagcctaagcagttcagcaagaaacactgcctgtagctgaaaggtaa

SEQ ID NO: 149428 - DNA, 601 bp, Human
gtgctctataacacatcctaggccaggcaagcatgttatgtcctacacttgtgctatgtttcagatttcagattttttcaaatgttaaaacattactaattgagcatctctcatcttaaagtccaaaatgttccaatgagcatatccttgtgtatcatgtcggcactcttaagtatcagattttggagcacttcagattttcggactagggatactcaacctgtactaactttcagtccaggtcaggaagaaacagcggcaggaatcttttgcttgccctttcctaccatacccaaacatyagtctcaaggccactgcattcatctcccctttaatttcagtcttcttccaaaatattcagaagaaaatgtttacaatgaaccaactgttaaagagctgtacatctctacaactgcaatgctgacttaagttaggagaaagcccctccaccttcaactggtacacaaaactgtggctactttactgaattagattgtatccatcctatcagctcatggacaacaatccagaagagactttaaaatgtattttaactattctggccatgaaaagtgacccaattcttcactaattcccatca

SEQ ID NO: 149429 - DNA, 601 bp, Human
acctgaccttcaacattaatcaaatctctcaatctctctctctcatgtctctgtctctctctctctctctctctctctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgatttctaaacctgttttctcttcatgttgccctcaaatcatccggccttgttctttggctacttatatataaggtgggtcagttrctcaccttatccctatctagatcaagataagtttgggaaatgagatggaagcagctcagagtattaagaaagtctctgaaagtagctggcatttgcttagaagttagaggtgcaaaatcaaagacatctatactctttaaataaagatgatacatcttcacacaattcagtatataaccaaggaatatctttgagaattggccatataatgccatcttctgagcttcatgtaaataagaatcaaacacaaagtaagctaatggagtataatcttaaattttcaaaggtatttcatcctgc

SEQ ID NO: 149430 - DNA, 601 bp, Human
agataaggaacaaagacaacaggaaaagaggaaagaagactttgaaaaaactaaaaggaaaaaggtcaagagaaacagtgtgccacctgaccttcaacattaatcaaatctctcaatctctctctctcatgtctctgtctctctctctctctctctctctctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgwtttctaaacctgttttctcttcatgttgccctcaaatcatccggccttgttctttggctacttatatataaggtgggtcagttgctcaccttatccctatctagatcaagataagtttgggaaatgagatggaagcagctcagagtattaagaaagtctctgaaagtagctggcatttgcttagaagttagaggtgcaaaatcaaagacatctatactctttaaataaagatgatacatcttcacacaattcagtatataaccaaggaatatctttgagaattggccatataatgccatc

SEQ ID NO: 149431 - DNA, 601 bp, Human
tccttgcaggctggggctgttcattcatactggactttccacagtccctacaacaatgcctctccacactgcaaaaattcaataaacagctgctcaacaaacaattcaagagttcttttgggagccactggaagacgtaggcagataaggaacaaagacaacaggaaaagaggaaagaagactttgaaaaaactaaaaggaaaaaggtcaagagaaacagtgtgccacctgaccttcaacattaatcaaatctctcaatctctctctctcatgtctctgtctctctctctctctctctctstctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgatttctaaacctgttttctcttcatgttgccctcaaatcatccggccttgttctttggctacttatatataaggtgggtcagttgctcaccttatccctatctagatcaagataagtttgggaaatgagatggaagcagctcagagtattaagaaagtc

SEQ ID NO: 149432 - DNA, 601 bp, Human
ggtccttgcaggctggggctgttcattcatactggactttccacagtccctacaacaatgcctctccacactgcaaaaattcaataaacagctgctcaacaaacaattcaagagttcttttgggagccactggaagacgtaggcagataaggaacaaagacaacaggaaaagaggaaagaagactttgaaaaaactaaaaggaaaaaggtcaagagaaacagtgtgccacctgaccttcaacattaatcaaatctctcaatctctctctctcatgtctctgtctctctctctctctctctstctctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgatttctaaacctgttttctcttcatgttgccctcaaatcatccggccttgttctttggctacttatatataaggtgggtcagttgctcaccttatccctatctagatcaagataagtttgggaaatgagatggaagcagctcagagtattaagaaag

SEQ ID NO: 149433 - DNA, 601 bp, Human
agggtccttgcaggctggggctgttcattcatactggactttccacagtccctacaacaatgcctctccacactgcaaaaattcaataaacagctgctcaacaaacaattcaagagttcttttgggagccactggaagacgtaggcagataaggaacaaagacaacaggaaaagaggaaagaagactttgaaaaaactaaaaggaaaaaggtcaagagaaacagtgtgccacctgaccttcaacattaatcaaatctctcaatctctctctctcatgtctctgtctctctctctctctctstctctctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgatttctaaacctgttttctcttcatgttgccctcaaatcatccggccttgttctttggctacttatatataaggtgggtcagttgctcaccttatccctatctagatcaagataagtttgggaaatgagatggaagcagctcagagtattaagaa

SEQ ID NO: 149434 - DNA, 601 bp, Human
aaagggtccttgcaggctggggctgttcattcatactggactttccacagtccctacaacaatgcctctccacactgcaaaaattcaataaacagctgctcaacaaacaattcaagagttcttttgggagccactggaagacgtaggcagataaggaacaaagacaacaggaaaagaggaaagaagactttgaaaaaactaaaaggaaaaaggtcaagagaaacagtgtgccacctgaccttcaacattaatcaaatctctcaatctctctctctcatgtctctgtctctctctctctctstctctctctgtgtgtgtgtgtgtgtgtgtatttgcatgaacttctgagtcacatgactcaaagtttatgcaaacctaaaaacgatgctacaattttaaaaaatgctacaattacaagtgaactgaagtgacaaaaagaagtggaatgatttctaaacctgttttctcttcatgttgccctcaaatcatccggccttgttctttggctacttatatataaggtgggtcagttgctcaccttatccctatctagatcaagataagtttgggaaatgagatggaagcagctcagagtattaag

SEQ ID NO: 149435 - DNA, 601 bp, Human
tataaatactataatcacaaacgctacagtgagctgctcataggaatggcaaccaaacgaacatcgaattagcgtttcgcacttcatgctcacccctggctaagcctcgccttttaaattgcttttctcttcctcacccaccctttttattgggtaagggcatgtagttgaatccggctaatataaatgcaaatagaatgtgacatcaaggcttgatcctgccgggtactcacaagtcatcaggaagccccttgtgcccatattcataagcatggtgggagctgtgataccagtggcttargctgctgctacccattgcaaatttagctcaagcaaaatggttgggaaccaggtaacaggggaggaccagctaggaatcctgccctctactggatcagtttgagcttctctgatattcaagctcttcactcccttacttccattttcattctctccatcaaaacctttcttgacctcttttcttcaaatgtaccctgttcccttctagcctaactcttgtgacaattattagtctatgttcttaacgttctccgattccttctacagcagccaaacgagagaatgccacccaattcctagc

SEQ ID NO: 149436 - DNA, 601 bp, Human
aatatgtaagagtatatgtgtctatagataatggtgctcaacaattaaattcccttgaagaactcaagaaactaaattgtaagaaaactggtcactttaaagattagtatcatctaataattaggtcttaatgattacctacaatataacttcaaaaagacatttatagtaaaccataattttccttacaattccagcattattactaagttacttttaccaacggagctaaatgaattttgtagaaccaatgaaaatataacacattaaccaaagaaaattcacatttatatacaaatcytaaattccggagaactacaacactgaggacactactcctattcccaaacttcagtattggtccttaacaaattaataaattttctaagggcaaagaaacagactgagtcttaaatatgaatgcttttcattgcttcctttacattcttgctgtaagagtcctggccctcattgcaagtctccctatctaaactactctttcatctactttttgtggcactgccctcatcttcctaaactagtttgaaatatgtgactaaaagtccctgaaccttgcagggccaaacagcacagcacagac

SEQ ID NO: 149437 - DNA, 601 bp, Human
ctgatatttggagtggagagtaaggaattatttcccttctggttgatcaaagtcagttgatactaactaaaactaaaaaaggcaccaggttttcattacaagtttccactgatgggttcttccacctctgtggataggaccaaacaggctgcctagccatctccaaggcatatataggtaatgttatttgggctggtggggagtaagtggtggtggtgacagtgagagaacatacagcagagccaccccacagttttggaggtgctaatttacagtggacagttcagacatttaaaaaaaygccaataaattttcagggtcctgcatatcataagtttctttgtcagacatttgtagtacaaatgcaataattaacaaaatttgttccttgccagagatggaaaaaaatgaactaatggtaaaagtggccagactcagaagctggtaatttctctttatgagaaggcaatgtccaaactaatcaataaaattactaatcagttctttataggcacagttgacaacaaagggcaaaaacagttgacacatggctaggaaggcttcatatggtttaactccactcttggttcagaggatgcaa

SEQ ID NO: 149438 - DNA, 601 bp, Human
gccaagccccacccctggacaagtcccacccccttcccagaggctgagggggccggagcccagagcacccagcagttgtcatggagacagctggagccggctccggtaacccctggcaaccaggctgctgccaagaagatcagctttggaacacccggcagcccctccacccatttctgaggaagggcgagcctcgaaatggggcgagcaccccacccaaggggctggggagggcccccggggctcggccctggtagtctaccagccgccacatcctcctgtcccgcaggggtgggggacsgcttgccctcctgggtctcgggcttcccagctggaaactgggaagaaggcaggggcaacaagcaggataaagaccactgcggacccagggaggggccctggacagccctgtctccccctcccacagtaggggtgtggctggggtctctccctcatgtgggtgatatggggacgggagtggggagagtggcagtcagacaacatcccatcatcgacctcacaagggccagcctcttcccggccagcagagaaaggcccctttgttggcgctgggcacattgtccctgcaccctccagccag

SEQ ID NO: 149439 - DNA, 601 bp, Human
ggtgggatgattgcttgagcccaggaggtccaggctgcagtgagctgtgatcgtgccactgtactccagcctgagcaacagagtaagaccgcgtctggggaaaaaaaaaaaaaaaaaaaagcagctaaaggcaagtccatgcccaaaatgttaagagaggctgggcgtggtggctcatgcctgtaatcctgacactttgggaggctgaggcgggcggatcacctgaggtcaggagtttgagaccagcctggccaacatggtgaaacctcgtctctactaaaaatacaaaaattagccgagkgtggtggcgcgtgcctataattccagctacttaggaggctgaggcaggagaatcgcttgaacctgggaggtggagattgcagtgagccgagatcgtgccattgcactccagactgggtgacagagtgagactgtctcaaaaaaaaaaaaaaaagttatgagagttcgatcatgggtcatccgtctagaaggaaaactgagcaacagctaacacctcccctctaggggatcaaggtgtgttacatgggaaaactggccccatgggtggcacatccactgtacactctgggctccgtgccac

SEQ ID NO: 149440 - DNA, 601 bp, Human
cgaggtggctcatgcctgtaatcccaccactttgggaggctgaggtgggaggactgcttgaggccaggagttcaagaccagcctggccaacatagtgagaccccatctctaccaaaaaacacaaaaaaattcgctgggggtggtggcacacacctgtggtcccagctactcagaaggctgaggtgggatgattgcttgagcccaggaggtccaggctgcagtgagctgtgatcgtgccactgtactccagcctgagcaacagagtaagaccgcgtctggggaaaaaaaaaaaaaaaaaaaagcagctaaaggcaagtccatgcccaaaatgttaagagaggctgggcgtggtggctcatgcctgtaatcctgacactttgggaggctgaggcgggcggatcacctgaggtcaggagtttgagaccagcctggccaacatggtgaaacctcgtctctactaaaaatacaaaaattagccgagggtggtggcgcgtgcctataattccagctacttaggaggctgaggcaggagaatcgcttgaacctgggaggtggagattgcagtgagccgagatcgtgccattgcactccagactgggtg

SEQ ID NO: 149441 - DNA, 601 bp, Human
gcagtgagctgagatggtgccaccgcactccagcctgggtgacagagcgagactccatctcaaaaaaaaaattagctgggtgtggtggctcgtgcctgtaatcccagccactcatgaggctgaggcaggagaatcccttgaacccaggaggcaaaggttccagtgagctgagatcacaccaccacactccagcctgggcgacagagtgagaccctgtctcttaaaaaaaaaaaaaaaaaaaaaaaaaaacaggctaggtgcggtggctcatgcctgtaatcccagcactttgggaggccargggaggcagatcacctgaagtcgggagttcaagaccagcctgaccaacatggtgaaaccctgtctctactaaaaatacaaaattagccgggtgtggtagtacatgcctgtgatcccagctactccggaggctgaggcaggagaattgcttgaacccaggaggcagaggctgtggtgagccaagatcgtggcattgtactccagcctgggcaacaagagcgaaactctgtctcaaaaaaacaaacaacaaacaaacaaaaaaccctcccctattccagaatttctttctttcttttttttt

SEQ ID NO: 149442 - DNA, 601 bp, Human
aaaaaaaaaaaaaaaattgtgttaagatttatatggcaaaaacttaccatctaagccatttgttaagtacacattattgtgcaaccatcaccagcagccatctccagaacattctccttcttccccaatggaacagtcctctgtccccattaaacagtctctccccattcccctcccccagccctggcaccccccatcccactttctgtctctatgagtgggatgactgtaggaacctcatataagtggaatcacatagtatttgtctttttgtgattggctaaaatgcctaatttcaagytacatacattttacctcaataagaaatggaggccaactgaggtggctcacgcctgtaatcccaccactttgggaggccaaggtgggtggatcacttgaggtcagaagttcaagaccagcctggccaacatggtgaaaccccagctctactaaaatactaaaattagccagacatggtgatacacacctgtagtcccagctattcgggaggctgaggcaggagaatcgcttgaacctgggaggcagaggttgcagtgagctgagatggtgccaccgcactccagcctgggtgacagagcga

SEQ ID NO: 149443 - DNA, 601 bp, Human
cctgatctcaggtgatccacctgcctcggcctcccaaagtgctgggattacaggcgtgagccaccgtgcccggccagcagggatttttattttaggaagagttttgggtttctaggaaaattgagcagataggacagaaagttcctttctttcttctgccccaacatacccacagatttccatttccctggctttaagtggtatatttgctacaaatgctgaactaatatagacacattattatcattatatacatttaaaatgttttatatatagttttagagttggcttgctctgtggmccatgctggagtgcagtggtgtgatcatagttcactgcagcctcgacctcctgggctcaagtgatcctcccacctcagcctcctgagtagctgggaccacaggcacccataaccatgcctagataatttatttcttttttaatttttgtgttgccatgttgcccagggtgatctcgaactcctgggctcaagcaatcctcctgccttggcctcccaaagtgctggggttacagggatgagccacctcacccagcccagcgccccttctcgttttttgttttttgtttttttttttttttg

SEQ ID NO: 149444 - DNA, 601 bp, Human
ctttgagacggagtctccctctgtcgcccaggctggagtgcagtggcatgatctcagctccacatcctgggttcaaacgattctcctgcttcagcctcctgagtagctaggactacaggtgcatgccaccaagcccggctaattttttgtatttttagtagagacggggtttcactgtgttacccaggatggtctcgatctcctgacctcatgattcacctgcctcggcctcccaaagttctgggattacaggcgtgagccaccccgcccagccgtcttttttttttttttttttttttttgagacagagtctcgttctgtcaccagactggagtgcagcggcacgatctcagctcactgcaacctccacctcccaggttcaagcaattctcctgcctcagcctccagagtagctgggattacaggcgctggacaccatgcccggctaatttttttgtatttttagtagagatgggcttttgccatgttggacagactggacttgaactcctgatctcaggtgatccacctgcctcggcctcccaaagtgctgggattacaggcgtgagccaccgtgcccggccagcagggatttttattt

SEQ ID NO: 149445 - DNA, 601 bp, Human
gggtttcaccatgttggtcccgctgatctcgaattcccaacctcatgtgacccacccgccttggcctcccgaagtgctgggattacaggtgtgagccaccgtgcccggccccattaggatcttaataagcccgaaggccatcccctgtccttccacagagtctccatctgacagatgagctgcccgagggtcctggattcaccctggacgtggggaagtgtctctcaccaagtccctgttccttgctctgtctcctgacagctcctgggctcctgccacaggtcctttgcacgtgctgtcmccatgacccagcatgccagtgcctggcattcagcacctcccttcactcctttcagtctctgctcatctgctcatctgctcatctgtcacccccagaccaactaacacctaacacctgcagccacaatttttttttggagacacagcctcactctgttgcccaggctggaatgcctcggctcacagccacctctgcctcccgggttcaagcgattctcccacctcagcctcttgagtagcttggactacaggcactcatcaccatgcccagctaatttttttatttttagcagacacaggg

SEQ ID NO: 149446 - DNA, 601 bp, Human
cgcgtcggcctcatctgctgctgggtcttgggggcctgcccacgaacacgcttggacgggtgacactaaaggagggaacgcggggtgcgggcccctccacactcactcggctttgctgggcttcaggctctgggcctcggctgtgtcatactcccgcaggtccttcagctcgtgcacctggcctgtcaacaccttggctgcaaacgccacgatgtactgcgagaggagaggggaggtgccagtgagaagaaagcccccacgccactgccctgctgacagccatgtgctcctgtcccgggcyctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagg

SEQ ID NO: 149447 - DNA, 601 bp, Human
cttcagggtactggccacatcgtccacgcctttattgcagtctctgttttggagtaggcttggggggcagcatccgcgtcggcctcatctgctgctgggtcttgggggcctgcccacgaacacgcttggacgggtgacactaaaggagggaacgcggggtgcgggcccctccacactcactcggctttgctgggcttcaggctctgggcctcggctgtgtcatactcccgcaggtccttcagctcgtgcacctggcctgtcaacaccttggctgcaaacgccacgatgtactgcgagaggrgaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcataca

SEQ ID NO: 149448 - DNA, 601 bp, Human
ggccaagcatggtggctgatacctgtaatcctagcactttgggaggccaagatgggtggatcacctgaggtcaggtgttcaagaccagcctgggccaacattgtgaaacctcatctctactaaaaaaaatacaactattagccaggtgtggtgtacacgcctgtaatcccagctactcgggaggctgaggcaggagaatcgcttgaacctggaaggcggaggttgcagtgagccgagatctcaccactgtactccagcctgggtgacagagcgagactctgtctcgaaaaaaaaaaaaaaagaagaagaaggggaggggactctctggggttagcaccaagagagccacatgggagctggacaggagtggtcttcgggatggggggaggaagatggggcacagctgggtttgaggaggacccaggaggatctaggaattctgctacaagggagggaaaacaggctgatgaggccagtgatggagaagagcagagagcacgttctctcctgggttgaaatgtccttgaataggcaagctgggtgaacatccctagcctcagagagagggactgttgtccactgtagcagcagctggacatcc

SEQ ID NO: 149449 - DNA, 601 bp, Human
gcgccttccatgaattgcaaattacaaactacagcagggtgctgctcaacaatttttgaatcaccctttgattaagttatttaatattttcgtggtgatgcccataaatttttaatagaaaaaaagggcctgggaatcccacggacaaaaagctcttcccattcgtgaacctgcaccccgaatcaggattctgccctgaccttcctcccatggtacttgcacaatctgggagagatgcggggctgcgggtccagagctgcccagagagggctccaggccaggacatggtcactgcgcaggraagagacaggccgtctggggggcccggctgtcagtgcagccgccatcttatggctgaaggggactgaggccgagctgggcaaggagaactctgggcgcagattgtggagatgactgcggagaggcctgagtcccatcaaccgcttcccaccggttccaaccaggctcgtcccttctctcgggatgtcggactcagcactttcaccatttctaggcttccagggggtcctcgtgtctcagctgtgaatgtccaatacctgcaggtcacagggccacagaggctgggcctctaaaagcagaa

SEQ ID NO: 149450 - DNA, 601 bp, Human
ttaattaaaataggtattaaaatgtatactaaatgacaaattgttgataaagtgaattagggaggggaaattggtatttgggaatgtcagacgaaactgaaaatttagtattttactgcaagccagagtcagactggaggaataggtgatgaggagtgaacttgaggccctgcttgtgacacgtgtgaaaaattcagaaaaaaaatcagtcccctgtggagtgtgaaaatcagtaagaggcaggaaattagattgaggtggctctagtccctggatttctacttcaaaaaaaaaaaaaaaatctaaactgaagagcatttattggtaaataactacattggaggaaacaaaattcaggcttaaccaactataaactgccaattaagctgattacataaccagctttaccttgattataaaaattaagaaactatgctgggcgcagtggctcacgcctgtaatcccagcactttggaaggccgaggtgggtggatcatctgaggtcaggagttccagaccagcctgaccaacatggtgaaaccctgtctctacaaaaaataaaaaaaaaaaaaatggccaaatgtggtggcgagcgcctgta

SEQ ID NO: 149451 - DNA, 601 bp, Human
cactgcactccagcctgggcaacagagcaaggctctatctcaaaagttaaaaaaaaaaaaagattaattaaaataggtattaaaatgtatactaaatgacaaattgttgataaagtgaattagggaggggaaattggtatttgggaatgtcagacgaaactgaaaatttagtattttactgcaagccagagtcagactggaggaataggtgatgaggagtgaacttgaggccctgcttgtgacacgtgtgaaaaattcagaaaaaaaatcagtcccctgtggagtgtgaaaatcagtaagwggcaggaaattagattgaggtggctctagtccctggatttctacttcaaaaaaaaaaaaaaaatctaaactgaagagcatttattggtaaataactacattggaggaaacaaaattcaggcttaaccaactataaactgccaattaagctgattacataaccagctttaccttgattataaaaattaagaaactatgctgggcgcagtggctcacgcctgtaatcccagcactttggaaggccgaggtgggtggatcatctgaggtcaggagttccagaccagcctgaccaacatggtga

SEQ ID NO: 149452 - DNA, 601 bp, Human
aaaacaaaacaaacaaacaaacaaaaaacagaatcgtttgagcccaggaagtggaggctgcagtgagcctagatgaagccactgcactccagcctgggcaacagagcaaggctctatctcaaaagttaaaaaaaaaaaaagattaattaaaataggtattaaaatgtatactaaatgacaaattgttgataaagtgaattagggaggggaaattggtatttgggaatgtcagacgaaactgaaaatttagtattttactgcaagccagagtcagactggaggaataggtgatgaggagtgracttgaggccctgcttgtgacacgtgtgaaaaattcagaaaaaaaatcagtcccctgtggagtgtgaaaatcagtaagaggcaggaaattagattgaggtggctctagtccctggatttctacttcaaaaaaaaaaaaaaaatctaaactgaagagcatttattggtaaataactacattggaggaaacaaaattcaggcttaaccaactataaactgccaattaagctgattacataaccagctttaccttgattataaaaattaagaaactatgctgggcgcagtggctcacgcctgt

SEQ ID NO: 149453 - DNA, 601 bp, Human
gccagtatagtgaaatcccgtctctaccaaaaatacaaaaattagccaggcatgctggcgagtgcctgtaattccagctacttgagagattgagacaagagaattgtgccgggcgcggtggctcatgcctgtaatcccagcactttgggaggcagaggtgggcggatcacgaggtcaggagatcgagaccatcctggctaacacagtgaaaccccgtctctactaaaaatacaaaaaattagctggggtcccagctactcgcgaggctgaggcaggagaatggcgtgaacccgggaggcgragcttgcagtgagccaagattgcgccactgcactccagcctgggcgacagagcgagactccgtgtcaaaaaaaaaaaaaaaacaaaacaaacaaacaaacaaaaaacagaatcgtttgagcccaggaagtggaggctgcagtgagcctagatgaagccactgcactccagcctgggcaacagagcaaggctctatctcaaaagttaaaaaaaaaaaaagattaattaaaataggtattaaaatgtatactaaatgacaaattgttgataaagtgaattagggaggggaaattggtatttg

SEQ ID NO: 149454 - DNA, 601 bp, Human
gttcaagaccagtctggccagtatagtgaaatcccgtctctaccaaaaatacaaaaattagccaggcatgctggcgagtgcctgtaattccagctacttgagagattgagacaagagaattgtgccgggcgcggtggctcatgcctgtaatcccagcactttgggaggcagaggtgggcggatcacgaggtcaggagatcgagaccatcctggctaacacagtgaaaccccgtctctactaaaaatacaaaaaattagctggggtcccagctactcgcgaggctgaggcaggagaatggcrtgaacccgggaggcgaagcttgcagtgagccaagattgcgccactgcactccagcctgggcgacagagcgagactccgtgtcaaaaaaaaaaaaaaaacaaaacaaacaaacaaacaaaaaacagaatcgtttgagcccaggaagtggaggctgcagtgagcctagatgaagccactgcactccagcctgggcaacagagcaaggctctatctcaaaagttaaaaaaaaaaaaagattaattaaaataggtattaaaatgtatactaaatgacaaattgttgataaagtgaattagggag

SEQ ID NO: 149455 - DNA, 601 bp, Human
agttgggttggatgaagacaatattaatgtctcaaggggttaactttgaaaaaaaaaaaaagtacaccaggaaatgcctcttagcctgagggcatccatgtgtgcacttgagaagctacactcaatacctcaggttgccctatgagcaaataagccccagggctgatattcactagagactctagcagacatagttatggtaggtattgtggtttttcccatacaatactgaaatccaggtccaagaaaaccggaagggtgactgaaaacacatcaccctataatgtttctaaaaaaaaaacttgacccaaaaacattctgataagatatctgtgtcaacggaaaatagaaggaaaaaaaacccacagagatattttacaatagtgtcagattattctttgcttaactctcataggaaatatgtacaaaaaaaatctttttaaatgtgccatcaaatgctttgtcaaaaaataattaattagccaggggcagtggctcaggtctgtaatcccagctctttgggaggcagaggcaggtggacttcttgaagccagaagttcaagaccagtctggccagtatagtgaaatcccgtctctacca

SEQ ID NO: 149456 - DNA, 601 bp, Human
aatgtattcattgtctatagctgaaattgaagagaaatttttctttgttttcttccttggtagctaccattctaaaagctagatggactgtatgaaatcactctgccataaaaacacacacctgagaaaatttctaaactcactctgagaaagaaaaaagtaagtgaaaattttcaacaaacaaaatgtattattagatattaatgtttttaagactcacctgccaggcgcggtggctcacgcctgtaatcccagcactttgggaggctgaggagggcgaatcatctgaggtcaggagttygagaccagcctgaccaacatggagaaaccctgtctttactaaaaatataaaaaattagccgggcttggcagcatatgcctgtaatcccagctactcaggaggctgaagcaagagaatcacttgaacccaggaggtggaggttgcagtgagccaagatggcaccattgcactcctgcctgggcaacaagagtgaaactgtctcaattaaaaaaaaaaaaaagactcaccttttttatgtcctttgtaaatattttcttacctttcaagctctactactaaaatgcaatatacaattaaaaa

SEQ ID NO: 149457 - DNA, 601 bp, Human
tcagacaaaatagacatgttgagttagacggtaccactcaaattttaatgtgtacaataaactggacatcttattaaggcagattattttttcaggagatctgaaataaagtctgaggtactaggctctaccaagctcaccagttatgccaatggtttggcaccaaaatactattttgtcaaacatccagtaagtggaagagcctgtgttttttttcagtttttctggcctgtaaacaaagatgagaatttcatttaccaaagaaagataaatgcaaagaaaacctttaaaaaaaaaaaaagcagctgccagattaaatgtgatggtttatgcacatcaactgcataaaaatacttaatgaagagaaaaataactctatagtgaaaaactctgtaagagagtttattaagtgagttattaacatcaactgcactaggaaaactttttatagtgtgctgatccacccagaaggacacagcatcactactgagatatggcccctactaaattactgtctgaatttaaccataagaaaacatcatttttatggaaagtacaagatacaggtatcttccatgttctacaattttttttttttttt

SEQ ID NO: 149458 - DNA, 601 bp, Human
cacaaacgttttctaaggtattctctaactatgagataagagagtggcataatatccacaacctcagtgtatatgtgatacttgtctgaatgacaaaagtgtaaaattgagggcatatcacgaacatgtacatttttgagtgctatatttacataatagagaattagttgtgtatatttttcagaagaaaaagacatagtttatatatttcagacaaaatagacatgttgagttagacggtaccactcaaattttaatgtgtacaataaactggacatcttattaaggcagattatttttycaggagatctgaaataaagtctgaggtactaggctctaccaagctcaccagttatgccaatggtttggcaccaaaatactattttgtcaaacatccagtaagtggaagagcctgtgttttttttcagtttttctggcctgtaaacaaagatgagaatttcatttaccaaagaaagataaatgcaaagaaaacctttaaaaaaaaaaaaagcagctgccagattaaatgtgatggtttatgcacatcaactgcataaaaatacttaatgaagagaaaaataactctatagtgaaaaactct

SEQ ID NO: 149459 - DNA, 601 bp, Human
aaatttttattttatattgaggaattttgtattaaagttatcctcacccaggaaggccaggtttatgtagttctctaacatcatcttcctatataaattcttctgtgcagtgtccaggtactgccactcctccagagagaattctatggccacatccctaaatgtcaacagtccctggaaaacacacacaaacacacatatttacaaagtggctatgaatagaattttttatttgacacaaggtaaaatcagaaagtgaatagaactggttctgacttaaaagaatgattgaaactatccmataaaataattgtcaacacacaaacgttttctaaggtattctctaactatgagataagagagtggcataatatccacaacctcagtgtatatgtgatacttgtctgaatgacaaaagtgtaaaattgagggcatatcacgaacatgtacatttttgagtgctatatttacataatagagaattagttgtgtatatttttcagaagaaaaagacatagtttatatatttcagacaaaatagacatgttgagttagacggtaccactcaaattttaatgtgtacaataaactggacatctta

SEQ ID NO: 149460 - DNA, 601 bp, Human
tcccaatatactaatttataacagaaatttttaaatatttagaaaatattttaattttgtaggttcttaatttcagtgcctgccactgctgaataaaaaattggtgaagcagatagattttaaggtgtgaataatattttatgccactaagcttctgaaattaccactaatctaaaatgaaggacacagatcagctcaggaatgtggaaagttcaggtcaagatgaaacatcttcaataaattttttctaaacagacaactccccaggattttcttgataacagaaatatgaaagcataaktaccagaaaacattctacaaagagaaatgaaatttttattttatattgaggaattttgtattaaagttatcctcacccaggaaggccaggtttatgtagttctctaacatcatcttcctatataaattcttctgtgcagtgtccaggtactgccactcctccagagagaattctatggccacatccctaaatgtcaacagtccctggaaaacacacacaaacacacatatttacaaagtggctatgaatagaattttttatttgacacaaggtaaaatcagaaagtgaatagaactggtt

SEQ ID NO: 149461 - DNA, 601 bp, Human
cactctcacctacctggggtttcatccaccatctcatgtcgcttcatattccagggctcttttccttgctccagacaggtgatcaggtctggcttagagaaagcaatacctgttttattaaaaatagctaacatgaattttgttcatattctccaattaccgacttagtaatgtgctcagtaaaaaggatataatagattattctaataagtttatcccaatatactaatttataacagaaatttttaaatatttagaaaatattttaattttgtaggttcttaatttcagtgcctgccaytgctgaataaaaaattggtgaagcagatagattttaaggtgtgaataatattttatgccactaagcttctgaaattaccactaatctaaaatgaaggacacagatcagctcaggaatgtggaaagttcaggtcaagatgaaacatcttcaataaattttttctaaacagacaactccccaggattttcttgataacagaaatatgaaagcataagtaccagaaaacattctacaaagagaaatgaaatttttattttatattgaggaattttgtattaaagttatcctcacccaggaagg

SEQ ID NO: 149462 - DNA, 601 bp, Human
tgtctagataactgcaatgtttgactgtaactgtgcattcatggaaggcaggcatttgaaattactggcatccattttatggcaataaaatttcagagaaaatgcagaacaatcataaatgggagatgctaatgagaaacttttaatagatttaagcatttaaaaaaactagtgccaatttttacgttttaaatatacgctatttttaaacaaaatataactactgtaatccaagtttagaagcaaagaaaatccttacactgcttttatatatatatacacatatatatgtatatatattcacatatggtcagagcctcctatataaaatgaatatttggggaataaattatgttattatttagatataggctgataaatttgttgaaaattctataattcctttttgtctgcctgcacactaattatctaatttaattcaggcacaacatgtaaattctagtatagtaccctaaatttctgaatctaaaattacagacaaatttgaagtagaaaatagaaagtaaaaatgtatatggagagtgacattaataagatttttttaaaaaggtgccctacttgcttatcccctgaaagcaag

SEQ ID NO: 149463 - DNA, 601 bp, Human
gtcatatttgcagataaaaacacacacatatatataatttgattgtgatacacatggctcatttatcttttaattaaaacttacattaacttaaagtatacaaacaactgctaattgtctaaaattataatacttaaataatagcaatagacacaataaactgatgttaacaaacttacactaaaaagcacactaactgcaagtacaactgcaagacaataataacagaaatgcttagtcataaaatctagttggcaacattaatgtacattaacaaataatttgtctagataactgcaaygtttgactgtaactgtgcattcatggaaggcaggcatttgaaattactggcatccattttatggcaataaaatttcagagaaaatgcagaacaatcataaatgggagatgctaatgagaaacttttaatagatttaagcatttaaaaaaactagtgccaatttttacgttttaaatatacgctatttttaaacaaaatataactactgtaatccaagtttagaagcaaagaaaatccttacactgcttttatatatatatacacatatatatgtatatatatacacatatggtcagagcc

SEQ ID NO: 149464 - DNA, 601 bp, Human
gttataaatgtacttcaaataattaaaaataaattatcaaatacagcaattccatttatgaatctatatctaaaatatgcaacataggaccttgaagacatgttcgatacaatgaaatattattcagccttaaaaaaaaatcttctcacatttaaagatacactctgagaatattatgtcaactgaaataagccataatgaaatgatggatgttatgatttcacttatttaagacatataaaatagtctcattcataaaaacagagtgtggaagggcggttctcaagggatggagagagtrtaaaatggataaacgttatttaatgatactgagttttagttttacaagatgtaaaatttcaagaagtcttttgcataacaatgtgaatatacatgacatgcctaaaatatacattttgtttttgtttttgttttcagactgggtctcaatctgtcacccaagattgtgtgcaatggcgcaattatggctcactgcagcctcagattcccagggtcaagtaatcctgcccctcaatctctcaagtagctgggaccacaggtgcacaccaccgtgcctagctatttcttagaaaaaaaatat

SEQ ID NO: 149465 - DNA, 601 bp, Human
aggatgcacccattattttataacgttataaatgtacttcaaataattaaaaataaattatcaaatacagcaattccatttatgaatctatatctaaaatatgcaacataggaccttgaagacatgttcgatacaatgaaatattattcagccttaaaaaaaaatcttctcacatttaaagatacactctgagaatattatgtcaactgaaataagccataatgaaatgatggatgttatgatttcacttatttaagacatataaaatagtctcattcataaaaacagagtgtggaagggyggttctcaagggatggagagagtgtaaaatggataaacgttatttaatgatactgagttttagttttacaagatgtaaaatttcaagaagtcttttgcataacaatgtgaatatacatgacatgcctaaaatatacattttgtttttgtttttgttttcagactgggtctcaatctgtcacccaagattgtgtgcaatggcgcaattatggctcactgcagcctcagattcccagggtcaagtaatcctgcccctcaatctctcaagtagctgggaccacaggtgcacaccaccgtgcct

SEQ ID NO: 149466 - DNA, 601 bp, Human
cccagcgctttgaaaggccgaggcaggcagatcacgaggtcaggtgttcaagaccagcctgatcaacatggcaaaactccatctctactaaaaatacaaaagttagccaggtgtggtggcatgcgcctgttatcccagctactcaggtgactgaggtgggagaatcacttgaaaccgggaggtggaggttacagcctaggcgacagagcaatactccatctcaaaacaaacaaacaaaacaataaagttgaataactttatttagaaataggccaataattgaaataaattttcatcaaarcatttgaaaggacacacaaaactaatttgtagagaaatgcataaaaatcacaatgaatgaaaaacaaaatcccctcacactcatttaaatggccactatcaattttttaaaaacaccaaacctgtcgatgatgcaataaaaatgaaacccttggccgcgcgtggtggctcaagcctgtaatcccagcactttgggaggccgaggcgggcaaatcatgagtcaggagttcaagaccagcctcaccaacatggtgaaaccccatcactgctaaaaatacaaagttagttgggttgattgtcg

SEQ ID NO: 149467 - DNA, 601 bp, Human
ggagaaacctagtctctactaataatacaaaattagcgaggcgtcgagacacatgcttgtaatcccaggtacttggggggatgaggcagtagaatcgcttgaacctgggaggcagaggttgcggtgagccaagatcatgccattacactacagcctgggcaacaagggggaaactccatctaaaaaatgaaatagaaaaacgaaaaaaaattctggaatatcactcagtattcaaaaagaaggaaatattctgccaactataaatataaatcttgattgcattatgcaaaatgaaatgagycagccacaaaaagagactgtatgagatatatgaaggagttacacttttagaaacaaagaacagagtgatatttgaaaagtgccataaaacagaaaaaactggggccaggcatggtggctcacacctgtaatttcagcactttgggaggccaaggcaggtggatcacctaagctcaggagtttgaaaccagcctggccaacatagcaaaactacgtctactaaaaatgcaaaaattagccaggcatggcagttggcacctgtaatcccagctactcaggaagctgaggcactaaaattgct

SEQ ID NO: 149468 - DNA, 601 bp, Human
caacaatcttcaaaaaaaagaaaaaaatgctggaggcatttaagttcttaattcaaaatacattacaaagctacagaattaaaatgatttgctattagtataaaggtaaaaaagtagacataaaatagaatgcagcacacatataaactttcacatatatggtcatataaggagtcatttacatactcataattattgcagcattgttactgtaagccaacaggtgaaagcaacccaaatttctttcaccaaatcattcagcagatgtaatttgaaatataaaaattgtgaggccaggtgyggtggctcaagcctgtaatcccagcactttgagagggtgaggcgggctgattacctgagactgagagttcaagaccagcctgaccaacatggagaaacctagtctctactaataatacaaaattagcgaggcgtcgagacacatgcttgtaatcccaggtacttggggggatgaggcagtagaatcgcttgaacctgggaggcagaggttgcggtgagccaagatcatgccattacactacagcctgggcaacaagggggaaactccatctaaaaaatgaaatagaaaaacgaaaaaaaa

SEQ ID NO: 149469 - DNA, 601 bp, Human
gttgcagttagctgaggttgcaccagtacactccagcatgtcgggaggatagagtgaggctctgtctccaaaaaataaaaattaaaaggaaacagtgatgtgccatttacaaacacagtcttacgagataatctgtgaagagttaacaaaaattttgcaggccataagggaactgtgtgatgtagtcataaaaaagttgtgagaaaaagcagctattaagtgagaataataccatcagtgaatctgttctgccaaataaaaatatagaaactttccaaaataaacaagttttaaaaaagtrtattggtactgcttatgtcctacatataaagggtgctgaaaatattttactgaaaataacatgattcaaaaaaacaccacataatcatacaaaaataattttctggaaaacatacacaaataaacaaaattagaatttctgagcattatcctagtggtgcaaaaaacatttctaattattctctgaaatttgaaagaaaaaagtatagaaataattataaatatctgttaatgaatatacaacacaaaaagacataactagcaatgtcaatgaaacttgagggaagatgaaaaagaattt

SEQ ID NO: 149470 - DNA, 601 bp, Human
aatcgcttgaacctgggaggtggaggttgcagttagctgaggttgcaccagtacactccagcatgtcgggaggatagagtgaggctctgtctccaaaaaataaaaattaaaaggaaacagtgatgtgccatttacaaacacagtcttacgagataatctgtgaagagttaacaaaaattttgcaggccataagggaactgtgtgatgtagtcataaaaaagttgtgagaaaaagcagctattaagtgagaataataccatcagtgaatctgttctgccaaataaaaatatagaaactttccaaaataaacaagttttaaaaaagtatattggtactgcttatgtcctacatataaagggtgctgaaaatattttactgaaaataacatgattcaaaaaaacaccacataatcatacaaaaataattttctggaaaacatacacaaataaacaaaattagaatttctgagcattatcctagtggtgcaaaaaacatttctaattattctctgaaatttgaaagaaaaaagtatagaaataattataaatatctgttaatgaatatacaacacaaaaagacataactagcaatgtcaatgaaa

SEQ ID NO: 149471 - DNA, 601 bp, Human
tcttatgtgtagtaagatttgaggatagactaaaagcttttctatattcttcacatttgtagggtttttcttcagtatgaattttcttatgattagtaagggttgaagaccaattaaagatttttccacgttctttacatttgtaggacttctctgtagtataaatgcttttatgctgggttttgtgtgaaagcatgcaaaatgatttgacacatttttttacatttgaaaggtttccttccagtgtgtcttatgtctgtttgaatttacaaatttataaaagactttcaaacatttaccrcattgaaatactttgctctgggtagttgtgtaacacaggttaagtccattataaccttctttgtgcaccttaagctcatccacactttgagccttttcttaactgtaaattctgatgtccacatttttcatatcttcttggtattactttttgaaaagaatcttccataccctgttctggccaaaggtcttgagcaacatgagaatgtatacctgaaaaaaaatttttataaattactccacttactagactcacatgaatatagtttaaaaatcttacctataaatttataccatctac

SEQ ID NO: 149472 - DNA, 601 bp, Human
ggatttgttaaacgttttgccacattcttcacacttataaggtttctctccaatatgaattatcttatgtgtagtaagatttgaggatagactaaaagcttttctatattcttcacatttgtagggtttttcttcagtatgaattttcttatgattagtaagggttgaagaccaattaaagatttttccacgttctttacatttgtaggacttctctgtagtataaatgcttttatgctgggttttgtgtgaaagcatgcaaaatgatttgacacatttttttacatttgaaaggtttccktccagtgtgtcttatgtctgtttgaatttacaaatttataaaagactttcaaacatttaccgcattgaaatactttgctctgggtagttgtgtaacacaggttaagtccattataaccttctttgtgcaccttaagctcatccacactttgagccttttcttaactgtaaattctgatgtccacatttttcatatcttcttggtattactttttgaaaagaatcttccataccctgttctggccaaaggtcttgagcaacatgagaatgtatacctgaaaaaaaatttttataaattact

SEQ ID NO: 149473 - DNA, 601 bp, Human
gctttgccacattcttcacatttgtagggtttctctccagtatgaatcatcttatgtgcagtaagggttgaggattgtctaaaagctttgccatactcttcacatttgtagagtttctctctagtatgcatcctcttatgtatagttagggttgaagatcggctaaatgctttgccacattcttcacatttgtagggtttctctctagtatgaattttcttatattcagtaagggttgaggaccatataaatgctttgccacattcttcacacttgtaaggtttctctccagtatggattmtcttatgtgcactaagatttgagaatcgatgaaaagttttgccacatacttcgcatttatagggtttctctgcagtgtgcattctcttatgtttagttagggttgaggaccatacatatgctttgccacattcttcacatttgtagcgtttctctccagtacgaattatcttatgtgtagtaagggttgaggattggctaaaagctttgccacattcttcacatttgtagggtttctctccagcgtgcatcctcttatgtttagttaggtttgaggaccatacatatgctttgccacatt

SEQ ID NO: 149474 - DNA, 601 bp, Human
ggtttctctccagtatgaattatcttatggttagtaaggattgaagactggttaaagcttttgccacatttttcacatttgtagggtttctcttcagtatggattatcttatgtttagtaagagttgaggacgagttaaaggctttgccacattcttcacatttgtagggtttctctccagtatgaatcatcttatgtgcagtaagggttgaggattgtctaaaagctttgccatactcttcacatttgtagagtttctctctagtatgcatcctcttatgtatagttagggttgaagatyggctaaatgctttgccacattcttcacatttgtagggtttctctctagtatgaattttcttatattcagtaagggttgaggaccatataaatgctttgccacattcttcacacttgtaaggtttctctccagtatggattatcttatgtgcactaagatttgagaatcgatgaaaagttttgccacatacttcgcatttatagggtttctctgcagtgtgcattctcttatgtttagttagggttgaggaccatacatatgctttgccacattcttcacatttgtagcgtttctctccag

SEQ ID NO: 149475 - DNA, 601 bp, Human
ttacaaccctcttcatattggtaatgctttttcaaaataaatactcttctgcactttatagacatattttctgatagatcttttgatagtaattaaacttttaatgcttttatttagtatgaattctgattttgagtaagatttgagcaggtattaatggcttttttgtcaatatttgtacattggttctcaagtataaatgctttacagtgcaataagatgtgagcattggttagaagcttggccacattgttcacaccgtcaattttctcagcatgaattatcttatctataatcaagygtgacaatcatttaaaggctttgtcacattcttcacatttctagaatttgttggcaacatgtttttatgtttagaaaagtttgaggtgttgtcaaaagcattgtcttttctttcaggtttgtagagtttctctccaatatgaataatcttatgtctgttaagaattgaggacttttttaggctttccatattattaacacttgtaagatttttctccaatatgacttatctgtagtaataagtgaggactggttaaaggctttgccaaattttttccatttgtagggttgctgtccagta

SEQ ID NO: 149476 - DNA, 601 bp, Human
gattacatattgcatgcctgtatcaaaatatgccatatatggcatatgcatatacacatattatgtatccacaaaaattaagaaaaataaatttaaacgtgaaaataagaataaaagtttcacctataggaacaatattctgtaacttattgacaatttaaagccactggcaaaaaagattactagagatttcagtccattatcttaccaaataatatattgttaccatcttttacctacacccttgagtaaggtgtaataggctaaagttagtggcataacacttcaatgaattcatgayagtatttaaactgttaaaaatgtttaaatggaaagttgacataaaatttataatttaaaagtataattaatattattccataaaagtacaattaataagataacatactaacttaaacaaaatttaaaagtttttctttcctaataatgcagattactctgaacacctacctcatacatcactcaatgttataagttaaccacaaagagcctctctacttaaattttcatcatgaatcctacattataatgtccttacccttccatagaaaaggtcataaataacacctacctaaaaaaa

SEQ ID NO: 149477 - DNA, 601 bp, Human
aaaaggagggatagaagacaacatatatggtgcagtgtatactggtcagctgatgggtctatcaggatctcacaaatcactaaagaacttactcatccaaccaagtatcacctgtaccccattaaattatggaacaatgagattttaaaaaaaattattcttataattacagactagctcacataatgaatacttcataaactattacacaggctgggcacagtggctcatgcctgtaatcccagcactttgggaggccaaggtgggtgaatcacctgaggtcagtagtttgagaccagcytgaccaaccctgtctctactaaaaatatgaaacttagttgggcatggtggcaggcacctgtaatcccaggtacttgggaggctgaggtagaagaattgcttgaaaatgtcatgccaaggttgcagtgagccaagatagcaccattgcactcccgcctgggctatacagcaagactccgtctcaaaaaaaaaacaaaaaaaaactattaaacaaacaaacaaacaaaaattatgggtctaacatgagtaatagtcaacttaaaacagagaattttcatggggagattctgaagcataagcc

SEQ ID NO: 149478 - DNA, 601 bp, Human
ggatgagattagagactattattctaagtgaagtaactgaggaatggaaaaccgaacgctgtgtgtcctcgctgatatgtgggaggtaagctatgaggacacaaaggcataagaatgatacaatagactttggggacttggggggaagagtgggaaaaaggagggatagaagacaacatatatggtgcagtgtatactggtcagctgatgggtctatcaggatctcacaaatcactaaagaacttactcatccaaccaagtatcacctgtaccccattaaattatggaacaatgagatttwaaaaaaaattattcttataattacagactagctcacataatgaatacttcataaactattacacaggctgggcacagtggctcatgcctgtaatcccagcactttgggaggccaaggtgggtgaatcacctgaggtcagtagtttgagaccagcttgaccaaccctgtctctactaaaaatatgaaacttagttgggcatggtggcaggcacctgtaatcccaggtacttgggaggctgaggtagaagaattgcttgaaaatgtcatgccaaggttgcagtgagccaagatagcaccatt

SEQ ID NO: 149479 - DNA, 601 bp, Human
gacctggatgagattagagactattattctaagtgaagtaactgaggaatggaaaaccgaacgctgtgtgtcctcgctgatatgtgggaggtaagctatgaggacacaaaggcataagaatgatacaatagactttggggacttggggggaagagtgggaaaaaggagggatagaagacaacatatatggtgcagtgtatactggtcagctgatgggtctatcaggatctcacaaatcactaaagaacttactcatccaaccaagtatcacctgtaccccattaaattatggaacaatgarattttaaaaaaaattattcttataattacagactagctcacataatgaatacttcataaactattacacaggctgggcacagtggctcatgcctgtaatcccagcactttgggaggccaaggtgggtgaatcacctgaggtcagtagtttgagaccagcttgaccaaccctgtctctactaaaaatatgaaacttagttgggcatggtggcaggcacctgtaatcccaggtacttgggaggctgaggtagaagaattgcttgaaaatgtcatgccaaggttgcagtgagccaagatagca

SEQ ID NO: 149480 - DNA, 601 bp, Human
tagaaaagagtgtagagattccttaaagaactaaaagtagaactaccatttaatcccaccactgggtatctacccacaggaaaagaagtcattatttgaaacatagaacaatgaaacagagaacccaaaaataaacccaaatactgattatagaaaaacatacttaaacattcatgtttctaggagcacaattcacaatttcaaaatcgtggaaccaaacaaaatgcccatcaatcaacgagtagataaagaaggtgtggtgtgtatatgtgtgtgtatatatgtgtgtatatatatataagttgggatactactcaaccacaaaaaggaatgaattaacagcatttgcaatgacctggatgagattagagactattattctaagtgaagtaactgaggaatggaaaaccgaacgctgtgtgtcctcgctgatatgtgggaggtaagctatgaggacacaaaggcataagaatgatacaatagactttggggacttggggggaagagtgggaaaaaggagggatagaagacaacatatatggtgcagtgtatactggtcagctgatgggtctatcaggatctcacaaatcactaaagaact

SEQ ID NO: 149481 - DNA, 601 bp, Human
aaacaaaaacataaagtggggaaagaacacccttttcaacaaatggtgctggaataattggctagccacatgtaggagaataaaactggatcctcatctctcaccttatacaaaaatcaactcaagatgacttaagaacttaaacctaagacctgaaactgtataaattttggaagataacattggaaaaacccttctaggcattggctaggcaaaaatttcatgacaaaaatccaaaagcaaatgcagtaaaaacaaagataaatagctaagacctaattaaattaaagagcttttcacrgcaaaaggaacagtcagcagagcaaacagacaactcacagtgtgggagaaaatcttaacaatctatacatctgacaaaggactaatatccagaatctacaatgaactcaaacaactcagtaaaaaaaaaattcccataaaaaagtgggctcttgattagacaactctcaaaagaagatatacaaatggccaacaaacatagatttaaaaaagctcaacatcactaatgatcagggaaatgcaaatcaaaaccacaatgtaataccatcttattcctgcaagaatggccataatcaaaaga

SEQ ID NO: 149482 - DNA, 601 bp, Human
actcaaaagacctctacaaggaaaactacaaagcactgttgaaagaaataatagatgacacaaatggaaacacatcccatgctcatggatgagtagaatcaatattgtgaaaatgaccatactgccaaaagcaatctacaaattcaacacaatccccatcaaaataccaccatcattctgaagatggtgagttagaaaaacagagttggaaaaaacaattctaacattcatatggagcccacatagacaaaggaaggctaagcaaaaaaaaaaaaaaaaaaaaaaaaatgaaggcaccacrctacctgatttcaaactatactgtaaggccatagtcaccaaaacagcatagtactggtataaaaacaggcacatagaccaatggaacagagaacccagaaataaacccaaatagttgcagccaactgatcttcaacaaagcaaacaaaaacataaagtggggaaagaacacccttttcaacaaatggtgctggaataattggctagccacatgtaggagaataaaactggatcctcatctctcaccttatacaaaaatcaactcaagatgacttaagaacttaaacctaagacctgaaac

SEQ ID NO: 149483 - DNA, 601 bp, Human
agttgaaagcattccctctgagaacgggaacaagacaaggatgcccactctcactactcctcttcaacacaatcctggaagtcctagccaaagcaataagacagaaaataaagggcatccaaatcagtaaacaaaaggtcaaactgcctctgtttgctgatgatataatcatttaccttgaaaaccctaaggactcctgcagaaagctcctagaactgataaaataattcagcaaagtttctggatacaagattaacctacacaaataagtagcccttttgttcaccaacagcaaccaaayggagaattaaatcaagaactcaaccccttttacaataactcaacaaaaataaaatacttaggaacacacctaatgaaggactcaaaagacctctacaaggaaaactacaaagcactgttgaaagaaataatagatgacacaaatggaaacacatcccatgctcatggatgagtagaatcaatattgtgaaaatgaccatactgccaaaagcaatctacaaattcaacacaatccccatcaaaataccaccatcattctgaagatggtgagttagaaaaacagagttggaaaaaacaattc

SEQ ID NO: 149484 - DNA, 601 bp, Human
tgtgatacaccacataaatagaatttaaaactaaaatcacaagatcatctcaatagattcagaaaaagcatttgacaaaatccagcatcttttatgattaaaactctcagcaaagttggcacacaagggacacagcttgatataataaaagctatctatgacaaacccacagccaacataatactgaatggggaaaagttgaaagcattccctctgagaacgggaacaagacaaggatgcccactctcactactcctcttcaacacaatcctggaagtcctagccaaagcaataagacagraaataaagggcatccaaatcagtaaacaaaaggtcaaactgcctctgtttgctgatgatataatcatttaccttgaaaaccctaaggactcctgcagaaagctcctagaactgataaaataattcagcaaagtttctggatacaagattaacctacacaaataagtagcccttttgttcaccaacagcaaccaaacggagaattaaatcaagaactcaaccccttttacaataactcaacaaaaataaaatacttaggaacacacctaatgaaggactcaaaagacctctacaaggaaaa

SEQ ID NO: 149485 - DNA, 601 bp, Human
atcagtactaatacagagaaagaaggaaatctctctaattcatcctatgaagccagcatcaccctaatacccaaaccaggaaaagacacaacctaaaaagaaaactacagaccaatatcattgataaacattgatgctaaaatccttaacaaaaaattagctaattaaatccaacaacatgtcaaaaagataattcactgtgatcaagtggattgcataccaggatgcagggatggtttaacacacacaggtaaaacaatgtgatacaccacataaatagaatttaaaactaaaatcacawgatcatctcaatagattcagaaaaagcatttgacaaaatccagcatcttttatgattaaaactctcagcaaagttggcacacaagggacacagcttgatataataaaagctatctatgacaaacccacagccaacataatactgaatggggaaaagttgaaagcattccctctgagaacgggaacaagacaaggatgcccactctcactactcctcttcaacacaatcctggaagtcctagccaaagcaataagacagaaaataaagggcatccaaatcagtaaacaaaaggtcaaactg

SEQ ID NO: 149486 - DNA, 601 bp, Human
ttcgcaacagaattgtaccagatattcaaagaatcagtactaatacagagaaagaaggaaatctctctaattcatcctatgaagccagcatcaccctaatacccaaaccaggaaaagacacaacctaaaaagaaaactacagaccaatatcattgataaacattgatgctaaaatccttaacaaaaaattagctaattaaatccaacaacatgtcaaaaagataattcactgtgatcaagtggattgcataccaggatgcagggatggtttaacacacacaggtaaaacaatgtgatacaycacataaatagaatttaaaactaaaatcacaagatcatctcaatagattcagaaaaagcatttgacaaaatccagcatcttttatgattaaaactctcagcaaagttggcacacaagggacacagcttgatataataaaagctatctatgacaaacccacagccaacataatactgaatggggaaaagttgaaagcattccctctgagaacgggaacaagacaaggatgcccactctcactactcctcttcaacacaatcctggaagtcctagccaaagcaataagacagaaaataaagg

SEQ ID NO: 149487 - DNA, 601 bp, Human
aaaaaaaaatacaaaaggtaaatgaatgagacaaaaagcttctccttaggaaaaatacataaaattgatagaccattagcaagactaagaaagaaaaaaagagaaaatccaaataacctcactgagaaatgaaacaggagatattataactgacaccactgaaacacaaaaaaatcattgaaggctagtataaacacctttacaaaagaactagaaaacctagaagagatacttaaattcctggaaaaatacaactctcctagcttaaatcaggaggaattacataccctgaacagaccartaacaagcagggagattaaaatggtaatttaaaaatcaccaacaaaaaaaagtccaggaccagagaggttcgcaacagaattgtaccagatattcaaagaatcagtactaatacagagaaagaaggaaatctctctaattcatcctatgaagccagcatcaccctaatacccaaaccaggaaaagacacaacctaaaaagaaaactacagaccaatatcattgataaacattgatgctaaaatccttaacaaaaaattagctaattaaatccaacaacatgtcaaaaagataattcactg

SEQ ID NO: 149488 - DNA, 601 bp, Human
gaaactagagaaaagagaaacaagaacaaaccaaacccaaacccagcagaaaaaaaggaaataaccaagatcagaaaagaactaaatgaaattgaaacaaaaaaaaatacaaaaggtaaatgaatgagacaaaaagcttctccttaggaaaaatacataaaattgatagaccattagcaagactaagaaagaaaaaaagagaaaatccaaataacctcactgagaaatgaaacaggagatattataactgacaccactgaaacacaaaaaaatcattgaaggctagtataaacacctttacaaaagaactagaaaacctagaagagatacttaaattcctggaaaaatacaactctcctagcttaaatcaggaggaattacataccctgaacagaccaataacaagcagggagattaaaatggtaatttaaaaatcaccaacaaaaaaaagtccaggaccagagaggttcgcaacagaattgtaccagatattcaaagaatcagtactaatacagagaaagaaggaaatctctctaattcatcctatgaagccagcatcaccctaatacccaaaccaggaaaagacacaacctaaaaagaa

SEQ ID NO: 149489 - DNA, 601 bp, Human
ggtctcaaactcctgaccccaggtgatccacccgccttagcctcccaaagtgctggcattataggagtgagtcactgtgcccagcccagaaactctttaaagcataaatcaaacaagacttataaaataaaaatacaagttaaaaaaaaatacccgatgcagtggctcacacctgtaattccagtaagcactttgagagactgaggtgggtggatcacaaggtcaggagttcgagaccaccctatctgatatggtgacaccctgtctgtactaaatatacaaaaattagcccggtgtagtkgtgagcacctgtagtaccagctactcaggaggctgaggcaggagaatcacttgaacctggaagacggatgttgcagtgagccaagatcgagccactgcactccaccatgggtgacagagcagactccattccaaaacaacaacaacaacaacagcaacaacaaaacaccaaagtatgcagccaacaaagatcatgatgaatgcaatggtacctcatatttcaatactaacattgaatgtaaatgacctaaatgctccacttaaaagacacagaacggcagaatggataagaactcaccaa

SEQ ID NO: 149490 - DNA, 601 bp, Human
gggattggggccccatcttcagcctcctcaaacaaaacaattatgtgccaagaattttgcatccaatgaaactaagcatcatatatgaaggaaagaaacagttgtatttttagtagagaagggggtatctccatgttgatcaggttggtctcaaactcctgaccccaggtgatccacccgccttagcctcccaaagtgctggcattataggagtgagtcactgtgcccagcccagaaactctttaaagcataaatcaaacaagacttataaaataaaaatacaagttaaaaaaaaataccmgatgcagtggctcacacctgtaattccagtaagcactttgagagactgaggtgggtggatcacaaggtcaggagttcgagaccaccctatctgatatggtgacaccctgtctgtactaaatatacaaaaattagcccggtgtagtggtgagcacctgtagtaccagctactcaggaggctgaggcaggagaatcacttgaacctggaagacggatgttgcagtgagccaagatcgagccactgcactccaccatgggtgacagagcagactccattccaaaacaacaacaacaacaacag

SEQ ID NO: 149491 - DNA, 601 bp, Human
acttttagaaatacgaaatgctctggaaagtctcagcagtaacaagtagaagaaagaaattcagagttcaaagacaagatatttgaattaaccaaattcaacaaagacaaataaaaaataataagaaaatatgaacaaagcctccaagaagtctggaattatgttaaatgaccaaacctaagaataatttgtgttcctgaggaagaagacaattctaaaagcttgaaaaatatatttgagggaataatcaaggaaaacttctctggccttgctagggacctagacatgcaaatacaagaarcacaaagaacacctggaaaattcattgcaaagagatcttcgcctaagcacactgtcatcagcttatccaaagtaaagacaaaggaaagaatcttaagagttgtgagacagaagcaccaggtaacctataaaggaaaacctaccagattaacagcagactacttaggagaaaccatacaaactagaagggattggggccccatcttcagcctcctcaaacaaaacaattatgtgccaagaattttgcatccaatgaaactaagcatcatatatgaaggaaagaaacagttgtatttttagt

SEQ ID NO: 149492 - DNA, 601 bp, Human
gaagaaatattcaacaaaatatatagcttaaagaaaaaaaaatcaaaaattcaggcaactttgcacagacttttagaaatacgaaatgctctggaaagtctcagcagtaacaagtagaagaaagaaattcagagttcaaagacaagatatttgaattaaccaaattcaacaaagacaaataaaaaataataagaaaatatgaacaaagcctccaagaagtctggaattatgttaaatgaccaaacctaagaataatttgtgttcctgaggaagaagacaattctaaaagcttgaaaaatayatttgagggaataatcaaggaaaacttctctggccttgctagggacctagacatgcaaatacaagaagcacaaagaacacctggaaaattcattgcaaagagatcttcgcctaagcacactgtcatcagcttatccaaagtaaagacaaaggaaagaatcttaagagttgtgagacagaagcaccaggtaacctataaaggaaaacctaccagattaacagcagactacttaggagaaaccatacaaactagaagggattggggccccatcttcagcctcctcaaacaaaacaattatgt

SEQ ID NO: 149493 - DNA, 601 bp, Human
gatttatctaaaaaaagaattcaggaggttagttcttaagctaatgatggagagacaagagaaaggtgaagcccaatgcaacaaaataaaaaaaaaatcatatgagaagtgaaggaagaaatattcaacaaaatatatagcttaaagaaaaaaaaatcaaaaattcaggcaactttgcacagacttttagaaatacgaaatgctctggaaagtctcagcagtaacaagtagaagaaagaaattcagagttcaaagacaagatatttgaattaaccaaattcaacaaagacaaataaaaaakaataagaaaatatgaacaaagcctccaagaagtctggaattatgttaaatgaccaaacctaagaataatttgtgttcctgaggaagaagacaattctaaaagcttgaaaaatatatttgagggaataatcaaggaaaacttctctggccttgctagggacctagacatgcaaatacaagaagcacaaagaacacctggaaaattcattgcaaagagatcttcgcctaagcacactgtcatcagcttatccaaagtaaagacaaaggaaagaatcttaagagttgtgagacagaagcacca

SEQ ID NO: 149494 - DNA, 601 bp, Human
ccctctgaaagggactacccaaatgagaaggaaccagaaaagcaaaccaggttgtatgacaaaaggaggtttgtcaacaccccacaaaaaaaaaaaatcacactagctcactggcaatggatccaaaccaagaagaaatccctgatttatctaaaaaaagaattcaggaggttagttcttaagctaatgatggagagacaagagaaaggtgaagcccaatgcaacaaaataaaaaaaaaatcatatgagaagtgaaggaagaaatattcaacaaaatatatagcttaaagaaaaaaaaatmaaaaattcaggcaactttgcacagacttttagaaatacgaaatgctctggaaagtctcagcagtaacaagtagaagaaagaaattcagagttcaaagacaagatatttgaattaaccaaattcaacaaagacaaataaaaaataataagaaaatatgaacaaagcctccaagaagtctggaattatgttaaatgaccaaacctaagaataatttgtgttcctgaggaagaagacaattctaaaagcttgaaaaatatatttgagggaataatcaaggaaaacttctctggccttgctagg

SEQ ID NO: 149495 - DNA, 601 bp, Human
ctttccctaaacaccatggtagcagaagaaaaaggacatataatcttgggagtcctgggttcccacccactgctagtccctttcaacagtactacagctgatgctttctggaaagcactatctcctggcaggaggtctaccagcacaaaaataaagcattaaaccaccaaagctaaggacacccatggagtccattgcacccttagccacctccaccagaacaggcactggtatccatggctgagagactcataaacacttcacatcacaggactctgtgcagacaaccccaagtatcagyctggagctgggaagactcattgggtggctagatccagaagagagacaaccaatcactgtagttcagctcacaggaaaccacatccacaggaaaagggggagagtactacatcaagggaacaccctgagggataaaaaaaaaaaatctgaacaacagttttcagctctagaccttccctctgaaagggactacccaaatgagaaggaaccagaaaagcaaaccaggttgtatgacaaaaggaggtttgtcaacaccccacaaaaaaaaaaaatcacactagctcactggcaatggatccaa

SEQ ID NO: 149496 - DNA, 601 bp, Human
ccaaggagactctgaactcaggcatgcctagcaccccccgcacccattggtctttccctaaacaccatggtagcagaagaaaaaggacatataatcttgggagtcctgggttcccacccactgctagtccctttcaacagtactacagctgatgctttctggaaagcactatctcctggcaggaggtctaccagcacaaaaataaagcattaaaccaccaaagctaaggacacccatggagtccattgcacccttagccacctccaccagaacaggcactggtatccatggctgagagacycataaacacttcacatcacaggactctgtgcagacaaccccaagtatcagtctggagctgggaagactcattgggtggctagatccagaagagagacaaccaatcactgtagttcagctcacaggaaaccacatccacaggaaaagggggagagtactacatcaagggaacaccctgagggataaaaaaaaaaaatctgaacaacagttttcagctctagaccttccctctgaaagggactacccaaatgagaaggaaccagaaaagcaaaccaggttgtatgacaaaaggaggtttgtc

SEQ ID NO: 149497 - DNA, 601 bp, Human
agaaagcctggggaaattttcaagcccaactcgccctccacctggaaacagactcaggtctgttatgaagggcacagtgagagtgagaccagccctttcgtttgcatgggagctgagtaaggcctgtgactgccagctttcccccacttccctgacaccctgcatgactcagcaaagacagccataatcctcctaggtacacaactccagtgacctgggaatctcacccccatctgccacagcagcttcagcaacaaccacccaaggagactctgaactcaggcatgcctagcaccccccrcacccattggtctttccctaaacaccatggtagcagaagaaaaaggacatataatcttgggagtcctgggttcccacccactgctagtccctttcaacagtactacagctgatgctttctggaaagcactatctcctggcaggaggtctaccagcacaaaaataaagcattaaaccaccaaagctaaggacacccatggagtccattgcacccttagccacctccaccagaacaggcactggtatccatggctgagagactcataaacacttcacatcacaggactctgtgcagacaacc

SEQ ID NO: 149498 - DNA, 601 bp, Human
tttgtaacaatttgaatggggcaagaagacttatggccagaacttgggggaaggcatgaatccggcttgaagacttcacaggcatggaagaactaaagcccttttttttcccgcagctgggagacagaaagcctggggaaattttcaagcccaactcgccctccacctggaaacagactcaggtctgttatgaagggcacagtgagagtgagaccagccctttcgtttgcatgggagctgagtaaggcctgtgactgccagctttcccccacttccctgacaccctgcatgactcagcaawgacagccataatcctcctaggtacacaactccagtgacctgggaatctcacccccatctgccacagcagcttcagcaacaaccacccaaggagactctgaactcaggcatgcctagcaccccccgcacccattggtctttccctaaacaccatggtagcagaagaaaaaggacatataatcttgggagtcctgggttcccacccactgctagtccctttcaacagtactacagctgatgctttctggaaagcactatctcctggcaggaggtctaccagcacaaaaataaagcattaaac

SEQ ID NO: 149499 - DNA, 601 bp, Human
cctggagctgcgtcaagttagagagccaagctgagtgaaatacaggggtgtaggaggcaacaaagaggccctgggagctcgctgaatccccaaggagcccattcctgcctagcaccacagggatccatcaaggggaggacagaggagcagggggtaaaacttccaaggggagaaggacttccctagctgaactttgtaacaatttgaatggggcaagaagacttatggccagaacttgggggaaggcatgaatccggcttgaagacttcacaggcatggaagaactaaagcccttttttttcccgcagctgggagacagaaagcctggggaaattttcaagcccaactcgccctccacctggaaacagactcaggtctgttatgaagggcacagtgagagtgagaccagccctttcgtttgcatgggagctgagtaaggcctgtgactgccagctttcccccacttccctgacaccctgcatgactcagcaaagacagccataatcctcctaggtacacaactccagtgacctgggaatctcacccccatctgccacagcagcttcagcaacaaccacccaaggagactctgaactcaggc

SEQ ID NO: 149500 - DNA, 601 bp, Human
ccactggagaagctgaaagtctgtttgtgggagaagtttctaactacctggagctgcgtcaagttagagagccaagctgagtgaaatacaggggtgtaggaggcaacaaagaggccctgggagctcgctgaatccccaaggagcccattcctgcctagcaccacagggatccatcaaggggaggacagaggagcagggggtaaaacttccaaggggagaaggacttccctagctgaactttgtaacaatttgaatggggcaagaagacttatggccagaacttgggggaaggcatgaatcyggcttgaagacttcacaggcatggaagaactaaagcccttttttttcccgcagctgggagacagaaagcctggggaaattttcaagcccaactcgccctccacctggaaacagactcaggtctgttatgaagggcacagtgagagtgagaccagccctttcgtttgcatgggagctgagtaaggcctgtgactgccagctttcccccacttccctgacaccctgcatgactcagcaaagacagccataatcctcctaggtacacaactccagtgacctgggaatctcacccccatctgcc

SEQ ID NO: 149501 - DNA, 601 bp, Human
gtacacagacaggtggacaggagggagagggagagtaaagctgctcaccctgtacacagggctcgtgctcaggcttgtgcctagagagaaaaaaaagccatctcaaaaattcccatagttccttgattgtttttccagcaacccaccactcacccacccactcctgttagacctcagattaggctggaacctgacacttggcatgataggggagctttcagagtaaatgtgattgtttatgcacattagtcacctctccaaaatacctattaataatacagtttttaaaaagaaacattayagtgaagaaattcttcagaaaacacgttaaccaagttaataaaattaatgggacagattggtatcaggtgctgatacatataggaggatgcaacatgactctgtgagactactggccaaaaaacataaattataatctgaatctaatcatgaaaaatgtgttttatgtaaagttcaagccacatatgttgcccatgttttgtaatttctagtagtgtatctaaaaactcttttagcattctagaaggcaaatttctttgaattcattcctttaaatatctttctaaattattccaggcta

SEQ ID NO: 149502 - DNA, 601 bp, Human
aaagagtacacagacaggtggacaggagggagagggagagtaaagctgctcaccctgtacacagggctcgtgctcaggcttgtgcctagagagaaaaaaaagccatctcaaaaattcccatagttccttgattgtttttccagcaacccaccactcacccacccactcctgttagacctcagattaggctggaacctgacacttggcatgataggggagctttcagagtaaatgtgattgtttatgcacattagtcacctctccaaaatacctattaataatacagtttttaaaaagaaayattatagtgaagaaattcttcagaaaacacgttaaccaagttaataaaattaatgggacagattggtatcaggtgctgatacatataggaggatgcaacatgactctgtgagactactggccaaaaaacataaattataatctgaatctaatcatgaaaaatgtgttttatgtaaagttcaagccacatatgttgcccatgttttgtaatttctagtagtgtatctaaaaactcttttagcattctagaaggcaaatttctttgaattcattcctttaaatatctttctaaattattcca

SEQ ID NO: 149503 - DNA, 601 bp, Human
agcttaagaaaaatactctgtaaaacatctagtaagtgatagaacctgggttttttccccatgtatatgaccagtaaacaaagatgacagccttcattttccaaagcaatgtataaacaaagagaaactattaagaaaaagagtgtaagaaaaatggatgttctgtggtcaaaaataggccatggtaaacgtctggttcagcatgactcagttagtttagagtgcaggtgcaccattctacttattatgtaacctggttgtataagctcatacttggctctgatccactattgagtgaaargagtacacagacaggtggacaggagggagagggagagtaaagctgctcaccctgtacacagggctcgtgctcaggcttgtgcctagagagaaaaaaaagccatctcaaaaattcccatagttccttgattgtttttccagcaacccaccactcacccacccactcctgttagacctcagattaggctggaacctgacacttggcatgataggggagctttcagagtaaatgtgattgtttatgcacattagtcacctctccaaaatacctattaataatacagtttttaaaaagaaacat

SEQ ID NO: 149504 - DNA, 601 bp, Human
gaactggctctgtttcacataagagactggcattatccaataaaatattgttcaatagagaaagattctctaatgtattccttcattctgaggaaagaggatgaaacaagatccacaaaaccagtgtatgtattatagttttctgaatgacacagcataatatttatggcaaaaacacaagcatttacagttttgagtgccatatatacattatacagagtaaggtgtgtacagttctcatatggagaagtcacagtaagttagaagttacctctcgaattttaatgcatacattaataarctggagattttgttaaaatacgtattctaattcaagagatctgggatgagacctgagttactgtattgctaacaaactcaccaatgatgtcaatgattctagcttaagaaaaatactctgtaaaacatctagtaagtgatagaacctgggttttttccccatgtatatgaccagtaaacaaagatgacagccttcattttccaaagcaatgtataaacaaagagaaactattaagaaaaagagtgtaagaaaaatggatgttctgtggtcaaaaataggccatggtaaacgtctggttca

SEQ ID NO: 149505 - DNA, 601 bp, Human
atggccacagccttgaaagttaacatttcctaaaataaacccaaagacccacacatacttagcaagtggtcataggcagaattattaattttactctaagtgtttgagagttaagagaactggctctgtttcacataagagactggcattatccaataaaatattgttcaatagagaaagattctctaatgtattccttcattctgaggaaagaggatgaaacaagatccacaaaaccagtgtatgtattatagttttctgaatgacacagcataatatttatggcaaaaacacaagcatytacagttttgagtgccatatatacattatacagagtaaggtgtgtacagttctcatatggagaagtcacagtaagttagaagttacctctcgaattttaatgcatacattaataaactggagattttgttaaaatacgtattctaattcaagagatctgggatgagacctgagttactgtattgctaacaaactcaccaatgatgtcaatgattctagcttaagaaaaatactctgtaaaacatctagtaagtgatagaacctgggttttttccccatgtatatgaccagtaaacaaaga

SEQ ID NO: 149506 - DNA, 601 bp, Human
tgggtccttagctctactattcaatattattgaatttaaaattggtgctggatattgaattttaatatttgggcaagaatatttaatgccactgaatttctagaatgaccattaatctagagtgaagaatacagattagctcaagaaaggggaagtttcctgttaaaacatcttgaagattttcttttctgttccagtaaaccttcaagttttccttaaaagtgttgatctaaaaataatttgtgcagaggaaaaactgccaaaatcattctacaaagggagaaaatagaagccttagggygtattagaaaacctggggaaaatgtattgacaccgagagaccagttttcggcagttctctaacactgcatctctgaacaaatttcactgagcagtattcagacattccacacctcctgagagaattctatggccacagccttgaaagttaacatttcctaaaataaacccaaagacccacacatacttagcaagtggtcataggcagaattattaattttactctaagtgtttgagagttaagagaactggctctgtttcacataagagactggcattatccaataaaatattgttcaat

SEQ ID NO: 149507 - DNA, 601 bp, Human
tccaaaatactgttttctgacagaaacttttgaatatttagaacatattttacatttctgggtccttagctctactattcaatattattgaatttaaaattggtgctggatattgaattttaatatttgggcaagaatatttaatgccactgaatttctagaatgaccattaatctagagtgaagaatacagattagctcaagaaaggggaagtttcctgttaaaacatcttgaagattttcttttctgttccagtaaaccttcaagttttccttaaaagtgttgatctaaaaataatttrtgcagaggaaaaactgccaaaatcattctacaaagggagaaaatagaagccttagggtgtattagaaaacctggggaaaatgtattgacaccgagagaccagttttcggcagttctctaacactgcatctctgaacaaatttcactgagcagtattcagacattccacacctcctgagagaattctatggccacagccttgaaagttaacatttcctaaaataaacccaaagacccacacatacttagcaagtggtcataggcagaattattaattttactctaagtgtttgagagttaa

SEQ ID NO: 149508 - DNA, 601 bp, Human
taacataacttgctgagattctacagttaccaaccttgtaccatgttcagtagagaggagaaaatatgaaagattctagaaatttaattccaaaatactgttttctgacagaaacttttgaatatttagaacatattttacatttctgggtccttagctctactattcaatattattgaatttaaaattggtgctggatattgaattttaatatttgggcaagaatatttaatgccactgaatttctagaatgaccattaatctagagtgaagaatacagattagctcaagaaaggggaartttcctgttaaaacatcttgaagattttcttttctgttccagtaaaccttcaagttttccttaaaagtgttgatctaaaaataatttgtgcagaggaaaaactgccaaaatcattctacaaagggagaaaatagaagccttagggtgtattagaaaacctggggaaaatgtattgacaccgagagaccagttttcggcagttctctaacactgcatctctgaacaaatttcactgagcagtattcagacattccacacctcctgagagaattctatggccacagccttgaaagttaacat

SEQ ID NO: 149509 - DNA, 601 bp, Human
caaaaaggaaagaaagaaaagaaaaaatacagaaatagcaagtaacatctgtcattgatgttcctgagatttctgaaacaaatcttaatgtcaccactgctctcacacacttcagatatgatggaaaaagaaaacttcagaaatgatctaacatgcacttcctcaaaatactcagagatattcttatatccccccttgaagcaatggaagaggaggcatatcatgcagcaccttataagccataaagaggactttagctctcacggtaccttcaaaggaaaatcactaaatagcaagtaamgtccatagagaatttaatggtatgggacaaatgatgctcctatacaaaagctacagaataaaaaatggctttttaggaaacatttccactgaagcagagcatcccataccacattttaaggtctgcaattctttttgacctttgtacctctcgtctgtgttatctgcttcattcatgcttacctgcctgagtatttgaccactgtctcatgtctcttcacattccaggggtcttttatttgctcaaggcaggagatgcgatcaggtttagagacagcaaggcctgttttgttagaaaaaa

SEQ ID NO: 149510 - DNA, 601 bp, Human
acaaaaaggaaagaaagaaaagaaaaaatacagaaatagcaagtaacatctgtcattgatgttcctgagatttctgaaacaaatcttaatgtcaccactgctctcacacacttcagatatgatggaaaaagaaaacttcagaaatgatctaacatgcacttcctcaaaatactcagagatattcttatatccccccttgaagcaatggaagaggaggcatatcatgcagcaccttataagccataaagaggactttagctctcacggtaccttcaaaggaaaatcactaaatagcaagtarcgtccatagagaatttaatggtatgggacaaatgatgctcctatacaaaagctacagaataaaaaatggctttttaggaaacatttccactgaagcagagcatcccataccacattttaaggtctgcaattctttttgacctttgtacctctcgtctgtgttatctgcttcattcatgcttacctgcctgagtatttgaccactgtctcatgtctcttcacattccaggggtcttttatttgctcaaggcaggagatgcgatcaggtttagagacagcaaggcctgttttgttagaaaaa

SEQ ID NO: 149511 - DNA, 601 bp, Human
aatcccattgaaaaatgagcaaatactactaagcatttttcaataaagacatacaaataaccaacacgcatataaaaaacatgctcaatctcaactaaaaataaaactacgatttgattcagaaacctcatcattgggtatctactcaaagaaaattagtttattacatgaaaatgatacctaatatcacctacaaataggcaactgcaaatgaaaacagtgatgaggtatgacttcaaatctgttaaaattactaatatcaaaaagaaaaaatagaggctgggcacggtggctcacgccwgtcatcccagcactttgggatgccaaggcgggaggatcacttacgttcggaaattcaagaccagcctgaccaacattgggaaacaccatctttactaaaaatacaaaattagctggtcatggtggcacatgcctgtaatcccagctactccagaggttgaagtgggagaatctcttgaacccagaggagaatcacttgaacccaggaggggaagatggtggtgagctgagatcatgccattgtactccagcctgggcaacaagagcaaaactctgcctcaaacaaacaaacaaacaaaca

SEQ ID NO: 149512 - DNA, 601 bp, Human
aaaagagtttttgcacagtaaaaaaaaaaaaaaaaatcaacaggataaataggcaacctacagaataaaagaatatatttgcaaactatgggccaacatgaaaccaatattcagaatttacaaataactcaaacaattcaaaaatatcataataataagaaatcccattgaaaaatgagcaaatactactaagcatttttcaataaagacatacaaataaccaacacgcatataaaaaacatgctcaatctcaactaaaaataaaactacgatttgattcagaaacctcatcattgggtayctactcaaagaaaattagtttattacatgaaaatgatacctaatatcacctacaaataggcaactgcaaatgaaaacagtgatgaggtatgacttcaaatctgttaaaattactaatatcaaaaagaaaaaatagaggctgggcacggtggctcacgcctgtcatcccagcactttgggatgccaaggcgggaggatcacttacgttcggaaattcaagaccagcctgaccaacattgggaaacaccatctttactaaaaatacaaaattagctggtcatggtggcacatgcctgtaatc

SEQ ID NO: 149513 - DNA, 601 bp, Human
tgaacaaaccagtaatgagtagcatgattgagtcagtaataaaaagtatctcgacaaagaaaagctcaggactggataaacgcacagccaaattctaccaaatatacaaagaataataatcctccttaaactcttcccaaaaattgaagataattaaattctccctaagtcactctgaggtcagtatcaccctgataccaaaactagccaaggacacaacaaagaaaactattattatattattattataaaaaatagacaaatgggacacaaaagagtttttgcacagtaaaaaaaaaaraaaaaatcaacaggataaataggcaacctacagaataaaagaatatatttgcaaactatgggccaacatgaaaccaatattcagaatttacaaataactcaaacaattcaaaaatatcataataataagaaatcccattgaaaaatgagcaaatactactaagcatttttcaataaagacatacaaataaccaacacgcatataaaaaacatgctcaatctcaactaaaaataaaactacgatttgattcagaaacctcatcattgggtatctactcaaagaaaattagtttattacatg

SEQ ID NO: 149514 - DNA, 601 bp, Human
tacaatggatacaacagtaatacaaaagttcactagaaatgattataaacatctagacactaataaacctgaaaacctaaaaagaatgaataaattcatgaaaacatacaacctcccaagatagagccaggaagaaatagagtacctgaacaaaccagtaatgagtagcatgattgagtcagtaataaaaagtatctcgacaaagaaaagctcaggactggataaacgcacagccaaattctaccaaatatacaaagaataataatcctccttaaactcttcccaaaaattgaagataatyaaattctccctaagtcactctgaggtcagtatcaccctgataccaaaactagccaaggacacaacaaagaaaactattattatattattattataaaaaatagacaaatgggacacaaaagagtttttgcacagtaaaaaaaaaaaaaaaaatcaacaggataaataggcaacctacagaataaaagaatatatttgcaaactatgggccaacatgaaaccaatattcagaatttacaaataactcaaacaattcaaaaatatcataataataagaaatcccattgaaaaatgagcaaat

SEQ ID NO: 149515 - DNA, 601 bp, Human
catcaaaaaagtagaaagcttacatattgagcacctgacatcacacactcttcaaggaactagaaaattaataataaacaaaattccaagttagaagaaaaaaataacaaaaatcagaacagaaccaaatgaaatagagatgaaaaacaataaaaatgatcaacagaatagagttggttttccaaaaagacaaaatgggtaaattgctaggtagattaaccacaaacagaatgaaaatctaaataaacaaaatcagttatgaaagaagacattacaatggatacaacagtaatacaaaagwtcactagaaatgattataaacatctagacactaataaacctgaaaacctaaaaagaatgaataaattcatgaaaacatacaacctcccaagatagagccaggaagaaatagagtacctgaacaaaccagtaatgagtagcatgattgagtcagtaataaaaagtatctcgacaaagaaaagctcaggactggataaacgcacagccaaattctaccaaatatacaaagaataataatcctccttaaactcttcccaaaaattgaagataattaaattctccctaagtcactctgaggtca

SEQ ID NO: 149516 - DNA, 601 bp, Human
cagtttacagcctaaatgactgcatcaaaaaagtagaaagcttacatattgagcacctgacatcacacactcttcaaggaactagaaaattaataataaacaaaattccaagttagaagaaaaaaataacaaaaatcagaacagaaccaaatgaaatagagatgaaaaacaataaaaatgatcaacagaatagagttggttttccaaaaagacaaaatgggtaaattgctaggtagattaaccacaaacagaatgaaaatctaaataaacaaaatcagttatgaaagaagacattacaatrgatacaacagtaatacaaaagttcactagaaatgattataaacatctagacactaataaacctgaaaacctaaaaagaatgaataaattcatgaaaacatacaacctcccaagatagagccaggaagaaatagagtacctgaacaaaccagtaatgagtagcatgattgagtcagtaataaaaagtatctcgacaaagaaaagctcaggactggataaacgcacagccaaattctaccaaatatacaaagaataataatcctccttaaactcttcccaaaaattgaagataattaaattc

SEQ ID NO: 149517 - DNA, 601 bp, Human
ctgatggctgtcctgatgcatgtctctctcacccccatgtccaatcagtcaccaggctctcctcaaaaccatgcttcagtcactgactttggctgtttaatcacttctgacctaaggccctcattgagtcataagcacctcttaattttctgccaccagtttctctctactgctgttaatcttccagcttgctgccagagtcatcatcctcaaaaacaaaagctgctgtcattgtttgcctgcctaataacatctcttgcctccctgctgtctgcaaaaagaaaaatccaaactccttcayttgttttacgaagacccatatctgcttccaaaccaaattgctagtcttggctcttgtctctgtcttccacatcactgacacactgaataattctttactgcccctgctgttgcatgggttgttctttttgttgtgtctccatccccttcccccagcaaagaatatttactctttactcttcgttgagacccatctcaaatagtaccttttctagggagaattaggccttctgttcctaataacttttaccctcgtctatcaagtctgtctgctgtaatttatctgttaacatgtttctcc

SEQ ID NO: 149518 - DNA, 601 bp, Human
tgggctcccacttaccttagagacatgtgcaacacttgagaatagttgttttaaaattctgaaatcagtggacagactgtaagcatcccattgcagtcagttgccaggtacctgttctctgcagcaacctttcacctcccatacttgggagtgagttctgttcctgcagagtgccctgtgcattctggtgcttttgtgccctctcctttaacctataaactgacaactctaactctacattttcacttacaatttttctgaagcagtaatcttttgtgatcctgatcacactacaagtccytcaccctgcaagtacttgtaaaaatgaaagtaatgtccattccttctggaaggtgattgccatgcacacaacctactaggccaggaacattactgatggctgtcctgatgcatgtctctctcacccccatgtccaatcagtcaccaggctctcctcaaaaccatgcttcagtcactgactttggctgtttaatcacttctgacctaaggccctcattgagtcataagcacctcttaattttctgccaccagtttctctctactgctgttaatcttccagcttgctgccagagtcatcatc

SEQ ID NO: 149519 - DNA, 601 bp, Human
cagtaagcagacagttgcctccacagtggtctgggctcccacttaccttagagacatgtgcaacacttgagaatagttgttttaaaattctgaaatcagtggacagactgtaagcatcccattgcagtcagttgccaggtacctgttctctgcagcaacctttcacctcccatacttgggagtgagttctgttcctgcagagtgccctgtgcattctggtgcttttgtgccctctcctttaacctataaactgacaactctaactctacattttcacttacaatttttctgaagcagtaawcttttgtgatcctgatcacactacaagtccctcaccctgcaagtacttgtaaaaatgaaagtaatgtccattccttctggaaggtgattgccatgcacacaacctactaggccaggaacattactgatggctgtcctgatgcatgtctctctcacccccatgtccaatcagtcaccaggctctcctcaaaaccatgcttcagtcactgactttggctgtttaatcacttctgacctaaggccctcattgagtcataagcacctcttaattttctgccaccagtttctctctactgctgtt

SEQ ID NO: 149520 - DNA, 601 bp, Human
tcatcagcttcttcaacaaatgagatgcattggctctgtaaagctgttttggtaggtggctcctacctgagttatttaggaaattcgctctgatgctgtcatctgccagtctccctcatgttttcagttacgtggagtatatcttttaaaaaaattctttgaactagctcttactagcttgatagttaatgtttttgcattcatagtctcccttattttaatttctcaagtttttgcaaaattcttacataactatctgcccttttcatagaccggtgtttctgagccaggtcttctgtcyacacatgtcgtcttgagagagtggatgttagccagctgccctggctgagatggatggggacaatacagggatgcaataaaggagacagtgataatttatatgatctgggaccccaggcctcacaccagaactgtctagtatatgtttagcaaataagtgccactgatttgacctttgtcctgcccttccactttccaccctactacacaagcaggaaatatgcacgagataaggcaggaagatgaggagactgaattccagaaaagaaagggctgcctgcagtaagcagacagttgcctc

SEQ ID NO: 149521 - DNA, 601 bp, Human
ctccatagtaaataagagctctagaactcatcagcttcttcaacaaatgagatgcattggctctgtaaagctgttttggtaggtggctcctacctgagttatttaggaaattcgctctgatgctgtcatctgccagtctccctcatgttttcagttacgtggagtatatcttttaaaaaaattctttgaactagctcttactagcttgatagttaatgtttttgcattcatagtctcccttattttaatttctcaagtttttgcaaaattcttacataactatctgcccttttcatagacyggtgtttctgagccaggtcttctgtctacacatgtcgtcttgagagagtggatgttagccagctgccctggctgagatggatggggacaatacagggatgcaataaaggagacagtgataatttatatgatctgggaccccaggcctcacaccagaactgtctagtatatgtttagcaaataagtgccactgatttgacctttgtcctgcccttccactttccaccctactacacaagcaggaaatatgcacgagataaggcaggaagatgaggagactgaattccagaaaagaaagggc

SEQ ID NO: 149522 - DNA, 601 bp, Human
attgcatccacaagcacagtgggtgcattccctgtattgcatgtgctatatttagaaatctgaaattccataaagtaagtaagcttttatttgcctctaagatgccatggttggcaaggtcaaagttttacaagaagcttgggattgaggaaaacattaagtggtattcagtgtatttgaaaactccatagtaaataagagctctagaactcatcagcttcttcaacaaatgagatgcattggctctgtaaagctgttttggtaggtggctcctacctgagttatttaggaaattcgctcygatgctgtcatctgccagtctccctcatgttttcagttacgtggagtatatcttttaaaaaaattctttgaactagctcttactagcttgatagttaatgtttttgcattcatagtctcccttattttaatttctcaagtttttgcaaaattcttacataactatctgcccttttcatagaccggtgtttctgagccaggtcttctgtctacacatgtcgtcttgagagagtggatgttagccagctgccctggctgagatggatggggacaatacagggatgcaataaaggagacagtg

SEQ ID NO: 149523 - DNA, 601 bp, Human
tattgcatccacaagcacagtgggtgcattccctgtattgcatgtgctatatttagaaatctgaaattccataaagtaagtaagcttttatttgcctctaagatgccatggttggcaaggtcaaagttttacaagaagcttgggattgaggaaaacattaagtggtattcagtgtatttgaaaactccatagtaaataagagctctagaactcatcagcttcttcaacaaatgagatgcattggctctgtaaagctgttttggtaggtggctcctacctgagttatttaggaaattcgctytgatgctgtcatctgccagtctccctcatgttttcagttacgtggagtatatcttttaaaaaaattctttgaactagctcttactagcttgatagttaatgtttttgcattcatagtctcccttattttaatttctcaagtttttgcaaaattcttacataactatctgcccttttcatagaccggtgtttctgagccaggtcttctgtctacacatgtcgtcttgagagagtggatgttagccagctgccctggctgagatggatggggacaatacagggatgcaataaaggagacagt

SEQ ID NO: 149524 - DNA, 601 bp, Human
gagctgaagtcaagcaagcctgcttgagaggtgtagtagtggcctttattgcatccacaagcacagtgggtgcattccctgtattgcatgtgctatatttagaaatctgaaattccataaagtaagtaagcttttatttgcctctaagatgccatggttggcaaggtcaaagttttacaagaagcttgggattgaggaaaacattaagtggtattcagtgtatttgaaaactccatagtaaataagagctctagaactcatcagcttcttcaacaaatgagatgcattggctctgtaaagytgttttggtaggtggctcctacctgagttatttaggaaattcgctctgatgctgtcatctgccagtctccctcatgttttcagttacgtggagtatatcttttaaaaaaattctttgaactagctcttactagcttgatagttaatgtttttgcattcatagtctcccttattttaatttctcaagtttttgcaaaattcttacataactatctgcccttttcatagaccggtgtttctgagccaggtcttctgtctacacatgtcgtcttgagagagtggatgttagccagctgccctg

SEQ ID NO: 149525 - DNA, 601 bp, Human
gtttatactcagaacaacactattagggttgggtgggtatgttgacccattttatagctgctttatgaggtacccagtggctggcaataaattaagctcagcatccacaattcctaactaccatctagctccatggaacacctgctttatagagtcagcttgatctcaaaaaaaaaaaaaatcatagatttaaatgtatactgcttatttacctctgtgtatgtgtgttgttatttttaataaagacctttttttttcaaaataaatttgattgaatttgaaggtataagggaatttcaartgaaactttagcctctggtgacgttgccattgatgaatatgatgatagacatcttttcagtagcctttctacctcatgggattgttgtaaagataaataaatgttccagaaactcaaaacctacatatggaataaagtggtttattttgagatcaggaagttttgtgggtatccactgtggatttcctttccagaattttgaatttttgagtgatttgctttggggaagggtgctactggccttaagtatacagacactagaaatgctgctcagcatattacaatgcacaggatagccac

SEQ ID NO: 149526 - DNA, 601 bp, Human
tattttcaccctgcttctttgaaatcattcaggaaagattccatgtttatactcagaacaacactattagggttgggtgggtatgttgacccattttatagctgctttatgaggtacccagtggctggcaataaattaagctcagcatccacaattcctaactaccatctagctccatggaacacctgctttatagagtcagcttgatctcaaaaaaaaaaaaaatcatagatttaaatgtatactgcttatttacctctgtgtatgtgtgttgttatttttaataaagacctttttttttcaaaataaatttgattgaatttgaaggtataagggaatttcaaatgaaactttagcctctggtgacgttgccattgatgaatatgatgatagacatcttttcagtagcctttctacctcatgggattgttgtaaagataaataaatgttccagaaactcaaaacctacatatggaataaagtggtttattttgagatcaggaagttttgtgggtatccactgtggatttcctttccagaattttgaatttttgagtgatttgctttggggaagggtgctactggccttaagtatacagac

SEQ ID NO: 149527 - DNA, 601 bp, Human
aatgtgtgatatttctggtagtttaattactttaaaatgttctttattcattttgatgtaccttcttggactaagttattttcaccctgcttctttgaaatcattcaggaaagattccatgtttatactcagaacaacactattagggttgggtgggtatgttgacccattttatagctgctttatgaggtacccagtggctggcaataaattaagctcagcatccacaattcctaactaccatctagctccatggaacacctgctttatagagtcagcttgatctcaaaaaaaaaaaaaatcatagatttaaatgtatactgcttatttacctctgtgtatgtgtgttgttatttttaataaagacctttttttttcaaaataaatttgattgaatttgaaggtataagggaatttcaaatgaaactttagcctctggtgacgttgccattgatgaatatgatgatagacatcttttcagtagcctttctacctcatgggattgttgtaaagataaataaatgttccagaaactcaaaacctacatatggaataaagtggtttattttgagatcaggaagttttgtgggtatccactgtg

SEQ ID NO: 149528 - DNA, 601 bp, Human
gcgcttaaatcataccaatagaaaaccatcttgccacatccgtgaaaaaattgtctgtcacaaaaccagaccctggtgccaacagggttgaggagcactgccctacattgtacagtgcctgacatacaccaggtagccaaaaaaattcttagtggggttaattagagcttttaaaaactgtatttgtctttccctagcttgctttgtattttctcttttttccgtgttctcagagacaatggggtaggactatataaatgtgtgatatttctggtagtttaattactttaaaatgttcttyattcattttgatgtaccttcttggactaagttattttcaccctgcttctttgaaatcattcaggaaagattccatgtttatactcagaacaacactattagggttgggtgggtatgttgacccattttatagctgctttatgaggtacccagtggctggcaataaattaagctcagcatccacaattcctaactaccatctagctccatggaacacctgctttatagagtcagcttgatctcaaaaaaaaaaaaaatcatagatttaaatgtatactgcttatttacctctgtgtatgtg

SEQ ID NO: 149529 - DNA, 601 bp, Human
tgaactgcgcacgtgagggatgtaggttgtacactatttacgagaatctaacgcctaaggatctctcactgtctgtcatcacccctagatgggaacctttagttgcaggaaaacaatcccatggctctcactgattctacgttatggtgagctgtataattatttcattatatattataatgtaataatagaaacaaagtgcacagtaagtgtaatgcgcttaaatcataccaatagaaaaccatcttgccacatccgtgaaaaaattgtctgtcacaaaaccagaccctggtgccaacarggttgaggagcactgccctacattgtacagtgcctgacatacaccaggtagccaaaaaaattcttagtggggttaattagagcttttaaaaactgtatttgtctttccctagcttgctttgtattttctcttttttccgtgttctcagagacaatggggtaggactatataaatgtgtgatatttctggtagtttaattactttaaaatgttctttattcattttgatgtaccttcttggactaagttattttcaccctgcttctttgaaatcattcaggaaagattccatgtttatact

SEQ ID NO: 149530 - DNA, 601 bp, Human
gatcaagaccagcctgaccaacatggtgaaaccccatttctactaaaaatacaaaattagccgtgcttcttggctcatgcctgtaatcccagctactcgggaggctgaggcaggagaatcacttgaacccgggaggcagagattgcagtgagctgagattacagcactacactcaataaataaatgaataaacattgttgccctacatcaggagtcctcaacacccagggcacagactgataccagtctgtggtctgttataaaccaaaccgcacagcaggaggtgagcagtggatgagcraggcttcatcaggattcacagccactccccatcactcgcattacaaatcagcagcagcattagattatcgtaggagtgcagaccctattgtgaactgcgcacgtgagggatgtaggttgtacactatttacgagaatctaacgcctaaggatctctcactgtctgtcatcacccctagatgggaacctttagttgcaggaaaacaatcccatggctctcactgattctacgttatggtgagctgtataattatttcattatatattataatgtaataatagaaacaaagtgcacagtaag

SEQ ID NO: 149531 - DNA, 601 bp, Human
accgtgcccagcccttatcattcttaaaaatactgctaaactggttgcatattaggatatctcatttttaaagggtttgctggatgtgcgagacttttaagaagtgctactgatgcttatggatatatggaatatcattctctggggttttctatataccactttatttctcatcagaaattcagactcaaagcccttagcgtgccagacacgagtttgttatgtgatggttaacacgcatttcactgagctggtacaggtgatacattcatacctaacttgttacaccatctaagtgacygtttgatgaaagggtcttttattttaagtttattcaggcagacttttgaggtcttatttgcatctggcaaaggtacagcatgttgaaggagaaaaaataaaccttaccttattattcctgcattagatcaatagctgtttattggccacctggtctgtgccaggcactgtacaacatgggtgacctagtaataaatggatggtaataaatgtagttgccagccggtcatggtggcttgcacctgtaatctcagcactttgggaggcctaggcgagtggatcacttgaggtcaggagatca

SEQ ID NO: 149532 - DNA, 601 bp, Human
ctcccgacctcaggtgatccgcccacctcggccacccaaagtgctggtattgcaggcatgggccaccgtgcccagcccttatcattcttaaaaatactgctaaactggttgcatattaggatatctcatttttaaagggtttgctggatgtgcgagacttttaagaagtgctactgatgcttatggatatatggaatatcattctctggggttttctatataccactttatttctcatcagaaattcagactcaaagcccttagcgtgccagacacgagtttgttatgtgatggttaacaygcatttcactgagctggtacaggtgatacattcatacctaacttgttacaccatctaagtgaccgtttgatgaaagggtcttttattttaagtttattcaggcagacttttgaggtcttatttgcatctggcaaaggtacagcatgttgaaggagaaaaaataaaccttaccttattattcctgcattagatcaatagctgtttattggccacctggtctgtgccaggcactgtacaacatgggtgacctagtaataaatggatggtaataaatgtagttgccagccggtcatggtggct

SEQ ID NO: 149533 - DNA, 601 bp, Human
gggatccgtcgatgtggagtgcaccttccttgcagtcgggggctcggtgccgggtgccgtcgttagtccaggaagaaggcggggagcttctcccgctcgaacaatttgcagctagttccggggcttcccttcctcctcccacaccggcccgcatcctagtgttgctttctctgcccccagcaccagcctcttcttgggctccctcctccccttcccactcgcgtctcttaggaaactgcgaccctagtgtttgctaaggagcaggggaggtccttcccgtcgccgacgccccccgcccggraagcggcgcgttttctgggccgagggcgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatccatgagaggttataaatgaggcggaaagaatttttccctgctcagcggatttgtcctttttctctcctgac

SEQ ID NO: 149534 - DNA, 601 bp, Human
cccttccgttggctaagtgcgtgttttacagagatccgtcggtgtggattgcaccttccttgttttacagggatccgtcgatgtggagtgcaccttccttgcagtcgggggctcggtgccgggtgccgtcgttagtccaggaagaaggcggggagcttctcccgctcgaacaatttgcagctagttccggggcttcccttcctcctcccacaccggcccgcatcctagtgttgctttctctgcccccagcaccagcctcttcttgggctccctcctccccttcccactcgcgtctcttaggaaactgcgaccctagtgtttgctaaggagcaggggaggtccttcccgtcgccgacgccccccgcccggaaagcggcgcgttttctgggccgagggcgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatcca

SEQ ID NO: 149535 - DNA, 601 bp, Human
tggggtgaatttatttcttacagaaccgccctgattcagatggtgcaagcctcgcaggccagaaacatcttcctgacgctgctccccaccttctgccctctctttcccagcatccttcccctgtggaaagagaaactttccttctaaggtctttccagcccctccctggcagggaagcctggaaactagggcccctgctttcccctgcagtcgcaaagcatctgggtgctggccaggaggtggcctcctggggtgctctcaccagggtgtttggtggaagcccctgacgcaccctgctctstggatttgatcttcctgggcagaggacactggcttcgagggggcagcaggcagccctgcgccctggccctttcctggctggcggttttggtgtggctgactacctaccaccttaggcgcccaggaaagaagggggccagggcctggccatgggggcgcctatcggtccttgcccttccgttggctaagtgcgtgttttacagagatccgtcggtgtggattgcaccttccttgttttacagggatccgtcgatgtggagtgcaccttccttgcagtcgggggctcggtgccgggtgccgt

SEQ ID NO: 149536 - DNA, 601 bp, Human
atgcccagaaaacattgagaagctgctgcacagatccagttcacagttgaggttgtgacttgtctactttacccatcatacaagacatgtggactctcatacctagaaccagaacatgtgagggattggtaatttcatccctgtattttttgaaggtctgattgtgacatacacctctgccaaacacctgatttgactctcctgcctggcttggttcacaggtagaattgtgatatattgctggacccagcacccaggtgagatgactctattctcaagccttggtgcctcttacaggagrcactgtgacatatcgctgggatttgcagtcaggtaatgtaaattttctctcctaccttggtgctgccaataaggggcattgtgtcatattgctcattttaacacccaggtgatgtgactcttctgcctgggtccagcctaaaggggggattgtgacatctctctgcactcatcacccaggtaatgtactctcatctcttgcctggtttctgttcacaggagggaaggtgacatatctctgagctcagcacctagctaatgtgacacttctcttcttcctaggttctgcccacaagggaga

SEQ ID NO: 149537 - DNA, 601 bp, Human
aattcgttatgcatggattttgtgacccttaaaccataatttagcacacgtgtcaggctgtgacttttctaaggggacacaatgcccagaaaacattgagaagctgctgcacagatccagttcacagttgaggttgtgacttgtctactttacccatcatacaagacatgtggactctcatacctagaaccagaacatgtgagggattggtaatttcatccctgtattttttgaaggtctgattgtgacatacacctctgccaaacacctgatttgactctcctgcctggcttggttcacrggtagaattgtgatatattgctggacccagcacccaggtgagatgactctattctcaagccttggtgcctcttacaggaggcactgtgacatatcgctgggatttgcagtcaggtaatgtaaattttctctcctaccttggtgctgccaataaggggcattgtgtcatattgctcattttaacacccaggtgatgtgactcttctgcctgggtccagcctaaaggggggattgtgacatctctctgcactcatcacccaggtaatgtactctcatctcttgcctggtttctgttcacagg

SEQ ID NO: 149538 - DNA, 601 bp, Human
cagccaattggggaggtgttgactctcatacctgagcttagaatgacaggtacaatcatgggcccatatcagcatgaaggtcttaatgcagattgcaactcacatgcatatcatattgtattagttcattttcacactgctataaagaactgcccaagaccaggtaatttatgtagaaaagaggtttaattaactcacagttccacatggctggggaggcctcagaaaacttacatttatggcagaagaggaagcagggaccttcttcaacaggtggcagcagggagaaagtgaatgaagraggaacttccaacatttataaaaccatcagatctcctgagaactcactcactatcacgaaaacagcatggaggaaactgccccatgatccagttaccttcctgctttgacacgtggagattacaattgtagatgagatttgggtgaggacatagagccaaaccatgtatctcataaattctttgggtggtacagagagtgtactaatagcctagctgaaaggtaagattgtgacagtagtaagcagacacagtcaagagtaaagattgttgtcctctcacatgagcatggcccactgttg

SEQ ID NO: 149539 - DNA, 601 bp, Human
gacacagccaattggggaggtgttgactctcatacctgagcttagaatgacaggtacaatcatgggcccatatcagcatgaaggtcttaatgcagattgcaactcacatgcatatcatattgtattagttcattttcacactgctataaagaactgcccaagaccaggtaatttatgtagaaaagaggtttaattaactcacagttccacatggctggggaggcctcagaaaacttacatttatggcagaagaggaagcagggaccttcttcaacaggtggcagcagggagaaagtgaatraagaaggaacttccaacatttataaaaccatcagatctcctgagaactcactcactatcacgaaaacagcatggaggaaactgccccatgatccagttaccttcctgctttgacacgtggagattacaattgtagatgagatttgggtgaggacatagagccaaaccatgtatctcataaattctttgggtggtacagagagtgtactaatagcctagctgaaaggtaagattgtgacagtagtaagcagacacagtcaagagtaaagattgttgtcctctcacatgagcatggcccact

SEQ ID NO: 149540 - DNA, 601 bp, Human
ttaagatagtcatcctcacacatggacacaacccactggtgagatcctgaatctcatatgtagacacagtctacagatggaatgtgtcagtcatatgtgaacatctggacacatatgggatagtgacccatctctaaatccagctcataggcagatgagtactcttctatttagacacagccaattggggaggtgttgactctcatacctgagcttagaatgacaggtacaatcatgggcccatatcagcatgaaggtcttaatgcagattgcaactcacatgcatatcatattgtattasttcattttcacactgctataaagaactgcccaagaccaggtaatttatgtagaaaagaggtttaattaactcacagttccacatggctggggaggcctcagaaaacttacatttatggcagaagaggaagcagggaccttcttcaacaggtggcagcagggagaaagtgaatgaagaaggaacttccaacatttataaaaccatcagatctcctgagaactcactcactatcacgaaaacagcatggaggaaactgccccatgatccagttaccttcctgctttgacacgtggagattac

SEQ ID NO: 149541 - DNA, 601 bp, Human
ctttaactttatccctgtatctttctgcatgtgagactgtgtgacatatgcctctgtccagcaactgagtgatttaacacttctgccttggcccaacccacagatggaattttgacatattgctaaacccagcaccttcatcatgggactctattccactgccttggcactgcccatagacagcattgtgacatatcactgtcactaggccttatattcagttaatgtcagtctcctcttctgttttgtcactgtgcacagaaggcattgtgacgttgggccccacacccaagttatgtgrttctcctacctgtaccctgcccacacggcccattgtgatatgttgcttggtccagaacccaggtgatgtaactctcttgccttggcccttcctacaggaggcattatgacatctctgcacccattagccaggtgatatgactcacttctgcctgatcgctgctcacagggaatattgtgactcatcactgggcccagcattgagttgatgtgactcttctattctttttaggttctgcctgcaggagagattgtgatgtgtctctggactcaatagtaaggtgatgctacacttttgcct

SEQ ID NO: 149542 - DNA, 601 bp, Human
cctaattgagtcttgcccacagaaagcattttgacacatcgctgggcccattaccaaggtgatgtggttctgcagtctacatcctgcatccagctttcaggaggggattgtgattgtaacatattcctggctaagtacccaggtgatattattcctctgcctggtcccttctgtcagggaagattgtgacatattcctggaccagaacataggcgatgtgactctcctgtttgctccctacccacaggtagggacatatatcttggtccagctaacagttgcaatgatgactctaataccrcacaccagccaacagaaaatatactatctgttttagctgaggttagagacacgggtaaaatcccatgtctcctctttgtatgaaggttatagaaaattaccactttctcacacattgtataaagccctagtgtggaacaaaatgtcaccacggaacccagcattcaaatgagattgtgtttctcatattctcaccctaccatccattaggattttcacccttacacgtggacagagcccacaggtgaggtcctgaatcacacaggttgacacagtccacagctggaattgtttctctcat

SEQ ID NO: 149543 - DNA, 601 bp, Human
agtctctctctctctctctctttttttttttttgcctggtccccacatgttttgggtattgtgacatatcgctgggcccaatacctagaaatggaacgctcctggctggggcctgtccacagtggacctggtgacatatttctgcatttatcacctaagcaatgtggctctcttcttctgcctgcaccctgcctacagggaagattgtgacatgttgctggcctcagcaaacagatgataagtctctcctaattgagtcttgcccacagaaagcattttgacacatcgctgggcccattamcaaggtgatgtggttctgcagtctacatcctgcatccagctttcaggaggggattgtgattgtaacatattcctggctaagtacccaggtgatattattcctctgcctggtcccttctgtcagggaagattgtgacatattcctggaccagaacataggcgatgtgactctcctgtttgctccctacccacaggtagggacatatatcttggtccagctaacagttgcaatgatgactctaataccacacaccagccaacagaaaatatactatctgttttagctgaggttagagacacg

SEQ ID NO: 149544 - DNA, 601 bp, Human
ttgggctctgctgaaggaggcattgtgatgtatccctggacacagggcctaagggatgttactctcctctcctgcctgggcccggcatacattgtgtgttgtaatatatggctgcacccaacaagtacgtgatgcaactctactctacggtccctgaagacaggggtattatatgatactgtttgttcatcacctaggagatatgacacatttttgttgcctgggacctgccaaataagaagattgtgacatatcacttgatccatcatctaggtgatatgagtctctctctctctctctctttttttttttttgcctggtccccacatgttttgggtattgtgacatatcgctgggcccaatacctagaaatggaacgctcctggctggggcctgtccacagtggacctggtgacatatttctgcatttatcacctaagcaatgtggctctcttcttctgcctgcaccctgcctacagggaagattgtgacatgttgctggcctcagcaaacagatgataagtctctcctaattgagtcttgcccacagaaagcattttgacacatcgctgggcccattaccaaggtgatgtggttctgc

SEQ ID NO: 149545 - DNA, 601 bp, Human
tcttgggctctgctgaaggaggcattgtgatgtatccctggacacagggcctaagggatgttactctcctctcctgcctgggcccggcatacattgtgtgttgtaatatatggctgcacccaacaagtacgtgatgcaactctactctacggtccctgaagacaggggtattatatgatactgtttgttcatcacctaggagatatgacacatttttgttgcctgggacctgccaaataagaagattgtgacatatcacttgatccatcatctaggtgatatgagtctctctctctctctctctttttttttttttgcctggtccccacatgttttgggtattgtgacatatcgctgggcccaatacctagaaatggaacgctcctggctggggcctgtccacagtggacctggtgacatatttctgcatttatcacctaagcaatgtggctctcttcttctgcctgcaccctgcctacagggaagattgtgacatgttgctggcctcagcaaacagatgataagtctctcctaattgagtcttgcccacagaaagcattttgacacatcgctgggcccattaccaaggtgatgtggttct

SEQ ID NO: 149546 - DNA, 601 bp, Human
attatttctgaggcctctgttctgttccattggtctatatatctgttttggtaccagtaccatgctgttttggttactgtagacttgtagtatggtttgaagtcagatagcatgatgcctccagctttgttcttcttgcccaggagtgtcttggctatgtgggatcttttttggttccatatgaagtttaaagtagctgtttacaattctgtgaagaaagtcagtggtagcttgatagggatagcgttgaatctataaattactttgggcagtatggcagttttcaagatattgactctcyctatccataagcatggaatatttttgcatttatttatgtcctctctaatttccttgagcagtggtttgtagttctccttgaagaggtccttcacatgccttgtaagttgtattcctaggtattttattatctttgtaacaattgtgaatgggagttcactcatgatttggctgtcagtttgtctgttattggtatatagaaatgcttgtgatttttgcatattgattttgtatcctgaaactttgctgaagttgtttatcagcttacagagattttgggcagagacaatggggttttcta

SEQ ID NO: 149547 - DNA, 601 bp, Human
gtgtgtctcttcttgtaccagtaccatgcctttttggttactatagccccgtagcatagtttgaagttgggtagcatgatatcttcagctttgttatttttgcttaggattgtcttgagtattcaggctcttgtttgtttcaatatataatttttttaattatactttaagttcttgggtacgtgtgcagaacgtgcagttttgttacataggtatatatgtgccatgctggctcactgcacctagcaaccagtcacttacattaggtatatctcctgatgttatcccttccctagccccygacagcctgacaggccccagtgtgtgatgttcttctcattatgtccatgtattctcattgttcaactcccacttatgagtgagaacatgagctgtttgattttctattcttgtgatagtttgctgagaatgatggtttccagcttcatccacgtctctgcaaaagaaatgaactcatccttttttatggctgcatagtatttcatggtgtatatgtgccacattttctttacctagtctattattgatggacatttgggttgtttctgagtctttgctattctgaatagtgctgcagtat

SEQ ID NO: 149548 - DNA, 601 bp, Human
atgcagacatgagtttgctgcatatgagaaaattggcagaaattctcaggatctcagggactctcattcctaaagcaaaccccattataaggatgaaccttggcctatgaggtcagaatgctcttttatcctctggactctgccaactttatgttctctgggccattctctgcttctctccagacttcaatttcccagttatccagtgagatgttagatgtcaaagtgcttaaaccacagctcagcctgcacatggtgcaagttccctaccaactaggatgggtgtagcagggctgtgatsagggtgtgcccagatcttcctcacttgggcagaaatagatgggttctgcactgggcagctggaccttctgtccaaaaagtcatgcacacaggatccttcaaggcccacagacaatgtgtgcatgtgggacccacctttatcccccagcagctcccactggagcatacccaatatgtcccctgtcctctgcatctagaaagtggtgacatccacacttaacacacggactgataagccctttgtggtggagtagtcctacaaaaagaatctgagatgctattactgtacaaggaattatgg

SEQ ID NO: 149549 - DNA, 601 bp, Human
cagacacattatcaacaaagaaacattggacttaatctgttgcactatagaccaaatgtacctagtaaatatttacaggacattttatctaatggttgcagaatgcattcttttctttagcacatggattattttcaaggatagactatatgttaggtcacaaaaaagtcctaaaacattcaaaaactagaaataatatcaaacatcttatttgtccacaatggaataaaattataaattaataagaagaggaattataaaaactatacaaatacacaaaaataaacaatatgcttctgartgattattgggtccatgaagaaattaagaagaaaattaaaaatgttcttgaaacaaatgataataaaagcactgtgtatcaaaatctatgggatacacaaaagcagtactaacaggaatgtttataggtataagtgactacatcccaaaaatgggaacattttcaaataaacaacctaataatgtatcttaaagaactagaggccgggcgcggtggctcacgcctgtaatcccagcactttgggaggccgaggcgggcgaatcacgaggtcaggagatcgagaccatcccggctaaaacg

SEQ ID NO: 149550 - DNA, 601 bp, Human
gtggcatggtgcagaaagggagagttcagcaattgtgaggcattgaattcagtgctttcctgttataacggaaagaaaaagcaaaccaaactcggctaacacttgctgatggaggaattatttaaaccatatagttaaatacagttgctggtgatagtaagtacacagaaaattaaataatattataacaccgtaactgtggtgtgtgaactacttttatgcaaggtagaaagactaaacaataaaccaatcaaaaataacaactgcaacaacttttcaagacatagacagtaaaattacrtataaatagaaacaacaaaaactgagggaagagatttaaagcatacagtttttattattctttttgcttctttgtttattcaaacagtgttaagttgttattagattaaaataatagattacaagatagcatttgcaagcttcatggtaacctcaaaccaaaaaacatacaagaatacacaaaaaataaaaagcacaaaactaagtcacatcaccagagaaaactaccttcaataaaaggaagacaaaaagcaaagaaagataaaagagaagacctccttcactaaaaggaagacaaaaa

SEQ ID NO: 149551 - DNA, 601 bp, Human
agactatttgcttcattaaatcagggaaggaggattcaaggaaaggtaacttgatgaccttaatgttttcacattagaaaaaaaaaagcatggatttcaattgttttcagaattgaatagtttgtgacatttcttcttggtttaaaaatattctaaagccgcagcctggccaacatagtgaaagcccatctctactaaaaatgcaaaaattagccgggcatggtggcatgtgcctgtagtcccagctacttgggaggctgaggcaggagaatcacttgaacctaagaggcggaggttgtgrtgagccaagatcgtgccactgcattctagcttgggcaacagagggagactccgtctcaaagaaaaaaaaaattctaaacccttgccaggcttaatattcaactatttcaattatttaagtaaataagtatctgtgcctccagttttcctctccaaaatggatttgttttaatatatttaatgattctaacattgaaataactttatttgatgttttcattcactaaaaatacaattttccctgtaataaatggttagatttaatttggttagatttaaatgagatcgctacaatcaaaac

SEQ ID NO: 149552 - DNA, 601 bp, Human
acaaagtctcactctgtcacccaggcaggagtacaatagtgcaatcttggcacactgcaacctctgcctctggggctcaagcaattatcctgcctcagcctcccaagtagctggaactacaggcgaatgccaccgtgcccagctaatttttatatttttgtagagacggtgtctcaccatgttccccaggtgattcaccctcttctgcctcccaaagtgagctcaggtgattcaccctcttctgcctcccaaagtgctgagccacaatgcccagacttcatataagagttttcagtgtgarttttttttttcttctactggtcagcatagaaccttttttcaacatgtgagtttcttcctaattactggattgtggcaccaaaaaaaaaaggcatatttgaagttctaaatgtcatattatacattgtgaagtgacttctcaggactgatcttatctaagaaagaagtctggagaaagagagaaaagaaagagacatgaagaatggcaatatcaacccaggtgatagtcattcttggttgattatcttcttaatgcagtgctgtgtttagcactgactaacctttgattctgcagtctcct

SEQ ID NO: 149553 - DNA, 601 bp, Human
tgcaagctgttggctaagtccaacacttgcgaccaacatctgtctcaaaataaatttaaacaccaacagtgaatatataacaataacaaaaaatagcaaacagtatgaaagaccaataaataaatgagtgaacaaaggtaaaagataattaatattacaattaagaccttctccccttactctcattttttctctctctctctttctctccctgtttgtcacactcaggctcgagtgtgacaaaaaaataaaccaaaaggtcaacttcagcatgcaggatggagcataaaagaatagtttscgggttagggctcagaaatggaaggaaggctgggaaatgcaggaccacaagaaatgaaaagctgtgttcattctcccctggtgaccctatgctcagcagggactagcagaaactgagggttttgtgatttgaaagggaggatgagtccagccacatacccctggctgttacctaatgtgtgggcttcactaacattagatagtaatttggggaaaagagtagaaatagatcatttgtttgtctccatgtaattttttttttttaagacaaagtctcactctgtcacccaggcaggagtac

SEQ ID NO: 149554 - DNA, 601 bp, Human
ctcaaaataaatttaaaaacctacagtaaatacataacaacaaaaaaaattaaagaccaataaataaataaatgggagtgaacaaaggtaaaaggtaattagtgtcaaaattaacatttattttcacacacacacacacacacacacacacactctctgtctctttgtcacacccagtctggagtgtgaccaaaaaaaacaaaccaaaaggtcagcttcagcgtacaggaaggagcataggagaatagaaagaaaaaagaacaaagaagataaacaacaacaagtcactcttaagtattgkggaaacaaactggaagtgtgtttaggaaaaaaacagaggaagaaggtccgagtagtcccaggtactggtaggctgagatgggaagatcacctgggtggaaccagggagatcaaggacgcagagattcacaatcgcatccctctgctggacctgaatggtactacctccagcgacagccatccagtcgaccttagatatggcaaagcgagagtcatctggtcagccttaaagatggtaagctggaagctaagtccgaggctcgaggccgatatcagtctcaaaataaataaacaaaaaaac

SEQ ID NO: 149555 - DNA, 601 bp, Human
aaagaagaaaaacaacagcaaatcactctatgtactgtggaaagaaactgaaaatggggttagaaaaaacagaggaagaaggtccgagtagtcccaggtattcaaggggccgagatgggttgaccacctgggcaagaccggggaagtgaaggccagagtgaatcaccatcgtatcctcctgctggacctgaacggtactgccactggtgaaaatcatatggacgatcttagacatggcaaggcgagagccatctggtcaaccttagacatggaaagctggaggctaagtccaacgcttgcsactgacatctgtctcaaaataaatttaaaaacctacagtaaatacataacaacaaaaaaaattaaagaccaataaataaataaatgggagtgaacaaaggtaaaaggtaattagtgtcaaaattaacatttattttcacacacacacacacacacacacacacactctctgtctctttgtcacacccagtctggagtgtgaccaaaaaaaacaaaccaaaaggtcagcttcagcgtacaggaaggagcataggagaatagaaagaaaaaagaacaaagaagataaacaacaacaagtcac

SEQ ID NO: 149556 - DNA, 601 bp, Human
taatatcacaattaagatctcttttctctttctccctgtatgtcacacccaggctacagtgtgataaaaaaatctaaaagtcaacctcagtgtgcaggaaggagtgtaggaaaatactgagagaaaagaacaaagaagaaaaacaacagcaaatcactctatgtactgtggaaagaaactgaaaatggggttagaaaaaacagaggaagaaggtccgagtagtcccaggtattcaaggggccgagatgggttgaccacctgggcaagaccggggaagtgaaggccagagtgaatcaccatygtatcctcctgctggacctgaacggtactgccactggtgaaaatcatatggacgatcttagacatggcaaggcgagagccatctggtcaaccttagacatggaaagctggaggctaagtccaacgcttgcgactgacatctgtctcaaaataaatttaaaaacctacagtaaatacataacaacaaaaaaaattaaagaccaataaataaataaatgggagtgaacaaaggtaaaaggtaattagtgtcaaaattaacatttattttcacacacacacacacacacacacacacactctc

SEQ ID NO: 149557 - DNA, 601 bp, Human
aaaataaatacacaaaaaacaacagtaaatatttaacaataaagaaatagtaacatacaatattattgaccaataaataagtggaagtgaacaataataaaaggtaattaatatcacaattaagatctcttttctctttctccctgtatgtcacacccaggctacagtgtgataaaaaaatctaaaagtcaacctcagtgtgcaggaaggagtgtaggaaaatactgagagaaaagaacaaagaagaaaaacaacagcaaatcactctatgtactgtggaaagaaactgaaaatggggttrgaaaaaacagaggaagaaggtccgagtagtcccaggtattcaaggggccgagatgggttgaccacctgggcaagaccggggaagtgaaggccagagtgaatcaccatcgtatcctcctgctggacctgaacggtactgccactggtgaaaatcatatggacgatcttagacatggcaaggcgagagccatctggtcaaccttagacatggaaagctggaggctaagtccaacgcttgcgactgacatctgtctcaaaataaatttaaaaacctacagtaaatacataacaacaaaaaaaa

SEQ ID NO: 149558 - DNA, 601 bp, Human
aagtccaatgcttgtggctgagatctgtcaaaaaataaatacacaaaaaacaacagtaaatatttaacaataaagaaatagtaacatacaatattattgaccaataaataagtggaagtgaacaataataaaaggtaattaatatcacaattaagatctcttttctctttctccctgtatgtcacacccaggctacagtgtgataaaaaaatctaaaagtcaacctcagtgtgcaggaaggagtgtaggaaaatactgagagaaaagaacaaagaagaaaaacaacagcaaatcactctaygtactgtggaaagaaactgaaaatggggttagaaaaaacagaggaagaaggtccgagtagtcccaggtattcaaggggccgagatgggttgaccacctgggcaagaccggggaagtgaaggccagagtgaatcaccatcgtatcctcctgctggacctgaacggtactgccactggtgaaaatcatatggacgatcttagacatggcaaggcgagagccatctggtcaaccttagacatggaaagctggaggctaagtccaacgcttgcgactgacatctgtctcaaaataaatttaaaa

SEQ ID NO: 149559 - DNA, 601 bp, Human
ctatcagtagggttagataaaaaacagaggaagaaggttgtttcaggtacacgggaggccaagatggatagatcacccaggtgagactgggaacattgaggtcacagtgaatcacgatcgcatccctctgctgcacataaactgtactgtcaccagcgagagccatctgctcgaccttatacatagcaaggcaagagatacctagttgaccttagacatggcaagctggcagctaagtccaatgcttgtggctgagatctgtcaaaaaataaatacacaaaaaacaacagtaaatatttamcaataaagaaatagtaacatacaatattattgaccaataaataagtggaagtgaacaataataaaaggtaattaatatcacaattaagatctcttttctctttctccctgtatgtcacacccaggctacagtgtgataaaaaaatctaaaagtcaacctcagtgtgcaggaaggagtgtaggaaaatactgagagaaaagaacaaagaagaaaaacaacagcaaatcactctatgtactgtggaaagaaactgaaaatggggttagaaaaaacagaggaagaaggtccgagtagtcccag

SEQ ID NO: 149560 - DNA, 601 bp, Human
acttcagcttacaggaagaagtgtaggaaaatagagaaaagaacaaagaagaaaaacaatagcaagtcactataagtactgtggaaataaactgaaagtgggttgagaaaaaaacaaacaaacaaacaaaaacagaaaaagaagttctgagtagtcccgggtacttgggaggctgagatgagaagaacacgcaggtgtgaccagggagattgaggctgcagtgaatcacgatcacatccttctgctggaactgaacagtactgctaccagtgagagccatgtggtgaatcttcgacatggyaagggaagagccatctggttgacctaatacatgtcagggtgagaaccatctggtcaaccttagacatggcaagctggcagctaaatccaatgctcactgccaatgtctctcaaaataaataaacaaaaaaagtaaatatttaacaataacaaagaaatgataacaatattaaacaccaataaataaatgagagttaacaaaggtaattaatatcacaattaagatctttctctctctctcctctgtgtgtgtgtctctcccctttgtcacacccaggctagagtgtgataaaaaaatatt

SEQ ID NO: 149561 - DNA, 601 bp, Human
gtctctctattctcctatgctccttcctgtatgctgaagctaatctttgttttttttttttttttttggtcacactctagactgggtgtgacaaagagacagagagagagagtgtgtgtgtgtgagagagagaaaataaatcttaattgtggtactaattaccttttacctttgttcactcccatttatttatttattggtctttaatatggtttattattttttgttatcgttatatatttactgtaggtttttaaatatattttgagacagatgtcggttgcaagcattggacttagcygccagcttttcatgtccaaggtcgaccagatggctctggccttgccatgtctaaggtcatccatatgactcttgccagtggcagtaccgttcaggtccagcaggaagatacgatcatgattcactgtggcccttgacctccctggtcttgcccaggtggtctacccatctctgcctcttgaatacctggggctactcgaaccttcttcccctgtttttttctaacctcactttcagtttctttccacagtacatagagtgatttgctgttgtttttcttctttgttcttttctcccagta

SEQ ID NO: 149562 - DNA, 601 bp, Human
tttttttttttttcctaaacacacttccagtttgtttccacaatacttagagtgacttgttgttgtttatcttctttgttcttttgtctctctattctcctatgctccttcctgtatgctgaagctaatctttgttttttttttttttttttggtcacactctagactgggtgtgacaaagagacagagagagagagtgtgtgtgtgtgagagagagaaaataaatcttaattgtggtactaattaccttttacctttgttcactcccatttatttatttattggtctttaatatggtttrttattttttgttatcgttatatatttactgtaggtttttaaatatattttgagacagatgtcggttgcaagcattggacttagccgccagcttttcatgtccaaggtcgaccagatggctctggccttgccatgtctaaggtcatccatatgactcttgccagtggcagtaccgttcaggtccagcaggaagatacgatcatgattcactgtggcccttgacctccctggtcttgcccaggtggtctacccatctctgcctcttgaatacctggggctactcgaaccttcttcccctgtt

SEQ ID NO: 149563 - DNA, 601 bp, Human
ccctccgagccaggtgcgggatataatctcctggtgcgccgtttcctaagcccattggaaaagtgcagtattagggtgggagtgactcgattttccaggtgccgtctgtcacccttttccttgaccaggaaagggaactccctgaccccttgtgcttcctgagtgaggcaatgcctcgccctgctttggctcacgcatggtgcgctgcacccactgtcctgtgcccactgtctggcactccctagtgagatgaacctggtacctcagatggaaatgcagaaatcacccgtcttctgcgtcrctcacgctgggagctgtagaccggagctcttcctattcggccatcttggctcctcccaccctaaaaggtaaacttaagcgtgtagaaagctacgtaggaaaagagagagagaaaagaaaaaaaaaagcaaaaggacagcaagtcattctaagtactctggaaaaaaactgaaagtggggttagaaaaaaaataggaagaaggtctcagtagtcccaggtactcaaggaggccaagatgggaagaccacccgggtgagactggggagatgaaggctgcagtggatcacagttgcatccctc

SEQ ID NO: 149564 - DNA, 601 bp, Human
ggcaatggtgggtgccccttccccagcctcgctgccaccttgcagtttgatctcagactgctgtgctagcaatcagcgagcctccatgggcgtaggaccctccgagccaggtgcgggatataatctcctggtgcgccgtttcctaagcccattggaaaagtgcagtattagggtgggagtgactcgattttccaggtgccgtctgtcacccttttccttgaccaggaaagggaactccctgaccccttgtgcttcctgagtgaggcaatgcctcgccctgctttggctcacgcatggtgcrctgcacccactgtcctgtgcccactgtctggcactccctagtgagatgaacctggtacctcagatggaaatgcagaaatcacccgtcttctgcgtcgctcacgctgggagctgtagaccggagctcttcctattcggccatcttggctcctcccaccctaaaaggtaaacttaagcgtgtagaaagctacgtaggaaaagagagagagaaaagaaaaaaaaaagcaaaaggacagcaagtcattctaagtactctggaaaaaaactgaaagtggggttagaaaaaaaataggaagaaggt

SEQ ID NO: 149565 - DNA, 601 bp, Human
tgtgagaccaagatcgaggccacggtggatcataatcacatccctctgctggacctgaaacggtatggccaccagcgaggccatctggtcgacttcagacatggcaagctggcagctaagcccaacgctcatggtcaatgtccatcacaaaatatataaacaaaccaacagtaaatatttaacaatatcaaagaaataataacaacaaacattaaacaccagtaaataaataagtggaagtgaacaaaggtaaaaagtaattaatattacaattaagatcttcttcactctttttctctctctctctcttcatttgtcacacccagctggagtgtgaccaaaaaatctaaaaggtaaactttttaaaaaatttttattattattatactttaagttttagggtacctgtgcacaatgtgcaggttagttacatatgtatacatgtgccatgctggtgtgctgcacccattaactcgtcatttagcattaggtgtatctcctaatgctatcctttccccctcctgccaccccacaacagtgcccagagtgtgatgttccccttcctgtgtccatgtgttctcattattcaattcccatctat

SEQ ID NO: 149566 - DNA, 601 bp, Human
ttgtcacactcatgctgcagtgtgtcaaaaaaaaatctaagaggtcaacttcagcatgcagaaaggaacatagaaaaatagagtgagaagaacaaagatttaacacaacagcaagtcactctaagtactgtggaagaaactgaaagtggggttagaaccaaaacagaggaagtaggtcctagtagtcccaggtacttgagaggctgagatgggaagactacccttgtgagaccaagatcgaggccacggtggatcataatcacatccctctgctggacctgaaacggtatggccaccagcraggccatctggtcgacttcagacatggcaagctggcagctaagcccaacgctcatggtcaatgtccatcacaaaatatataaacaaaccaacagtaaatatttaacaatatcaaagaaataataacaacaaacattaaacaccagtaaataaataagtggaagtgaacaaaggtaaaaagtaattaatattacaattaagatcttcttcactctttttctctctctctctcttcatttgtcacacccagctggagtgtgaccaaaaaatctaaaaggtaaactttttaaaaaatttttat

SEQ ID NO: 149567 - DNA, 601 bp, Human
tcttcgtgttggtcaagctagtctgaaactcccgacctcagctggtttgcccgcctcggcctcccaaagtgctgggattacaggtgtgaaccacctcgcctggcacataaatatttaacaataacaaagaaataacaaacaatgataagaccaataaataaataagtgggagtgaacaaaggtaaaatgtaattaatataacaactaattgttgtctgcctccctgtctctctctgtttctgtctctctgccactgtctgtttgtgtctctgtctttctgtccctctctccatcgatctccatgtgtcacactctcacacacatgctggagggcaggggcatggtaacggctcactgctgatccagcacctacactccagccagggtgtgacagtgagaagacctaccaaaaatcaaatttaaacatccacgtcagcgttcaggaaggagggtaacaaaaaagaaaaaagaaatggagcaaagaacaaagaagaaagaccacagcaaccccctctaaataccgtggaaacaaaatgaaagtgggagtagaaaaaaaaaagaaggaagatggcctgagtagtccaaggtaaatgggaggctg

SEQ ID NO: 149568 - DNA, 601 bp, Human
taaacatggcaagctggcggccaagtccaacactcgtggctgacatctgtctaaaatgtataaacaaataaacaaacaataatttttttttttgagctggagtttcgctcttgttgcccaggctggagtacagtggcgtgatcttggctcaccgcaacctctgcctcccaggttcaagtgattgtcctgcctcagcctccggagtagctgggattacaggcatgcgccaccacgcctggctaattttgtagttttagtagagttgatgtttcttcgtgttggtcaagctagtctgaaactyccgacctcagctggtttgcccgcctcggcctcccaaagtgctgggattacaggtgtgaaccacctcgcctggcacataaatatttaacaataacaaagaaataacaaacaatgataagaccaataaataaataagtgggagtgaacaaaggtaaaatgtaattaatataacaactaattgttgtctgcctccctgtctctctctgtttctgtctctctgccactgtctgtttgtgtctctgtctttctgtccctctctccatcgatctccatgtgtcacactctcacacacatgctggag

SEQ ID NO: 149569 - DNA, 601 bp, Human
actatagcaactctctctaagtactgtggaagcaaactgaaagtggggttagaaataaaacagaggaacaatgtctgagtagtcccaggtactcgggaggccaagatgggaagaccacccgggtgagactggggagatccaggctgcagtgaatcatcatcacatctctcttctggacctcaatggtaccgctgccagcaagagccaaatggtcaaccttaaacatggcaagctggcggccaagtccaacactcgtggctgacatctgtctaaaatgtataaacaaataaacaaacaatawtttttttttttgagctggagtttcgctcttgttgcccaggctggagtacagtggcgtgatcttggctcaccgcaacctctgcctcccaggttcaagtgattgtcctgcctcagcctccggagtagctgggattacaggcatgcgccaccacgcctggctaattttgtagttttagtagagttgatgtttcttcgtgttggtcaagctagtctgaaactcccgacctcagctggtttgcccgcctcggcctcccaaagtgctgggattacaggtgtgaaccacctcgcctggcacataaat

SEQ ID NO: 149570 - DNA, 601 bp, Human
ctaaaaaaatatatgtgtatatataaaacatcaacttcagcatacaggaaagagcgtaaaaaaaaaataagagagagagagagaatgagagcaaagaacaaagaagaacaactatagcaactctctctaagtactgtggaagcaaactgaaagtggggttagaaataaaacagaggaacaatgtctgagtagtcccaggtactcgggaggccaagatgggaagaccacccgggtgagactggggagatccaggctgcagtgaatcatcatcacatctctcttctggacctcaatggtaccrctgccagcaagagccaaatggtcaaccttaaacatggcaagctggcggccaagtccaacactcgtggctgacatctgtctaaaatgtataaacaaataaacaaacaataatttttttttttgagctggagtttcgctcttgttgcccaggctggagtacagtggcgtgatcttggctcaccgcaacctctgcctcccaggttcaagtgattgtcctgcctcagcctccggagtagctgggattacaggcatgcgccaccacgcctggctaattttgtagttttagtagagttgatgtttc

SEQ ID NO: 149571 - DNA, 601 bp, Human
ctccagccagggtgtgacagactgagaagacctggctaaaaaaatatatgtgtatatataaaacatcaacttcagcatacaggaaagagcgtaaaaaaaaaataagagagagagagagaatgagagcaaagaacaaagaagaacaactatagcaactctctctaagtactgtggaagcaaactgaaagtggggttagaaataaaacagaggaacaatgtctgagtagtcccaggtactcgggaggccaagatgggaagaccacccgggtgagactggggagatccaggctgcagtgaatcrtcatcacatctctcttctggacctcaatggtaccgctgccagcaagagccaaatggtcaaccttaaacatggcaagctggcggccaagtccaacactcgtggctgacatctgtctaaaatgtataaacaaataaacaaacaataatttttttttttgagctggagtttcgctcttgttgcccaggctggagtacagtggcgtgatcttggctcaccgcaacctctgcctcccaggttcaagtgattgtcctgcctcagcctccggagtagctgggattacaggcatgcgccaccacgcct

SEQ ID NO: 149572 - DNA, 601 bp, Human
aaaaggtaattaaaatcacaattaactgtatctctctctgtctctatttctctgcctctctctgtctttctgttttagtctgggtctctgtctctctgtctttctgaatctctcttccctgatctccgtgtgtcacactgtcaaacccaggctggagtgaacgtgtgtggtcacagctcactgctgatcatgtacctgcactccagccagggtgtgacagactgagaagacctggctaaaaaaatatatgtgtatatataaaacatcaacttcagcatacaggaaagagcgtaaaaaaaaaataagagagagagagagaatgagagcaaagaacaaagaagaacaactatagcaactctctctaagtactgtggaagcaaactgaaagtggggttagaaataaaacagaggaacaatgtctgagtagtcccaggtactcgggaggccaagatgggaagaccacccgggtgagactggggagatccaggctgcagtgaatcatcatcacatctctcttctggacctcaatggtaccgctgccagcaagagccaaatggtcaaccttaaacatggcaagctggcggccaagtccaacactcgt

SEQ ID NO: 149573 - DNA, 601 bp, Human
aaagccaggcgcggtgcctcatgcctgtaatcccagcactttgggaggctgaggtgggtggatctcatcaactttagcatccaggaaggagcataaaagattttaaaaagagagagagagcaaagaacacagaagaaaaaccacagcaactccctctaagtgctgttgaagccaactaaaagtggggctagaaaaaaaaacagaggaagaagcttgagtagtttcacgtactcgggaggccgaatggaaagaccacctgggcaagactgaggagatcgaggctgcagggaatcacaatcgyatccttctcctggacctgaagagtactgccactggtgaccgctttctggtctaccttagacatggcaagctggtggccaagtccaatgctcatggctgaagtctgtcttaacataaataaactaacaactaacagtaaatatttaacaataataagtaataacaaataataacaagacaaataagtgagagggaacacagataaaaggtaattaatgtcacaattaattgttgtctctctttctctgtctctctcttcctcaatctccatgtgtcacactttcacacccaggctggagtg

SEQ ID NO: 149574 - DNA, 601 bp, Human
ttatggccatcatctggactgagcatgtgcactcttcccaaacagaccaaaacaaaacaaaatgagtcactcatgccaaaagtgagctaatcaaacctaaaatttaagaaaatagctagatcttagaccagtttttctttgggaggcggaggcgagtggatcacctgaggtcaggagttcgagaccagtctgaccaacatggagaaacccctgtctctactaaaaatacaaaattaaagccaggcgcggtgcctcatgcctgtaatcccagcactttgggaggctgaggtgggtggatctyatcaactttagcatccaggaaggagcataaaagattttaaaaagagagagagagcaaagaacacagaagaaaaaccacagcaactccctctaagtgctgttgaagccaactaaaagtggggctagaaaaaaaaacagaggaagaagcttgagtagtttcacgtactcgggaggccgaatggaaagaccacctgggcaagactgaggagatcgaggctgcagggaatcacaatcgcatccttctcctggacctgaagagtactgccactggtgaccgctttctggtctaccttagacatgg

SEQ ID NO: 149575 - DNA, 601 bp, Human
agatagtgccactgcactccagcctggacaacaaagcgagatttcatcttaaaaaaaaaaaaaagaaagaaaaaaagataatggaaacagagtggcactaaggccctgagttttggtcacaccgtgacctatgtgagagcttacaaatagggtaatttttttttttttttgagatggaatcttgttctgttgcccaggctggagtgcagtggtgcaatctcggctcaatgcaaactctgcctcacgggttcaagtgattcttctgcctcagcctcccgagtagctgggactacaggtgtgyaccaccacgcccggctaatttttgtatttttactagagacggggtttcaccatattggccaggatggtctggatctcctgaccttttgatccgccagcctcagcctcccaaagtgctgagattacagacctgagccactgagcccggcctggggtgaattttttaaacaaaattatttatggccatcatctggactgagcatgtgcactcttcccaaacagaccaaaacaaaacaaaatgagtcactcatgccaaaagtgagctaatcaaacctaaaatttaagaaaatagctagatctt

SEQ ID NO: 149576 - DNA, 601 bp, Human
tttcattctttcttttttttttttttttgagatggactctcgctctgtcgcccaggctggagtgcagtggctcgatctcggctcactgcaagctccgcctcccaggttcacgccattctcctgcctcagcctcccgagtagctgggactacaggcgcccaccaccatgcctggctaatttttagcatttttactagagatggggtttcaccatgttagccaggacggtctcgatctcctgacctcgtgatccacctgtctcagcctcccaaaatgctgggattacaagcgtgagccactgygcccagcaataatattatttcttttaattacttattggatgaacagagaagtacctatgaagttgctaacacttgtagttgcacatggagaaatacgtagtgtaggctccctgagcctactctgcatccacggagatgcagttgcagcggattaatgaacagtgtgcttggttgaaatgagtagaccacttatctagctaactattcggcctatttaattttagttggtgtttcgtggggaccctggctaaaaagcatgcttcaaactcttggtatcattctcctgatagttgaaatagt

SEQ ID NO: 149577 - DNA, 601 bp, Human
cggccgccaccccatctggggaggtgtacccaacagctcattgagaacgggccatgatgacgacggcagttgtgttgaatagaaaagggagaaaagggggaaatgtggggaaaagatagagaaatcagattgttgctgtgtctgtgtagaaagaagtacacataggagactccattttgttctgtactaagaaaaattcttctgccttgggatgctgttgaccttacccccaacctggtgctctctgaaacatgtgctgtgtccactcagggttaaatggattaagggcggtgcaagatgygctttgttaaacagatgcttgaaggcagcatgctcgttaagagtcatcaccattccctaatctcaagtacccagggacacaaacactgtggaaggccccagggtcctctgcctaggaaatccagagacctttgctcacttgtttatctgctgaccttccctccactattgtcctatgaccctgccaaatccccctctgtgagaaacacccaagaatgatcaataacaaaaaaaagaaaaaaaatgttattatattaagccctcttccttctaataaagtctatacaaatacacacataca

SEQ ID NO: 149578 - DNA, 601 bp, Human
gaaagcgatcccaagctctggctgcagcgagagacaaaagccccgccaaatgccggatgccacgccctcctctccaactgtgccactgattcgataaagcaccagcactcgcccagtaccactccctccacccccaggaaaacaggctaaagcagggagtgtcaaccatagggaattacagccaattaagaagtaagctgagacttgaaatgaacttgctctttcccttacctgggtctgcttgtataatgcatcttatttgctacttaagggtaagaaaagaacatttggattatttttrtttgtttgagactgagttttgctcttattgcccaggcttgagtgcaatggtgtgatcttgtttcactgcaacctctgcctcccaggttcaagtgattctcctgcgtcagcctcccgagtagctgggattacaggcgcatgccaccacacccagctactttttgtatttttagtacagacggggtttcgccaagttgggcaggctggtctcgaactcctgacctcaggtgatcctcccaccccagcctcccaaagtgctgggattacaggcgtgagccaccatgcccggcccatttgaaca

SEQ ID NO: 149579 - DNA, 601 bp, Human
agctccagatagggcgccgcagggactgggcgggacgcgcgggtcattgctgcgggcccagccaccatcttgcggccagagggacctgggacggagctgcgccagcagggactcaggtcggcaacccaggagcggtgaggaggccagtcccgtcggtttctcagccagctctcccctctcgggatgctcaacccctcacactcaccctttcccaccttctggaatgtcctggcatcttagctgtctgtgcacgtcccaggacctgcagatcacagggcaacagcctgtcaccggctggggsgagaggggggcagaggtggaggacgttgaatagcagaaagcgatcccaagctctggctgcagcgagagacaaaagccccgccaaatgccggatgccacgccctcctctccaactgtgccactgattcgataaagcaccagcactcgcccagtaccactccctccacccccaggaaaacaggctaaagcagggagtgtcaaccatagggaattacagccaattaagaagtaagctgagacttgaaatgaacttgctctttcccttacctgggtctgcttgtataatgcatcttatttgcta

SEQ ID NO: 149580 - DNA, 601 bp, Human
atctcatttttttttaatgggtgcacagtactccatggtgtatatgtactacactttctttatccagtctatcattaataggcatttaggttgattccatgcctttgctattgtgaattgtgctgcaatgcacatatgcatgcatgtgtctttataatagaatgattcacattgctttgggtaaatacccaataatggattgctaggtcaaatggtattttgtctctaggtcttcaaggagttgccacactgtcttccataatggttgaactaatttacactcccatcaacagtgtatacrcgttcctttgtgaaaaaataattttaattttctaaaaggttagctttctaagacaaatggtatgcgaggaaatttccacaggcctaagccatccagctgctcttctgagaggctacactcttcctcctcaggctgtcctctaagagatgacccaggggatgatattcattagacactccaagagatatggccactgtgggcatcttgggttatccctgacggttctgaaaatcatgaacaagaaaagaccggagggctgccacaaagggccctggaatttctccaaagcaaaacttcaac

SEQ ID NO: 149581 - DNA, 601 bp, Human
tataagtgagaatatgtagtagtttgttttgcttttttttttttttttgagatggagtttcgctcttgtcacccaggctggagtgcagtggcactatctcagctcactgcaacctctgcctcccgggttcaagagattctcctgcctcatcctcctgagtagctgggattacaggcatctgccaccacgcctggctaattttttgtatttttagtagagatgaggtttcaccatgttgctcaggctggtatcaaactcctgacctcagatgatccacctgccttggcctcccaaagtgctrgaattacagctgtgagccaccacatccagctagtatttagttttctattcctctgtttgctaagaataatgtcttatggctctatccacgttcctgcaaaggacatgatctcatttttttttaatgggtgcacagtactccatggtgtatatgtactacactttctttatccagtctatcattaataggcatttaggttgattccatgcctttgctattgtgaattgtgctgcaatgcacatatgcatgcatgtgtctttataatagaatgattcacattgctttgggtaaatacccaat

SEQ ID NO: 149582 - DNA, 601 bp, Human
gggttctatttaaaatcatgcaaccaggaaaagcagacatgagaaacttactacactcactctggagaagataaaggtaaataagaatctttaatacataaaatatatgagtagatttttctgaaatatacctttcatagtctgactttttaaacatcttttaaactcttctgataaaatataagttacagttattaaaaaactgaaatagtaatgtgaaaaaatctttccaaggtaaaaaactcaggaagaggcacatgccacaatgcctgactaatgtttttgtatttttagtagagayggggtttcaccatgttggccaagctggaaataattttttactctgcggccaggtgtggtggctcatgcctgtaattccagctacttgggaggctgaggtgagagaatcgcttaaaggcggagggaggctgaggtgagagaatcgctgggaggcagaggttgcagtgagccgagactgcaccactgcactttagcctgggcaacagagaaagactgtctcaaaaaaaaagcatactctgcactagcagcattaacacaaaaagttctagtaaaccctgacacccactcaaatgtcacatcc

SEQ ID NO: 149583 - DNA, 601 bp, Human
gtggaaatatattcactttgtatagccataatgaaaaaaagatttttcctatttcttttctctggtagcattcccaaagcaaagccctggggttctatttaaaatcatgcaaccaggaaaagcagacatgagaaacttactacactcactctggagaagataaaggtaaataagaatctttaatacataaaatatatgagtagatttttctgaaatatacctttcatagtctgactttttaaacatcttttaaactcttctgataaaatataagttacagttattaaaaaactgaaatagwaatgtgaaaaaatctttccaaggtaaaaaactcaggaagaggcacatgccacaatgcctgactaatgtttttgtatttttagtagagatggggtttcaccatgttggccaagctggaaataattttttactctgcggccaggtgtggtggctcatgcctgtaattccagctacttgggaggctgaggtgagagaatcgcttaaaggcggagggaggctgaggtgagagaatcgctgggaggcagaggttgcagtgagccgagactgcaccactgcactttagcctgggcaacagagaaag

SEQ ID NO: 149584 - DNA, 601 bp, Human
caatgcaccaattaatctatcacatttgcttgtggaaatatattcactttgtatagccataatgaaaaaaagatttttcctatttcttttctctggtagcattcccaaagcaaagccctggggttctatttaaaatcatgcaaccaggaaaagcagacatgagaaacttactacactcactctggagaagataaaggtaaataagaatctttaatacataaaatatatgagtagatttttctgaaatatacctttcatagtctgactttttaaacatcttttaaactcttctgataaaatrtaagttacagttattaaaaaactgaaatagtaatgtgaaaaaatctttccaaggtaaaaaactcaggaagaggcacatgccacaatgcctgactaatgtttttgtatttttagtagagatggggtttcaccatgttggccaagctggaaataattttttactctgcggccaggtgtggtggctcatgcctgtaattccagctacttgggaggctgaggtgagagaatcgcttaaaggcggagggaggctgaggtgagagaatcgctgggaggcagaggttgcagtgagccgagactgcac

SEQ ID NO: 149585 - DNA, 601 bp, Human
acatctgcaggggaggctcctcaggcagaagagctgctttttcaatgatctccctttgcaggcaaaactatccttagcttgcagtcactgagttcaggcttctacttcccagtcaggattattcacttagtttgaaataagaaaatgaccaatgtatggccagacatgatggctcacgcctgtaattgcagcactttggaaggctgaggcaggtggatcacttgaggtcaggagttcgagaccagcctggcaaacatggtgaaaccctatctctactaaaaacacaaaaattagccgggcrtggtggcatgcgcctgtaatcccagctattcagaaggctgaggcacgagattcccttaaacctgggaggcgcaggttgcagtgagccaagatcgtgccactgcactccagcctgggtaacagagtgagactcagtctcaaaaataaataaataataataattaaaaaaatgaccaatgtttcaaaaaagtgcaaaatcactccaacacactgtttatagaatagtgtaaggaaattgtaagacttaaattttcaactacaatataaaaagcttaagtaaggctgggcatggtggctcaca

SEQ ID NO: 149586 - DNA, 601 bp, Human
aagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgtgcctgcttgtagtcccaactactagggaggctgtggcaggagaatggcttgaatctgagagactgaggttgcagtgagccgagatcatgccactgtactacagcgtgagtaacagaatgagaccctggctcaaaaaaatawaaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgtggatttcaaggttttcaaggctctgtggcttctctaagtataaaggctctgtccatggctattgtgagcaggccaggacatctgcaggggaggctcctcaggcagaagagctgctttttcaatgatctccctttgcaggca

SEQ ID NO: 149587 - DNA, 601 bp, Human
aaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgtgcctgcttgtagtcccaactactagggaggctgtggcaggagaatggcttgaatctgagagactgaggttgcagtgagccgagatcatgccactgtactacagcgtgagtaacagaatgagaccctggctcaaaaaaawataaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgtggatttcaaggttttcaaggctctgtggcttctctaagtataaaggctctgtccatggctattgtgagcaggccaggacatctgcaggggaggctcctcaggcagaagagctgctttttcaatgatctccctttgcagg

SEQ ID NO: 149588 - DNA, 601 bp, Human
taaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgtgcctgcttgtagtcccaactactagggaggctgtggcaggagaatggcttgaatctgagagactgaggttgcagtgagccgagatcatgccactgtactacagcgtgagtaacagaatgagaccctggctcaaaaaaatataaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgtggatttcaaggttttcaaggctctgtggcttctctaagtataaaggctctgtccatggctattgtgagcaggccaggacatctgcaggggaggctcctcaggcagaagagctgctttttcaatgatctccctttgcag

SEQ ID NO: 149589 - DNA, 601 bp, Human
tcgcactgatgatcaaaggtcagttcctggtcaataaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgtgcctgcttgtagtcccaactactagggaggctgtggcaggagaatggcttgaatctgagagactgaggttgcagtgagccgagatcatgccactgtactacagygtgagtaacagaatgagaccctggctcaaaaaaatataaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgtggatttcaaggttttcaaggctctgtggcttctctaagtataaaggctctgtccatggctattgtgagcaggccaggacatctgcaggggaggctcctcaggca

SEQ ID NO: 149590 - DNA, 601 bp, Human
acaccagccctgggaacacaaagcagaatgaaaggaggaaggagagaagaaagaaaggtaggaaggaaggaaaaataaaaccaaaaaagttcagggaacatcactcgcactgatgatcaaaggtcagttcctggtcaataaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgwgcctgcttgtagtcccaactactagggaggctgtggcaggagaatggcttgaatctgagagactgaggttgcagtgagccgagatcatgccactgtactacagcgtgagtaacagaatgagaccctggctcaaaaaaatataaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgt

SEQ ID NO: 149591 - DNA, 601 bp, Human
gaattttgacaccagccctgggaacacaaagcagaatgaaaggaggaaggagagaagaaagaaaggtaggaaggaaggaaaaataaaaccaaaaaagttcagggaacatcactcgcactgatgatcaaaggtcagttcctggtcaataaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggygttgatgtgcctgcttgtagtcccaactactagggaggctgtggcaggagaatggcttgaatctgagagactgaggttgcagtgagccgagatcatgccactgtactacagcgtgagtaacagaatgagaccctggctcaaaaaaatataaaataaaataaaaataaataaataaataacttcttacctaaatctagattcatcatattttacaaaatctagaaacaacctcagaacaataacaactccattcccagaaagagcctcccaaccccacctttgtgccaatcccaactgcat

SEQ ID NO: 149592 - DNA, 601 bp, Human
agctcgcccctgaaaacgtccctctggcgtctaagtctgcgagcttcccatcactccctgggtgacagagtgagactccatctcggaaaaaaaaaaaaaaaaagatgatggggaagaaggaagggagggagggagggaggaagagaggaaaaggaagaatgaaaaggaaaaacaagaagaaaataaaagaggacagagcatggtggctcaaacctgtaatctcaacactttgggaagctgaaatgggagaattgcttgagcacagaattttgacaccagccctgggaacacaaagcagaakgaaaggaggaaggagagaagaaagaaaggtaggaaggaaggaaaaataaaaccaaaaaagttcagggaacatcactcgcactgatgatcaaaggtcagttcctggtcaataaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggcgttgatgtgcctgcttgtagtcccaactactaggga

SEQ ID NO: 149593 - DNA, 601 bp, Human
ctctacaaaaataaaaagtaaaatatacaaaataaagtgccagtgtggtggcgcatgcctttagtcccagctactgggaagtggggtgtctgagacgggaggatcacctgagcccagggaggtcgaggctgcagtgagctgtgatcatgcacctgcactttagcctgggtgaaagaaatctaaaacaacagcaacttcagtgtacgggaaggagcaagagagacaaagagaaaaaaagaaaaaaacaacagaactcaatgtactgtgaaaacaaactcaaagtggtgctaaaaaaaaaaaaaaaaaaaaaaaggaaaagaaaaagaaacagaaagatcctgagagccccacctatttgggaggccaaaataagaggatcaactggatgagcctaggaaggtaaagagtgcagtgagccatcattgaactcctctgctggaccgaagctgtactgtcccggtgagagccatctggtccaccgtaaacatttccagctggcaaccaagtcctacgctcgtggcccacatcctgtacacctggcagccagaaagagaagccagctggtggtggtggcagaagcagaagcccactgtgtctaccc

SEQ ID NO: 149594 - DNA, 601 bp, Human
agctactcgggaggctgaggcaggagatttgcttgaatccaggaagcggagattgtggtgagccgagattgtgccattgcgctctagcctgggcaatgagagtgaaactccatctcaaaaaaaaaaaaaaaaaaaaaaaaaaatgaccagaccaggcacagtggctcatgcctgtaatcccagcagtttgggaggccaaggcgggagaatatctggagcccaggattttgagactatcctgggggccacatggtgagacaacacctatattaaaaaataataattacagttaaaaaaaaawatatatatatatgaccagcgcctgaaaaacatagcaagaacacatctctactgaaaaaaaaaaaaaaaaacatagatgattgattggtagacagagagacacacagatagacagatagatagatatagatagaaccagtcatggtggctcacgcctgtaagctcagtaatttgagaggtctaggccagcacatcgtctggctgcaggagtttgagatcagcctggaaaacatgatgggaccctatctctacaaaaataaaaagtaaaatatacaaaataaagtgccagtgtggtggcgca

SEQ ID NO: 149595 - DNA, 601 bp, Human
aaaatgttcagggatgagattatacatctggactgggaagaatcaacacatcaaaaatatgaccaggccgggcacagtggctcccgcctgtaatcccagcactttgggaggccgaggcgggcggatcaccagaggtcgggagtttagaccagcctgaccaacatggaaaaaccccgtctctgctaaaaatacaaaattagccagtgtgctggcacatgcctataatcccagctactcgggaggctgaggcaggagatttgcttgaatccaggaagcggagattgtggtgagccgagattgygccattgcgctctagcctgggcaatgagagtgaaactccatctcaaaaaaaaaaaaaaaaaaaaaaaaaaatgaccagaccaggcacagtggctcatgcctgtaatcccagcagtttgggaggccaaggcgggagaatatctggagcccaggattttgagactatcctgggggccacatggtgagacaacacctatattaaaaaataataattacagttaaaaaaaaatatatatatatatgaccagcgcctgaaaaacatagcaagaacacatctctactgaaaaaaaaaaaaaaaaac

SEQ ID NO: 149596 - DNA, 601 bp, Human
gacccagtgatatgtcacaatgcccactgtgggaagtgccaaagcagtagaacagttacatcactttggtgctgggtccagtgatatgtcacaatcccttctgtaagctgggcaggagcatcaactcactctggtgtcgggtaaagtcatatgtcataattacactatcaaaaatgttcagggatgagattatacatctggactgggaagaatcaacacatcaaaaatatgaccaggccgggcacagtggctcccgcctgtaatcccagcactttgggaggccgaggcgggcggatcaccrgaggtcgggagtttagaccagcctgaccaacatggaaaaaccccgtctctgctaaaaatacaaaattagccagtgtgctggcacatgcctataatcccagctactcgggaggctgaggcaggagatttgcttgaatccaggaagcggagattgtggtgagccgagattgtgccattgcgctctagcctgggcaatgagagtgaaactccatctcaaaaaaaaaaaaaaaaaaaaaaaaaaatgaccagaccaggcacagtggctcatgcctgtaatcccagcagtttgggaggccaaggc

SEQ ID NO: 149597 - DNA, 601 bp, Human
agcagggtccaggcaggagactcatatcacatttgttctgggcccagcaatatatcaccataccttctgagggcagtgccatgacaaaagagtaatgtcaccttagtattaggcctagtgacatttcacaatatcccctgcaggcaaaacacaggaagaggagaaaagtcacattagctaggtgctgagcccagtgatatgtcacaatcccttctgtgagcaggggccaggcaggagaagagagtcacattacctgtgtgatgggtgcagggttatatcacaatgtccgctgtaggcaggmccgaggcagtagagttacatcacctgggtgttggacccagcaatatgtcacaatggcctacatgggtagggcacaggcaggagactcacataacctatgtgtggggcccagcaatatgacacaatgccccctgtgaaagagccaggctggagagaagattcacaccatctgggtacaagacccagtgatatgtcacaatgcccactgtgggaagtgccaaagcagtagaacagttacatcactttggtgctgggtccagtgatatgtcacaatcccttctgtaagctgggcaggagcatc

SEQ ID NO: 149598 - DNA, 601 bp, Human
ctgcataagagcttcagaacctcaacagtgagctgtgtttatgtggaaggatgacagtctttactgttggcaggctatgcatatgagtgtcacaacctcctctgtgtgctgagttctgttaggacattctctgtacctcttgacaactttacacagtatgtgacagagtgttctttatgaccttcatacaaagaggagacccaagacattactcattttcctgaccctggctatgagagatagtgtatctgctattggttttttcgaagtttgaaaatcattattgcacctttaagtttgracaagatatgcatcacaatcccaccaatgaaaagggactgactagtagactcacagcacctgcattttggggcagtgatatgtcagaatctcctctgagggcagggacagggcagaagtgtcacaccacctgggtgctcaattagggatacgttacagtctcctcctgaaagcagaatacagtcagcagtcacatcacctggatgctaggcccagtgatatgttacaatgatctgtgggcaaggaccaggaaggaaaaacagatcacctgattcctgagaacagtgattcatcacaatct

SEQ ID NO: 149599 - DNA, 601 bp, Human
tactctaaagtcatgtttgtaagcacccatgaccatacttgtggctctaagtccaggtattagagccaacatctctccagttggtagggtttatatagtagagtcctcatctgctatgttctgagtttagaagtgtgtcaccatctcaactgtggccggaggctcatatatgacagtcacaattccaactctggacagtgtttgcatttgagattcaagacctcagcaatgggctcttttcatgtgtaagggtgataatcctaatggttggtgaggtgtgcatataagaaacaatctcacytttgtgctgtgtgccttgggataacactctttgtaacactcgagggcattatatgatatgttggagggtggcaattctgtatgaccttcataaaaagagaagaccaagaatgtgactcatttttctaagtcgagctatgagagacagtatttcttctaatagctgactagaggtatgagagtcatcattacacttataagctgactacagtacatgcctccatttaacctgtaggtagagagttagcaggagagtcacatcacctgggatttcagccaagggtatctcacaatcttccct

SEQ ID NO: 149600 - DNA, 601 bp, Human
aggagttacaatctcaacagtagacaaaatttgtacctaacagcccatactcctgctgtggacttagtctaattagtgaagtcacagcctcataggcgtgctgattcttgctctgaatgtcaccaactcacctgtggactggatccaaatatgagagtcaagttttccacctttgacttcctctatgtgtgagattcagaactcacaatgatgatgtgtactgtttgatgggtgttcatacaatggtaaaagtctcctctgtgtgctgggtcttgttagtacactttttttctttttttttgagatggagtctcacaatgtcgcctgggctggagtgcagtggtgcgaccttggctcactgcaacttctgcttcccgagttcaagcgattctcctgcctcagcccccggagtagctgaaattacaggcgcctgtgagggatcagtcagaatggtaagaaaaactatagggaaaggacgcaaaccttctgaaagttcggaaggttctgcaaagacccaggggagaatagctgaaggcagctgctttataaccctgaggcagagggccaggagtaggtacagtggagtgtaggggaatttatc

SEQ ID NO: 149601 - DNA, 601 bp, Human
cacatgatatgtcgcaactccccctgtgagcagggaccaggcaggagaagaaagtcacatcatgtgggtgaggtgtgaaaatatatgtcacaatgctccttgtgggtagtagagttgcattaccagggtgtatgtcccagcaatatgtcacaattgcttatgtggtcaggtgacaggtaggaaagtcaaaaaacctggtgtggggcccagagatatgtgacaatgcattctgtgggcagtgccaaggcaaaggagactcacatcacctaagtgcaaggcccagcgatatgtcacaatgccycctgtgagcagcaccaatgcagaaaaagagagtcagttctgggttcagctatatgtcactattccatctgtaggcaagacagtcagatcactcaggtgctgggcagagaaatatgttccaagtaaacctgtgagaaggtgcagggatcaaattaacaatcccacacatgttccggttttaggtataggaggttaacccttcctatatgttgtgtctaagaacaggagttacaatctcaacagtagacaaaatttgtacctaacagcccatactcctgctgtggacttagtctaattagtg

SEQ ID NO: 149602 - DNA, 601 bp, Human
cctgtctctactataaatacaaaaattagccgggcgtggtggcacatgcctttaatcccagctacttgggaggccaagtcaggacaatcgcttcaacctaggaggcagaggctgtagtgagctgaaatcatgccgctgcactccagcctgggcaacagagtgagactccatctcaaaaaaaaaaaaaaaaaaggaaagaaaagaaaagaagagttacaccagctaggtgtattgggcctagcaatatgtcacaagttgttttgtgagaaggaactaagcagtaaaagggaatcatattacytgggtgatgagcatagagatatgtgacaatgactcctgcaggcagaacccaaacaagagagtgacattacctgggttttagacccagcaatatgtcacagtgacccatgtgggcaaagcagaggcaggagagtaacataacctagtggggagggcagcaatatttcacaattttcattgtggacggcaccaaagcaggagagaaaactcccatcacttgggtgcaaggcccagtgatatgtcacgatgccccatataaaaacacagaggcaagaaaatagagtcacatcacctagtttct

SEQ ID NO: 149603 - DNA, 601 bp, Human
gcattctcatagcttagttcccacttacaagtgagaacatacaatgcttggttttttattgctgagttacttagaataatggtctccaactaaatcgagattgctgcaaatgctattattttattcctcgttagggctgagtagtatgcattggtatatatatgccacattttctttttccactcattagctgatgggcattaggctgcttccatatttttgcaattgcaaattgtgctgctataaacatgtgtgtgcaagtgtcttacacatataatttctttttcttcatgtagatacrcagtagtagaattgcttaatcaaatggtagctttacttttatttaatgaatctccatactgtttttcatagtggttgtactagtttacatacccaccagcagtgaaaaagtattcttttttcaccacagccacgccaacatgtattattttttgatgttttaatcatggccggttttgcaggaatatattggtttggttcagaaaggcgggacaactcaaagcgggcggcttccaggtaaatttaaatattttgtggttgacaagtggtggaatctgaagacctgggatcaatgaaaggg

SEQ ID NO: 149604 - DNA, 601 bp, Human
gttctaaattgctcttcaaagaatcagtatgtcagtatattcagctccctgttcttcattctccattttaaagtttaacttctttgttgtttttgtctccagttttagtaaacaaccttcccgccagttctaatcagtagtttacatctgtacccctggtcacctgctccatcctgagtcacccctggtcacctgctctgacctgagtcaccttggtcacctgttccataacagtagttcccacccaaactgctcaccccaccactctggcttgtactcctcctctctttaaaatagccartgggaattagcttagactgtgcagtccaaccctagccaataggggaatgacacagcagtaggggctacctgcatcagggctaagaactcctttccctcccttgttcaggtgtgctcttgccattgctccattcgcaagatgcacccttctataaaagtaaatattgtcttgctgagaaaatttacattcaagtactatttcctttgcggcatcaaaaatttgcttctaacatttaataaaagattttttttttaattttctgtaaacgaatctaaatatagttagcttttttataacata

SEQ ID NO: 149605 - DNA, 601 bp, Human
tgacccaaaaacattctggtaagatagctgcgtctagggaaaatagacgaaaaaaacgcacagagatattttaccatacagtgtcaggagattattctttgctttcttctcacagggagtatttaccaaaaaaaacaaatctttttaaatgtgccatcaaatgctttgtcaaaaaaaaaattaattggccagatgcggtggctcacgtctgtaatcccagctctttgggaggccgaagtgggcagaccagctgaggccaggagttcgagaccagcctggccaacatagtgaaaccctgtcwgtactaaaaatacaaaaattagccagacgtggtcgtgggcacctgtaagtccagctacttgggagactgagagaggagaatcatttgagcccagtaggcggaggttgtagtgagcctagtgcgtcactgcactccagcctgggtgacagagcaaggctctgtctcaaaaattaaaaataaaaatgattaaaatcggtatcaaaatgtacactacaggacaaatagttgataaagtgaattagggaggggaaattggcatttgggaatgtcagacgaaactggaaatttagtattttactg

SEQ ID NO: 149606 - DNA, 601 bp, Human
agaaaaaactgaagggtgactgaagacacatcaccctatacagtttccaaaaggaaaacctgacccaaaaacattctggtaagatagctgcgtctagggaaaatagacgaaaaaaacgcacagagatattttaccatacagtgtcaggagattattctttgctttcttctcacagggagtatttaccaaaaaaaacaaatctttttaaatgtgccatcaaatgctttgtcaaaaaaaaaattaattggccagatgcggtggctcacgtctgtaatcccagctctttgggaggccgaagtgrgcagaccagctgaggccaggagttcgagaccagcctggccaacatagtgaaaccctgtctgtactaaaaatacaaaaattagccagacgtggtcgtgggcacctgtaagtccagctacttgggagactgagagaggagaatcatttgagcccagtaggcggaggttgtagtgagcctagtgcgtcactgcactccagcctgggtgacagagcaaggctctgtctcaaaaattaaaaataaaaatgattaaaatcggtatcaaaatgtacactacaggacaaatagttgataaagtgaatt

SEQ ID NO: 149607 - DNA, 601 bp, Human
ctgccgggcacagtggctcatgcctgtaattccagcacgttgggaggctgaggtgggtggatcacctgaggtcaggagttcgagaccagcctggccaacatggtgaaaccccgcctctactaaaaatacacaaattagccgggcgttgtggcaagcgcctgtaatcccagctatttgggaggctgaggcaggagaatcacctgaacccaaaaggcagaggttgcagtgagttgagattgcactactgcactccagcctgggtgacaagagtgaaactccatctcaaaaaaaaaaaaaaaaagaaaaaaaaatagtcacatgggaacacttctaggaggtatcaagtttcatcacataaaatttagcattaaactcaaaaatcaaaataccaggatatagaaccaggcacgacagctcacatctgtaatcccagcactttgggaagctaaggtggaaaaatcatgagggcaggaatttgagagcatcctgggccacatggtgaaaccccatctctactaaaaatacaaaaattagctgggagtggtggtgcacgtctgtaatcccagctactggggagctgagacaggagaattccttgaat

SEQ ID NO: 149608 - DNA, 601 bp, Human
aacacagtgttcatataagggaagaaaagtttaaggtgtttacatcttatacctcagtaagaaaagcaaaagtatttattcctttcagacaataaatatattatgttattatttgtatcaaaaatcacgtagcaaacaattagtctgccgggcacagtggctcatgcctgtaattccagcacgttgggaggctgaggtgggtggatcacctgaggtcaggagttcgagaccagcctggccaacatggtgaaaccccgcctctactaaaaatacacaaattagccgggcgttgtggcaagcrcctgtaatcccagctatttgggaggctgaggcaggagaatcacctgaacccaaaaggcagaggttgcagtgagttgagattgcactactgcactccagcctgggtgacaagagtgaaactccatctcaaaaaaaaaaaaaaaaagaaaaaaaaatagtcacatgggaacacttctaggaggtatcaagtttcatcacataaaatttagcattaaactcaaaaatcaaaataccaggatatagaaccaggcacgacagctcacatctgtaatcccagcactttgggaagctaaggtggaaa

SEQ ID NO: 149609 - DNA, 601 bp, Human
aatcttaactgcatctgcgtgtgggttgccagctttccagggctctgtagattgtctcagtataggggcttcttccatagctgaggtgagcaagctgggacatctgcaggggaggctccccagaaggaactaagtgggtctttaaaaacctccttttgcaggctcaagcctgcaaaaggcttagcttggagtcactgggtttaagctttaatttctatgtcagagttattaacttggcttttgaaactataactaggtggtagaataattcagcaaaattatgcaaacacagtgttcatayaagggaagaaaagtttaaggtgtttacatcttatacctcagtaagaaaagcaaaagtatttattcctttcagacaataaatatattatgttattatttgtatcaaaaatcacgtagcaaacaattagtctgccgggcacagtggctcatgcctgtaattccagcacgttgggaggctgaggtgggtggatcacctgaggtcaggagttcgagaccagcctggccaacatggtgaaaccccgcctctactaaaaatacacaaattagccgggcgttgtggcaagcgcctgtaatcccagct

SEQ ID NO: 149610 - DNA, 601 bp, Human
agctgactttgtcttcagtggtaaacataaaatacttcttaatctaactgaacttaagtttattttcttcccacaggctcctgaactttgagctaccctcagtctgagccaccatacaaccccattttatgtttatcctaagaacatgctgacttcagggtaaaacattctcaaaatctgattttattaccctctgtttaaacattcccctcctacctccttactaatcttgtttgcttttccctaggaaaaaaagccactgtctgcctcatctttgcaatctttaaaaatcttatagtcrctacttcctcctgttgcaatactcctttgaaattcaagtttttacatacatctaacttttattttaaaaagtctagaaactgcctcaaaacaataacttcatcttcagtaagaccctcccaatacccttttatattaatcttaactgcatctgcgtgtgggttgccagctttccagggctctgtagattgtctcagtataggggcttcttccatagctgaggtgagcaagctgggacatctgcaggggaggctccccagaaggaactaagtgggtctttaaaaacctccttttgcaggct

SEQ ID NO: 149611 - DNA, 601 bp, Human
cacaaactctataagcccatctgtgcttctgagatactgtttagaaactggggactcccataatgttactgaaatttactaatttgttagagctactcacagaactcagcggaacactgtagtcatatttaccattttcacataaaagatacaacccgggacaggcgcgccagctcacttctgtaattccaccacttcgggaggctgagacaggcgaatcacctgagatcaggagttcaagaccagcctgaccaacatggagaaactctgtctctagtaaaaatgcaaaattagccaggcrtggtagcacatgcctgtaatctcagctacttgggaggtggaggcaggagaattgcttgaacccgggagacggaggttgtggtgagccgagattgtgccattacactccagcctgggcaattagagtaaaactccgtctcagaaaagaaaaaggtacaaccccaacaaagtcatgtgaaaaaaatgtataagaccaagaataaaggtggaaaaagatgaagcacatagatgataaacagctgtgattaataaaattctctatcttttgtgttctccaagaacactttatggtgggggggcg

SEQ ID NO: 149612 - DNA, 601 bp, Human
caccctggaaggggagctggaatcacagaacaagggacagtgtgacagcctgtgtagagtgcacagcctctcattcctggacacccagaggtttattctaatccaggagtctgtggtatctttcttctggcaccaaatctgtagagtttgctaaacaccaagcaattctccaacaccaacttattatctaaaacttcaattctgacaccacccagagtcagcacagaccttgattcagggctcagtcccacaacattgtcctcactgcagatgccagtcacaaactctataagcccatctrtgcttctgagatactgtttagaaactggggactcccataatgttactgaaatttactaatttgttagagctactcacagaactcagcggaacactgtagtcatatttaccattttcacataaaagatacaacccgggacaggcgcgccagctcacttctgtaattccaccacttcgggaggctgagacaggcgaatcacctgagatcaggagttcaagaccagcctgaccaacatggagaaactctgtctctagtaaaaatgcaaaattagccaggcatggtagcacatgcctgtaatct

SEQ ID NO: 149613 - DNA, 601 bp, Human
caaaaggggatctgccatcagagctcctttcctctaagttttaggtcctctgtcaccctggaaggggagctggaatcacagaacaagggacagtgtgacagcctgtgtagagtgcacagcctctcattcctggacacccagaggtttattctaatccaggagtctgtggtatctttcttctggcaccaaatctgtagagtttgctaaacaccaagcaattctccaacaccaacttattatctaaaacttcaattctgacaccacccagagtcagcacagaccttgattcagggctcagtcycacaacattgtcctcactgcagatgccagtcacaaactctataagcccatctgtgcttctgagatactgtttagaaactggggactcccataatgttactgaaatttactaatttgttagagctactcacagaactcagcggaacactgtagtcatatttaccattttcacataaaagatacaacccgggacaggcgcgccagctcacttctgtaattccaccacttcgggaggctgagacaggcgaatcacctgagatcaggagttcaagaccagcctgaccaacatggagaaactctg

SEQ ID NO: 149614 - DNA, 601 bp, Human
ttttggcaaaaaaaaaaaaaaaaacactaggatcaaaaatgctgtagtaaaattcctgagtgtggttccctgtcctgggagaggtgtggacacattaatgtctagtgggtatgttagtgagtgggtgaaaatcttgtggtggtggctgtggcaaaaggggatctgccatcagagctcctttcctctaagttttaggtcctctgtcaccctggaaggggagctggaatcacagaacaagggacagtgtgacagcctgtgtagagtgcacagcctctcattcctggacacccagaggtttatwctaatccaggagtctgtggtatctttcttctggcaccaaatctgtagagtttgctaaacaccaagcaattctccaacaccaacttattatctaaaacttcaattctgacaccacccagagtcagcacagaccttgattcagggctcagtcccacaacattgtcctcactgcagatgccagtcacaaactctataagcccatctgtgcttctgagatactgtttagaaactggggactcccataatgttactgaaatttactaatttgttagagctactcacagaactcagcggaacactg

SEQ ID NO: 149615 - DNA, 601 bp, Human
aaatggaaaaccaaatgcatgttatttataagtaagagctaaataataaaaacatgaacacagaggggaacaacagacactgacgcctagttgagggtggagggtggcaggagaaacagggtcagaaaaaatacctctttggtgctatacttagtaccttagttacaaaataatctatacacaaaaccaccatgacacaattttagctgtataacaaacctgcatgtgtacccctaaaccaaaaatagaagtttaaaaaaaaaaactccctgggtagggaagagtacactccaggtagaargactggtttgtgctacagatagtggcccaggtggggctgtactctgatttatttctgggtccatgcaggcagatgagtttataaacaggtggtccagaaccccaggctggtggacaaaacagcctgctgctgcagattcagtgtctggaggtgggaatatgccagaagacttggagatacttctgtaagtttttggcaaaaaaaaaaaaaaaaacactaggatcaaaaatgctgtagtaaaattcctgagtgtggttccctgtcctgggagaggtgtggacacattaatgtctagtgggt

SEQ ID NO: 149616 - DNA, 601 bp, Human
ttattcttggaaaaccaatgcggaggccaaatgcagtggctcacgcctgtaatcccagcactttgggaggccaaggcaggcaaatcacctgaggtcaggagttggagaccagcctggccattatggtgaaacgccatctctactaaaaaatacaaaaattagccaggcatggtggtgggcacctgtaatcccaagctacttgggaggctggggatggagaattgcttgaacccaggaggtggaggttgcagtgaccaaagatcacgccattgcactccagcctggtgacaagagtgaaacyatcttttaaaaaaaaagaaagaaagaaaacgaatgcgtaaatggaaaaccaaatgcatgttatttataagtaagagctaaataataaaaacatgaacacagaggggaacaacagacactgacgcctagttgagggtggagggtggcaggagaaacagggtcagaaaaaatacctctttggtgctatacttagtaccttagttacaaaataatctatacacaaaaccaccatgacacaattttagctgtataacaaacctgcatgtgtacccctaaaccaaaaatagaagtttaaaaaaaa

SEQ ID NO: 149617 - DNA, 601 bp, Human
atgaagctggagaccattattcttggaaaaccaatgcggaggccaaatgcagtggctcacgcctgtaatcccagcactttgggaggccaaggcaggcaaatcacctgaggtcaggagttggagaccagcctggccattatggtgaaacgccatctctactaaaaaatacaaaaattagccaggcatggtggtgggcacctgtaatcccaagctacttgggaggctggggatggagaattgcttgaacccaggaggtggaggttgcagtgaccaaagatcacgccattgcactccagcctggtgacaagagtgaaaccatcttttaaaaaaaaagaaagaaagaaaacgaatgcgtaaatggaaaaccaaatgcatgttatttataagtaagagctaaataataaaaacatgaacacagaggggaacaacagacactgacgcctagttgagggtggagggtggcaggagaaacagggtcagaaaaaatacctctttggtgctatacttagtaccttagttacaaaataatctatacacaaaaccaccatgacacaattttagctgtataacaaacctgcatgtgtacccctaaaccaaaaat

SEQ ID NO: 149618 - DNA, 601 bp, Human
tcataaaaaacaaacagaaaacaataaccaaaaacattgtttttgtataattcatataaaaccaaattgtaaaattcatataaaaccacaacagaggctgaatagccaaagtaaacataagcaaaacaacaaaactgaaggcattacattacctgttttcaaattatactacagagctacagtaaacaaagtaacatggaactggtacagaaaaaaacaagattatgccctttatagcaacatgaagctggagaccattattcttggaaaaccaatgcggaggccaaatgcagtggctcaygcctgtaatcccagcactttgggaggccaaggcaggcaaatcacctgaggtcaggagttggagaccagcctggccattatggtgaaacgccatctctactaaaaaatacaaaaattagccaggcatggtggtgggcacctgtaatcccaagctacttgggaggctggggatggagaattgcttgaacccaggaggtggaggttgcagtgaccaaagatcacgccattgcactccagcctggtgacaagagtgaaaccatcttttaaaaaaaaagaaagaaagaaaacgaatgcgtaaatg

SEQ ID NO: 149619 - DNA, 601 bp, Human
aataccgtgtggtcataaaaaacaaacagaaaacaataaccaaaaacattgtttttgtataattcatataaaaccaaattgtaaaattcatataaaaccacaacagaggctgaatagccaaagtaaacataagcaaaacaacaaaactgaaggcattacattacctgttttcaaattatactacagagctacagtaaacaaagtaacatggaactggtacagaaaaaaacaagattatgccctttatagcaacatgaagctggagaccattattcttggaaaaccaatgcggaggccaaaygcagtggctcacgcctgtaatcccagcactttgggaggccaaggcaggcaaatcacctgaggtcaggagttggagaccagcctggccattatggtgaaacgccatctctactaaaaaatacaaaaattagccaggcatggtggtgggcacctgtaatcccaagctacttgggaggctggggatggagaattgcttgaacccaggaggtggaggttgcagtgaccaaagatcacgccattgcactccagcctggtgacaagagtgaaaccatcttttaaaaaaaaagaaagaaagaaaacg

SEQ ID NO: 149620 - DNA, 601 bp, Human
gaacaagagtattgcttggcccaccacgatggctcatgcctgtaatcccagaactttgggaggccaaggtgggtggatcacctgaggtcaggagttcaagactagcctggccaacatggtaaaaccccatctcttctaaaaatacaaaaattagtcgggcatggtggtggtgggcatctgtactcccagctactcaggaggctgagacaggataattgcttaaacccgggaggcagaggttgcagtgagctgagatggcactattgcacttcattctagacaacaagagtgagactgtctcaaaaaaaaaaaaaaaaaaaaaaggccaggcacagtggctcatgcctgtaatcccagcactttgggaggcagaggtgggcagatcacttaaggtcaggagttccagaccagcctggtcaacatggtgaaaccccgtctctactaaaactacaaaaattagcagggcgtggtggcgcacacctgtaatcacagctactcaggaggctgaggcaggagaattgctggaacccgagaggcggaggttgcagtgagccaagattatgccaccgtacttcagcctgggcaacagagtgagaccctg

SEQ ID NO: 149621 - DNA, 601 bp, Human
caatagcaaagacatggaatcaacttgaatgcctatcaatggtagactgaataaagaaaatatggtatgatcaggcacaatggctcatgcctgtaatcccagcactttgagaggccaaggcaggtggactgcctgagctcaggagtttgagaccagcctgagcaatatgggaaaatcccatctataaaaatgcatctctaaaaaaaatacaataagaaaaattagttaggcatggtggcacacacctgtggccccagctacttggaaggctgaggaacaagagtattgcttggcccaccaygatggctcatgcctgtaatcccagaactttgggaggccaaggtgggtggatcacctgaggtcaggagttcaagactagcctggccaacatggtaaaaccccatctcttctaaaaatacaaaaattagtcgggcatggtggtggtgggcatctgtactcccagctactcaggaggctgagacaggataattgcttaaacccgggaggcagaggttgcagtgagctgagatggcactattgcacttcattctagacaacaagagtgagactgtctcaaaaaaaaaaaaaaaaaaaaaaggcc

SEQ ID NO: 149622 - DNA, 601 bp, Human
tattgtttgcagacacacaagaaatctagcttggccaggattggcactagctacaaagggctggacgcgtcacattagaaatttacagaactttacagcactccaatattttctgagcaagaggaagtaaaaacatatttaacacctcagccttttttctagactcttttctatatattgcttgggctcaccgtagagaattctccagtgttaaaacttttctgttttcacatttgaattttacgggttttggagattttcttgtagttcttatatatccctatatattatatctatattrcaaaattttaactgtcagctacatgttggtaagatacaggcaaagtactactgtaactaagttatttttaaagtaaaaatatatttttacatgcctttggaaaaaaataattttaggatacaaaataaatggacaaaaattagtagcatccctgtgaatcaacaacatccaagccaaatgtgatcataaacataatcccattcacaattgctgcaaaaataataaaatatctaagaatacagctaaccaggaaggtgaaagatctctataagaattacaaaacaatgcttaaagaagtca

SEQ ID NO: 149623 - DNA, 601 bp, Human
cagatattgtttgcagacacacaagaaatctagcttggccaggattggcactagctacaaagggctggacgcgtcacattagaaatttacagaactttacagcactccaatattttctgagcaagaggaagtaaaaacatatttaacacctcagccttttttctagactcttttctatatattgcttgggctcaccgtagagaattctccagtgttaaaacttttctgttttcacatttgaattttacgggttttggagattttcttgtagttcttatatatccctatatattatatctayattacaaaattttaactgtcagctacatgttggtaagatacaggcaaagtactactgtaactaagttatttttaaagtaaaaatatatttttacatgcctttggaaaaaaataattttaggatacaaaataaatggacaaaaattagtagcatccctgtgaatcaacaacatccaagccaaatgtgatcataaacataatcccattcacaattgctgcaaaaataataaaatatctaagaatacagctaaccaggaaggtgaaagatctctataagaattacaaaacaatgcttaaagaa

SEQ ID NO: 149624 - DNA, 601 bp, Human
gggcttctgaagctgtatttgcagttttgtgatgggttttctaaaataatattcttataaagcatttttattttttacctgttatagcttgtttgcaaaaacaatttagaaaaaaaaaatcctgtcttggcaaaacgaggaaatctgtcagtcagaatccattttcagcaggcattggtgatgtttggctcagatattgtttgcagacacacaagaaatctagcttggccaggattggcactagctacaaagggctggacgcgtcacattagaaatttacagaactttacagcactccaayattttctgagcaagaggaagtaaaaacatatttaacacctcagccttttttctagactcttttctatatattgcttgggctcaccgtagagaattctccagtgttaaaacttttctgttttcacatttgaattttacgggttttggagattttcttgtagttcttatatatccctatatattatatctatattacaaaattttaactgtcagctacatgttggtaagatacaggcaaagtactactgtaactaagttatttttaaagtaaaaatatatttttacatgcctttggaaaaaa

SEQ ID NO: 149625 - DNA, 601 bp, Human
ggtacaaaaacaaactaaactaactgcagttgaacagaagggcttctgaagctgtatttgcagttttgtgatgggttttctaaaataatattcttataaagcatttttattttttacctgttatagcttgtttgcaaaaacaatttagaaaaaaaaaatcctgtcttggcaaaacgaggaaatctgtcagtcagaatccattttcagcaggcattggtgatgtttggctcagatattgtttgcagacacacaagaaatctagcttggccaggattggcactagctacaaagggctggacgygtcacattagaaatttacagaactttacagcactccaatattttctgagcaagaggaagtaaaaacatatttaacacctcagccttttttctagactcttttctatatattgcttgggctcaccgtagagaattctccagtgttaaaacttttctgttttcacatttgaattttacgggttttggagattttcttgtagttcttatatatccctatatattatatctatattacaaaattttaactgtcagctacatgttggtaagatacaggcaaagtactactgtaactaagttattt

SEQ ID NO: 149626 - DNA, 601 bp, Human
tcaccgcccaccacgccggaaccgcgcacagctagagccacttctgaagccacttgagaaaaatttgacagttcctaacgaaaaagattcttcagaaacatataccatctgtgaaaaaagttgccctttcttccgcttgcaaaacagacattctcaaattccaaaatgccagccaaggccccaatttacctgaaagcagccaataacaagaaaggaaagaaatttaaactgagacattctgtctcccgatatcatcagtccccctcttggaggcttttgccataccatccaaatcggcaaagagggccaagcatgacgtctttggagatatttcctttcttcaagggaacaatgagcttttacctggaaactaggagaaagcacacctgggtcagctccccgggcatagtaagttcttccgggccaacagcacctcagactctgtgttcacagaaacaccctcctcagtggtcaaaaataccatctccctcacgatcactggagggtcccaagctctcatgttgctcttattgtcaccggtgaactttaattccaaacaggagtcctttcggccagcaaagttgccaaggcttagctgcga

SEQ ID NO: 149627 - DNA, 601 bp, Human
taagaaaaagtaacttctctccaactcattatataagaacagcattattctgataccaaaacctggcagagataaaacaaaccaataaaattcaggccagtatctttgaacactgatacaaaaatcttcaacaaaatcatgacaaaatccagcagcatatccaaaagctaacccactatgagcaagtagaatttattttgggaatgcaaggttggttcaacatacacaaattaataaatgtgattcatcacataaaaagaactactaaagacagaaaccacaagattacctcagtagatgmagaaaaagcttttggtaaattttaacatctttcatgttaaaaatcctcaacaacctaggcattgaaggtacatgctttaaaataagttatctatgacaaaccctcagccccaatatactgaataaacaaaacctggaagcggatgggtacagtggttcagtcctgtaatttcagcaatttggcaggccaaggcaggtggatcgcctgaggtcaggagtttgagatcaacctggctgacatagcaaaaccccatctctactaaaaatgcaaaaattagccaggtgtggtggcgggtgcctg

SEQ ID NO: 149628 - DNA, 601 bp, Human
acaaatgaagacaaccattctctatcttaaagtatactacttgctggctctttaaagttcacaaagaaaacagaaaacagcaatttctgagtaagtctgcatttggaaaacaacatgtgcacatgtactaatgcaatgtttattaagcaggtactatgtaatcaacaggatgttacagagcactgtgataattcattatttgatttaattctaataacaccctgtgagttgatactaagtgttgaataatcccaaggatttagaataaggatccagcatttttatttcttcttctgttttcgtcactcatttttttaaaaaaatgcatagaataaaatctaaatatagacagatgagagggatacagatagagtgtaatgtaatttagatgaattattatgtttatatttactattttgtgacttgtgaatcaactactgtatctgcaggaacagaaaacaagttgctaaatggaatgtctctgtaaacactggttttaatataaaattattaaattaagaccctataatacatgttatttttccatttatctgctattgggtttcagaaaagtgtgagcaccaactctaaaaggcaacag

SEQ ID NO: 149629 - DNA, 601 bp, Human
gatcacaaattcatggtgagaattctgcatggcatataagaagccatcatgcagagaaggctctggtagatagaaaagaaatattttcagagatccttgactatcataagcttttttttttttctctttttttttgagacggagttttgctcttgttgttgcccagactggagtggaatggcacgatctcggctcaccacaagctctgcctcccgggttcaagcaattctcctgcctcagcctgccgagtagctgtgattacaggcatgcatcaccacacccagctaattttgtatttttygtagagacagggtttctccatgttggtcacactggtctcaaactgccaacctcaggtgatctgcccgcctcggcctcccaaagtgctgggattacagacgtgagccaccacgcctggcctatcataagcatttttaaaagtagttaagacaaactcattagggagaaaaaatacaggtacagaagtaaaaatttgcaagtactaaacgcgtggcattccacgaggcagagtggacacagctcttgatctgagacatgtttagctgaaaaaaagccattttttctctttctcctcctcctc

SEQ ID NO: 149630 - DNA, 601 bp, Human; identical to SEQ ID NO: 27367

SEQ ID NO: 149631 - DNA, 601 bp, Human; identical to SEQ ID NO: 27366

SEQ ID NO: 149632 - DNA, 601 bp, Human; identical to SEQ ID NO: 27365

SEQ ID NO: 149633 - DNA, 601 bp, Human; identical to SEQ ID NO: 27364

SEQ ID NO: 149634 - DNA, 601 bp, Human; identical to SEQ ID NO: 27363

SEQ ID NO: 149635 - DNA, 601 bp, Human; identical to SEQ ID NO: 27362

SEQ ID NO: 149636 - DNA, 601 bp, Human; identical to SEQ ID NO: 27361

SEQ ID NO: 149637 - DNA, 601 bp, Human; identical to SEQ ID NO: 27360

SEQ ID NO: 149638 - DNA, 601 bp, Human; identical to SEQ ID NO: 27359

SEQ ID NO: 149639 - DNA, 601 bp, Human
agggagtgtcttccacacaggaatttcatcttccactcttaagaaacaacaagaagatcagagtgatttttttgcacccgctgttatacaaatgtctttaacttagtcaatatgccagaatagcgtatcttaaccccttcacttcttgctaactaggccttgtactaaattagcaagatctcttctacaaggaagcacactgggaattaacccacaaatcaaaaagtcataagggtagaaatgactttaagaggacattcctttctgtttgttcttcaagggctgccttaaataattcttygcaaaatagaatctcttttctttgctaaatgataccagtggaatcctttatcttttcctcataggtctcattttctaactgatgaattgtctttgtgactctcacaaaaacttgtttcttatttccttccctctttctcctagtgggtaagagagaactcgttttctattagtgaagttctggttttagctcggatttcacactcccaagggacacagggccctaaaagttgtgcaccacgttttcgagatactgttatttattccagctggtactggtttggctatcataagtatctga

SEQ ID NO: 149640 - DNA, 601 bp, Human
atttaaatttttaaattcagtttttaaaataggtaatatatttaagtggttaaaaattcaaaggtacttggtaaataagtttcctttttacacctgtctctcatctgtctatttcctatctccctgcacaggcaaccactgatagtagtatcttccagagtttctttatgtgtatgcaagcaaaaacaaatatgtgttttatggaacttgaactccattaaaagcctttgttcttgtttttttcctgttgttttcttaaacctattgaagtcttaattttgttttttgtttttacttactrttatttttttttttggagacagagtctaactccaagttggagtgcagtgatgcaatcataggtcactgcagcctcaacctcctgggcaacctccatctctgtctcccaagtagctaggatcatacgcatgcgccaccacatctggctaatttttgtatttctcccacttttaaaagtttttcttgtttagtgaaaaattaaggactttttctctgttgcacaaagtgcctgtcttcactaaaaaaatgctctccaatgcttaataatttgttgaatacaaaatggccatatatactccta

SEQ ID NO: 149641 - DNA, 601 bp, Human
attcagtttttaaaataggtaatatatttaagtggttaaaaattcaaaggtacttggtaaataagtttcctttttacacctgtctctcatctgtctatttcctatctccctgcacaggcaaccactgatagtagtatcttccagagtttctttatgtgtatgcaagcaaaaacaaatatgtgttttatggaacttgaactccattaaaagcctttgttcttgtttttttcctgttgttttcttaaacctattgaagtcttaattttgttttttgtttttacttactattattttttttttkggagacagagtctaactccaagttggagtgcagtgatgcaatcataggtcactgcagcctcaacctcctgggcaacctccatctctgtctcccaagtagctaggatcatacgcatgcgccaccacatctggctaatttttgtatttctcccacttttaaaagtttttcttgtttagtgaaaaattaaggactttttctctgttgcacaaagtgcctgtcttcactaaaaaaatgctctccaatgcttaataatttgttgaatacaaaatggccatatatactcctaatgactatcttaag

SEQ ID NO: 149642 - DNA, 601 bp, Human
gtttttaggacaggtcctaaaaagtgcagtggtaagagcagtgcttctgggggaaaggattcatgttagccccctgtattgtatcttctcaagtcaaggagctctgaggtgtgctattccagggacttgggcttattatcaataccgccagttattcaactggacatgtgatcttgaggcaatttgtttaacctttctaccacttgttactttttaaaggaagagtatttcctatctgccatagtccatccctaacctatggtaggatagtatacaatcatgtgtcacttaacgatggggrtacgttctgagaaatgagttattaggccatttcatccttgtttgaatgtcacagagtgtacttacacaaatctagacgatgtagcctactgcacccctaggctatatggtatagcctattgctcccaggctacacacctgtacagcatgttaccatattgaatgctgtagacatttgtaacaccatggtatttctgtatctaaacatagctaaacatagaaaaggtaatgcattgtgctatagctacaactttatgacagatacaaggtcactgggcaataagaatttttcagcctcata

SEQ ID NO: 149643 - DNA, 601 bp, Human
tatgtaaacctcaataacaatattctgtgttaactgctctaatagaagtaagtacaagtgttatagggacacacaggagggaaggacaattctattgaagagagttgaatggggctgtcttcatagaggatgtgatctttgacctggacctttaaatattaaagtatggttaaaaaaaaattcacctgtcagagaagagatgagagagtagttcaggtgtgaggaacagtgcatataaaggccgagagacatgacacaggtttaattgtttaaaatagtgagtgtagctgtaactgaagcrtagagtgtggtttggtaagacaggagataaagcctagaggcaggttggagccaatgagtgcatcctaaggggttttgttttctctcacttccagagttcccaggttggaaataacctttgggacccgttttgagctagtgcagccttgctctggattcttgctctaacttgtgcacaagtgtccttcctgcaggcttgtgccaagtatgtggatccaaattaacagaaatattagccccttcttgtcatcttcttttttttttgagagagagagtcttgttctgtcacccaggctggagt

SEQ ID NO: 149644 - DNA, 601 bp, Human
agacaggagataaagcctagaggcaggttggagccaatgagtgcatcctaaggggttttgttttctctcacttccagagttcccaggttggaaataacctttgggacccgttttgagctagtgcagccttgctctggattcttgctctaacttgtgcacaagtgtccttcctgcaggcttgtgccaagtatgtggatccaaattaacagaaatattagccccttcttgtcatcttcttttttttttgagagagagagtcttgttctgtcacccaggctggagtgcagtggcacagtctcggctcactgcaacctccgcctcccgggttcaaatgattctcctgcctcagcctccctagtagctgggattacaggtgcacgccaccacgcctggctaatttttttgtatttttagtagagacggggttttgccatgttgaccaggctggtcttgagctcctgacctcaggtaatccacccgcctcggcctcccaaaatgatgggaatacaggcgtgagccactgcacctggccagccccttcttgtcttctaatggccactccgtgtttggagccaaagagctgaaggaatggcagtactgt

SEQ ID NO: 149645 - DNA, 601 bp, Human
ctgtgtgatagcagtggcagcatcataaccacatttaacgagtgcctgttctgtaccagccactgtgttaaggactccttgtgacccttcatttaatctttataacaacctgataaaattggaatagtgattgatggcacccactttatcaataagaaaactgagccttagcaaccttaacataagttgcctaagatcatgacagctaatgagtgacagagctgggtattgaatccaggtctttctggcctcaaagcctgtaaaccactctgctttgctgctttctaagagagaggagagygagaatagattctagaatatgaattcagtaaatagaggggttaatatgctttacataataagcctgcattttgctcttgcttagagcaactgtagtctgtgcactttaagaggttaaagtagaaggtgatcaaagtcaaatttatatcgaaggacaacaaggaagaatggccatggaggagggtcagacctgccctgccctgggaagcagcattgtgctggctcagcattgaagcaggtgcacagtgctgctgctctgcccggtatggcttcctgtgaccagaacgtgagcaggaagggt

SEQ ID NO: 149646 - DNA, 601 bp, Human
gccaggattaggattcccttgaatttcagttcagtggtcttgccttcagaagtgagcagggatgagattcttcctgaggcctgtgtgtcaaggcttagcgcctgcctcttgctcatcctggtgcattggctaccaagagtgctcagtgctttgttggccgtatcctatggatagcctgatatctgggcacgtaaagactcatttggacccaaaaagcatgaacctacaaccatatttttctgtctcttctgtcactgatctctccatgtgcaattaagaaatacaccttcagtctacattkgagccagtgtcttacatttaaactttaaattaaaatgtttttaatgtttttgtttttaatttaggacagaaaaaagatcattgtagaaagcaggcaatgtatgtgatacagaagaagtatatttttaaatggaaaaagacaaagtataaatactggattaataataaccttttcaataccttggcatttccagaatccttgggaaaatattattgtaccttctcatttattattggcttttaaacttcccagtggttttctttctaacctggaggcctcctcaattcctgatttttccat

SEQ ID NO: 149647 - DNA, 601 bp, Human
tagcgcctgcctcttgctcatcctggtgcattggctaccaagagtgctcagtgctttgttggccgtatcctatggatagcctgatatctgggcacgtaaagactcatttggacccaaaaagcatgaacctacaaccatatttttctgtctcttctgtcactgatctctccatgtgcaattaagaaatacaccttcagtctacatttgagccagtgtcttacatttaaactttaaattaaaatgtttttaatgtttttgtttttaatttaggacagaaaaaagatcattgtagaaagcaggsaatgtatgtgatacagaagaagtatatttttaaatggaaaaagacaaagtataaatactggattaataataaccttttcaataccttggcatttccagaatccttgggaaaatattattgtaccttctcatttattattggcttttaaacttcccagtggttttctttctaacctggaggcctcctcaattcctgatttttccatttgtttctttgacaaatatttactaaatacctactgtgggctaggcactatagatacagctgtgaacaaggtagatgtaaaaaatcaattataac

SEQ ID NO: 149648 - DNA, 601 bp, Human
gaaatcaataacaccagatagcttacctgcctcttggggactcctctcatcctatagtacaatagagagcaaagataccatcttagtgatggttatggatccaaggatgacccaaaatatgcttgacctgacagcatagaagaggaaaaagagtagcaacgtagtatttgagtcctgatcctgatacttcctgctctaagacctttggcaagccatttaacttacctgagccttggtttttttcatccataaaatggatttatttaataagccatgctctctcttgctcacagggttactktaaggatccacttacattacatgaaagtgctttgtaaacagagggctttataaatgtagggtggtagtgtcattttgcagagtatattggtcctctaagaactggtgttttaacatgaccacaatgtctagaaatccatttaatttctgtattagactactagagattacattgaaagaaatatgagatgaatctaaaagcaggagaaatggtgtaactgaggtaactgaaatccccccttgacttaggttgtcacagtgagtgtaaagaaaacaaatgattaagaggaacttctggcca

SEQ ID NO: 149649 - DNA, 601 bp, Human
aaatcaataacaccagatagcttacctgcctcttggggactcctctcatcctatagtacaatagagagcaaagataccatcttagtgatggttatggatccaaggatgacccaaaatatgcttgacctgacagcatagaagaggaaaaagagtagcaacgtagtatttgagtcctgatcctgatacttcctgctctaagacctttggcaagccatttaacttacctgagccttggtttttttcatccataaaatggatttatttaataagccatgctctctcttgctcacagggttactgyaaggatccacttacattacatgaaagtgctttgtaaacagagggctttataaatgtagggtggtagtgtcattttgcagagtatattggtcctctaagaactggtgttttaacatgaccacaatgtctagaaatccatttaatttctgtattagactactagagattacattgaaagaaatatgagatgaatctaaaagcaggagaaatggtgtaactgaggtaactgaaatccccccttgacttaggttgtcacagtgagtgtaaagaaaacaaatgattaagaggaacttctggccag

SEQ ID NO: 149650 - DNA, 601 bp, Human
ggtaactgaaatccccccttgacttaggttgtcacagtgagtgtaaagaaaacaaatgattaagaggaacttctggccaggcgcggtggctcacgcttgtaatcccagcactttgggaggctggggcaggcagatcccgaggtcaggagttcgagaccagccaggccaacacagtgaaaccccgtctctactaaaaatacaaaaattagccagacgtggtggcaggtgcctgtaatcccagctactcgggaggctgaggcaggagaatcgcttgaacccagaaggcagaggttgcagtgayccgagatcatgccatggcactctagcctgggcaacagagctagactctgtatcaaaaaaaaaaaaaaaaaaaaagaggaacttctagccgtttgtcatttgggataatagctgagttaaatttgattgaattgcacattgatatgaatctagaacagtacttctcacactttggcatgcataagaatcacctggcatacctcttaaaaatgcagattcatagatcccatatccagaacttttaattcctagtttgggtaaggatgcaggaatctgcatttttaaagaccatgccaggtga

SEQ ID NO: 149651 - DNA, 601 bp, Human
ggccggacacagtggctcatgcctgtaatcccagcgctttgggaggccgaggcaggtggatcacttgaggccaggagttcaagaccaacctggcaaacctggtgaaaccacatctctactaaaaatacaaaaattagctgggcatggtggcacatgcctgtaatcccagctactcgggaggctgaggtgggagaattgctttaacctgggaggtggaggttgcagtgagctgagatgatggcactgcactccagcctgggtgacagagcaagactccacctacaaaaaaaaaaaaaaaaaatgggtccgggcgtggtggctcacgcctgtaatcccagcactttgggaggccgaggcgggtggatcatgaggtcaggagctcaagaccagcctggccaacatagtgaaaccccgtctctactaaaaatacaaaaaaattagctgggcatggtggtgggcacctgtaatcccagctactcgggaggctgaggcaggagaatcgcttgaacctgggaggcagaggttgcagtgagccaagatcgtgccatcacactccagcctaggtgatagtgtgacacttcatctcaaaaaaaaaataaat

SEQ ID NO: 149652 - DNA, 601 bp, Human
ctggtgaaaccacatctctactaaaaatacaaaaattagctgggcatggtggcacatgcctgtaatcccagctactcgggaggctgaggtgggagaattgctttaacctgggaggtggaggttgcagtgagctgagatgatggcactgcactccagcctgggtgacagagcaagactccacctacaaaaaaaaaaaaaaaaaatgggtccgggcgtggtggctcacgcctgtaatcccagcactttgggaggccgaggcgggtggatcatgaggtcaggagctcaagaccagcctggccaacatagtgaaaccccgtctctactaaaaatacaaaaaaattagctgggcatggtggtgggcacctgtaatcccagctactcgggaggctgaggcaggagaatcgcttgaacctgggaggcagaggttgcagtgagccaagatcgtgccatcacactccagcctaggtgatagtgtgacacttcatctcaaaaaaaaaataaataaaataaaaagatgggatttccttcaacttggacctgatttcagagacataatttgtctgttaatgctgtttgaggatctgtagataaataaactgca

SEQ ID NO: 149653 - DNA, 601 bp, Human
gaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcaggtaaactcttcttttttctatacctttttcaaaaatgtattttttattaaggtaaaatgtgtatatrtatattataccatctttaccattttaagtgtaccgttcagtgttaagcacaattatattcttctttttcctctttcatcccctctatcccctcttcttcctggcctctagtaaccaccagtctactctctaccttcaagagatccacttttttagctcccacgtatgagtgagaacatgctacatttgtctttctgtgcttggcttatttcagtgaacataataacctctggttccatctatgttgctgcaaatgataggatttcattctttttatggctgaatagtattccataatgta

SEQ ID NO: 149654 - DNA, 601 bp, Human
tttagttatataccccataatgaaattgctggtgtattattcagggttctctaaaggtatagaactaataggatatatttatatatctattagtatataaatatataaaggggagtttattaagtattaacttacacaatcacaaggtcccacagtaggctgtttgcaaacttcaggagcaaggagagtgagtctgagtcccaaaactgaagaacttggagttggatgttcgagggcaggaagcatccagcatgggggaaagatgtaggctgggaggctaggccagtctcgcctttttacrtttttctgcccgctttattttcactgacagccgattaaatggtgcccaccacattaagggtgggtctgcctttcccatcccactgacttgactgttaatctcctttggcaacacacctcacaaacacacccaggatcaatattttgcatccttcagtccaaccaagttgacatgcagtattaactatcacattggattatatggtaattctatttttagttttttgaggagcctccatactcttctccaaactcattgtactaacgtgcattcccacaacaggtaaactctttgcattgg

SEQ ID NO: 149655 - DNA, 601 bp, Human
gaattaattttttgataatgtagggaattaaacatcttattgaagggaatgagaggttgtgtttggaggtttaaagaaaatattgacagtttagaatagtttttaagaagaatgggagagggaattcccctaatcagattcattctatttactaattaagtcccaactccttaccctggaattcatagcattccccatccccttagtacggttacaacctatgtgttcattctccagtctctgtgccccatcaagcaccctatacctgaaccagaatgagctactagatatttctcatatrtgatgtttgttttctaccctctgtggtttgctcaagaaacaccctctctaaaatgtcctgttggccagcacagtggctcacacctgtaatcccagcactttgggaggccaaggtgaaagaatcatttgaggccaggagttcaagaccaccctgggcaacatagagagacccctgtctctaccaaaaaattggccaggcgtggtggcccatgcctgtagtcccagctactccggagtctgaggcgggaagatggcttgagcatgggaggttgaagctgcagtgagctgtgatcttaccact

SEQ ID NO: 149656 - DNA, 601 bp, Human
attagccaggcatggtggcacatgcctgtagtcctagctacttggaaggctgaggcaggaggatgccttgagcccaggggtttgaggcatatttctgttttacatatttctgttatgagtgaaacagaattataactggggatgttgagatgttttaatttcaggagattgttgcccttgcaatacatactaatacatttattaacagtgaaaaatgggatcatgctttttcaaatgaaaataaatctaatttagccaattgctctgacattgaggactgactgctcattagatcatgtgrttgaacattttcagaaatgagctaaatctgtgactttaaggtagattttgatgaaaatatatttaaatcatgtgataagataaaatcatattaaaaataaatgttggcaatgatggaaagacattaataatattttgatcatttcaaccatctattgggttaaacgagcttcctttaagtacaagagtaactcatgtgagaataacccacataattattagtaaataatacagctttttgatgtcctcagaaatcaagaaagggaatgtgtgtaggtaacaaatcttttggcaaattgag

SEQ ID NO: 149657 - DNA, 601 bp, Human
caaatgaaaataaatctaatttagccaattgctctgacattgaggactgactgctcattagatcatgtgattgaacattttcagaaatgagctaaatctgtgactttaaggtagattttgatgaaaatatatttaaatcatgtgataagataaaatcatattaaaaataaatgttggcaatgatggaaagacattaataatattttgatcatttcaaccatctattgggttaaacgagcttcctttaagtacaagagtaactcatgtgagaataacccacataattattagtaaataatamagctttttgatgtcctcagaaatcaagaaagggaatgtgtgtaggtaacaaatcttttggcaaattgagttttcagttctttgctttcaataaaattggaaaaagacttaattgccagccgatagattattacaataaattttgctgatagtttgctatatatttttggtatataacttggaaggagtccaaagaattgagtgacattactataacaaagttcttccattccaagataatatttatgtgaataaggttttagcacataaaattgattattagaaaggtggggaggattga

SEQ ID NO: 149658 - DNA, 601 bp, Human
aataaattttgctgatagtttgctatatatttttggtatataacttggaaggagtccaaagaattgagtgacattactataacaaagttcttccattccaagataatatttatgtgaataaggttttagcacataaaattgattattagaaaggtggggaggattgatgttgagccatgtctcattctaataataagtaatactaccaacaaatatttaaacaccaattgaaaagaaaatctcatccatcttattaagaaatgcattttaatacaattttctttcttaagtctattacctrtaaaatgtgtaatatatttctatagcttgatcaattgtattcataagaatattaataaaaactcaatccaggagaattatttaaatgtcttaaagactcatgctcatagaaaatttttaatagtaagtacagtttatttataattttttgtataatttgttggaatcatagccaacaaaaagataagggcagaaatgttaaagaggagccccatggcccttccagtgttaacatcaaaagtgttaacaggctgggcgtggtgcctccctcctgtaatcccagcactttgggaggccaagg

SEQ ID NO: 149659 - DNA, 601 bp, Human
gaaatgcattttaatacaattttctttcttaagtctattacctgtaaaatgtgtaatatatttctatagcttgatcaattgtattcataagaatattaataaaaactcaatccaggagaattatttaaatgtcttaaagactcatgctcatagaaaatttttaatagtaagtacagtttatttataattttttgtataatttgttggaatcatagccaacaaaaagataagggcagaaatgttaaagaggagccccatggcccttccagtgttaacatcaaaagtgttaacaggctgggcrtggtgcctccctcctgtaatcccagcactttgggaggccaaggcaggaggatcacttgaacccaggagttcgagatcagcctgggcaacatagagaagtaaattcaggggtgagcagtaaaatacattaaaacataaaagtgtacattcaaataaaattccctagggaatatggaaaggaagcatgaaattgaaggagaagaataaataagaaaaaatttatgctaaagaattcttggccgggcgcggtggctcacgcctgtaatcccagcactttgggaggccgaggcgggcggatcac

SEQ ID NO: 149660 - DNA, 601 bp, Human
cctagccttgaaatcccagctttcaaaacctcacttagggaagagggcctgctcacccgtgttggtgtaccctaagtttaacagattagattttcctggtagtacagatatattgttctctagacaccatcttagccccctctcagcacttttagtgatgtccttcatagacaattttagtttgtgtcatgttagttaacactggtgaatatatgtttgccctctctctcttcatgaatcagcctattttgatgaatactatgagacatctacaaatggacaatgactagaccatgtaaaraaatagaacgttgacccatgacctgcccaagaaaccatcccccttatctacaataaacagtccaagaagccagcctgttataagtcaaacttgcaggaagccaggttgctgtctctgatgacaatccaggaagctaagtaataatttctgtaacaatagtcccctaatgagagccaggcatggtggcccttacctgtaatcccaacgctttgggaggctgaggcaggaaaattgcttgaacccaggagtttgagactagcctgggcaacatagtgagacctcatctcttcaaaaaaatta

SEQ ID NO: 149661 - DNA, 601 bp, Human
ctagctcttattcttactttctaacaattttttttgtacccattaactacctccatctccccgctacccttccccactacccttcccagcctttggtaaccatccttctactttctatcctcaggagttcaattgcattgatttttagatcccacagataagtgagaacatgtgatgtttgtcttcctgtgcctggcttatttcacttaatataatgactttcagttctatccatgttgttgtaaatgacaggatctcagtctttttttatgtctgaatagtactctgttgtgtctaagtrccacattttctttctccattcatctattgatggacacttaggttgcttccaaatcttggctgttatgaacagtgctgcaacaaacttgggagtgcacatagtgcagatagtgcagttatctctttgatatactgatttcttttttctttttcttcttctttttttttttgagacaatctcactctgtcgcccaggctggagtgcaatggcacaatctcggctcactgcactgttaacctctgccacctgggtcctatgttcaagcgattctcctgccttggcctcccaaggagctggaat

SEQ ID NO: 149662 - DNA, 601 bp, Human
ttgtagagatgttttatttcttttattaattactaggtatttaattttatttgtggctcttataaatgggattactttttttatttctttttcagattgtccacctttggcatatagaaatgcttctggtttttgtatgttgattttatgtcctgcaactttactgaatttatcagttctaagagttttctggtggagtctttggatttttctcagtataaaatcatatcacctgtaaacaaggataatttgacttcttcctttccgatttgtatgccctttatttctttttcttgtccarttgctctaagtaggacttccagtactatgttgagtaacagtggtgaaagtgagtatccttgttgtgttccagatcttagagaaaagctttcagtttttccctatccagtataatattagctgagagtctgtcatatatggcttttattatattgaagtatggtccttcaatacctagttttttgagggtttttaaccacgaagggtgttgaattttataaaatgctttttcaacgtcaattgaaatgatcatatggtttttgttgtttattctgttgatatgatgtatcacactgattga

SEQ ID NO: 149663 - DNA, 601 bp, Human
ttccaccctgggcgggccaggtgttccttgccgtcattcctgtaaacccacaaccttccagcttgggtgtgagggccatcatgaacatgttacagtgctgcagagattttgtttatggccagttttggggccagtttatggccagattttggggggcttgctcccaacgtgtctcccttctttgatttgcaaagagataaaagcaagggcggctttgtcacagtgagctacttcttgcaggagtcagaatctgcatctgcagactatacaaagaaaaacaacgtagattaaaagcacagtsatcattgaaatcacagagcttccaagtgtttttatccattttaatggattactagctgctaatttgtctgcagcgcctttaagcactccagttcctggcattaaggtcaggtgtgcctgggatgctttaaatatttgttctttaattttgcaatatccaaaggcaagtttgtagagtgtctttgtagatggtttttattttttcctaaattttgatcttattaagagctattaatagtttccacaaatccttatgtttagctcccacaacgagccctatcatttgaggttgaggtgccac

SEQ ID NO: 149664 - DNA, 601 bp, Human
tcattcctgtaaacccacaaccttccagcttgggtgtgagggccatcatgaacatgttacagtgctgcagagattttgtttatggccagttttggggccagtttatggccagattttggggggcttgctcccaacgtgtctcccttctttgatttgcaaagagataaaagcaagggcggctttgtcacagtgagctacttcttgcaggagtcagaatctgcatctgcagactatacaaagaaaaacaacgtagattaaaagcacagtcatcattgaaatcacagagcttccaagtgttttyatccattttaatggattactagctgctaatttgtctgcagcgcctttaagcactccagttcctggcattaaggtcaggtgtgcctgggatgctttaaatatttgttctttaattttgcaatatccaaaggcaagtttgtagagtgtctttgtagatggtttttattttttcctaaattttgatcttattaagagctattaatagtttccacaaatccttatgtttagctcccacaacgagccctatcatttgaggttgaggtgccactataccaccatggttccagataataggaacttt

SEQ ID NO: 149665 - DNA, 601 bp, Human
ccatcatgaacatgttacagtgctgcagagattttgtttatggccagttttggggccagtttatggccagattttggggggcttgctcccaacgtgtctcccttctttgatttgcaaagagataaaagcaagggcggctttgtcacagtgagctacttcttgcaggagtcagaatctgcatctgcagactatacaaagaaaaacaacgtagattaaaagcacagtcatcattgaaatcacagagcttccaagtgtttttatccattttaatggattactagctgctaatttgtctgcagcrcctttaagcactccagttcctggcattaaggtcaggtgtgcctgggatgctttaaatatttgttctttaattttgcaatatccaaaggcaagtttgtagagtgtctttgtagatggtttttattttttcctaaattttgatcttattaagagctattaatagtttccacaaatccttatgtttagctcccacaacgagccctatcatttgaggttgaggtgccactataccaccatggttccagataataggaacttttgccgtactttttggtatttctaccatgtgatcagtttgttc

SEQ ID NO: 149666 - DNA, 601 bp, Human
cattgttaccctgaggcatccgaactccccttcttactcaccatggggactgctttaagagtactcgggtgtcctccagctagttttctgttccaagcatcgcttcagcaaccctttgacctggatttgagcccccacgaatggacgccacttgcgcgagaccagctcggtcagggagaccctaacccagtggcgctagaggaattaaagacacacacacacagaaatatagaagtgtgaagtgggaaatcaggggtctcacagccttcggagctgggagccccaaacagagatttacccrcgtatttattaacagcaaaccagtcattagcattgtttctatagatattaaattaactaaaagtatcccttttgggaaactaagggaagggccgaattaaaggagtaggttgggctggttaactgcagcaggagcatgttcttaaggcacagatcgctcatgctattgtttgtggcttaagaatgcctttaagtggttttccaccctgggcgggccaggtgttccttgccctcattcccgtaaacccacaaccttccagcttgggcgttagggccattatgaacatgttacagtgctgca

SEQ ID NO: 149667 - DNA, 601 bp, Human
tatgacttaatttcttgctttttattttttgtgtatccgttgtgtgtttttcaattcgaggctaccatgaggcttgcaaatattattaatgtctcataatccattattttattttatttttatttatttattttttgagacagagtttcactcttgttgcccaggctggaacacaatggtgtgatctcggctcactgcaacctccacctcctaagtgattctccagcctcagccccccaagtagctgggattacaagcatgtgccaccacgcccggctaattttgtatttttagtagagaygggctttctccatgttggtcagactggtctcaaacttctgacctcaggtgatccgcccacctcgacctcctagagtgctgggattacaggcgtgagccactgcacctggcataacccattattttaaactgatgacaacttaacactgattgcataaacaaacatgcaaaaagaaaactaataaaaactgtacactttaacttcatccctctgctttttaactttttgttgtttctctttatgtcttattgtactatgtcttgaaaagttgttgtagttattatttatattggcttatca

SEQ ID NO: 149668 - DNA, 601 bp, Human
gcccacctcgacctcctagagtgctgggattacaggcgtgagccactgcacctggcataacccattattttaaactgatgacaacttaacactgattgcataaacaaacatgcaaaaagaaaactaataaaaactgtacactttaacttcatccctctgctttttaactttttgttgtttctctttatgtcttattgtactatgtcttgaaaagttgttgtagttattatttatattggcttatcataacactgtaattatggtatgtgggagtttacatgccacaattacagtgttacartattctgtgtttttctgtatgcctactattaccagtgagttttgtatcttcagatgatttcttcttgccgttaacatcctctcttctttcagatggaagaactccttttagcagttcctgtaggacaggtctggtgttgatgaaatctctcagcttttgcttgtctgggaaggtctttatttctccttcatgcttgaaggatatttttgccggatatagtgttctagggtaaaagtttctttccctcagcactttaaatatatcattaccactttctcctagcctgtaaggtttttcact

SEQ ID NO: 149669 - DNA, 601 bp, Human
tggcagttgtatttcatgcttaatttgaggagagctttgttatgtagggcttcatacctagattgttgtaactgccagttgagtgtctgtctttgatatctgataattcttttgaatctttgctttggaaatgacctttgagatcgtctagtccagtgatttttcagtctgtgtgtatcagagtcctgggattctaggggagtgcctcaggagaggaagaaatctatccaagtgggctcctgcttcatctagggaaattcctggtgtatttcatgtattgggggtcatgtgagatcttgtytgacaataacactttctgtttctaaaagagacggagaagataagacaaaggagagaaagaaaaaggaaagaagatgatgacccagggagggaaggaggaagaagctgtagaaagaaagagaaaagcaaaggatgagagcaggaaagggcaaaggggcaagaaagaaggagacaggaggagacagaacaaggaaggaaaggtgaaaaggggagaggagtgtgacttgtatttctaactcaaccatgagctgtaaacttgttaagggtggagacagtaacttgtacttctttgagaacatag

SEQ ID NO: 149670 - DNA, 601 bp, Human
gagctcaagaattcaagactatcctggacaacatagcaagaccctatctgtaaaataaatatcacaataatacacctatcacacatgaacataaataacatattggtgtggggaaactatattttttaagaaaaactggaagaatggcattgttcgacattttgcaaatctctttaatgtctggtttgtttgtttgtttgtttgttttgttttttgaggcagagtctcactctgtcgcccaggctggagtgcagtggcacaatctcggctcactgcaacctccgtctcccaggttcaagcrattcttctgcctcagcctccagaatagctgggattataggtgcccgccaccatgcctggctaatttttgtatttttagtagagatggagtttcaccatgttggccaggctggtcttgaactcctgacctcaagtgatccacccacctgggcattccaaagtgctgggattataggcgtgagccaccgtggctggcctcatgtctggtttaatagaaggtagttagattctctttttctgtttctacattcagtctgttgtgatatgttattttagctaaagtataggaagaaaagcttgc

SEQ ID NO: 149671 - DNA, 601 bp, Human
ttccatggtcaatcagccagtgcttcttcatgagcacttcctgtgtgtttaccaggaaccagtgggataacaaatcaagtctctacttagtgtgtgttaggcaggctagcatttctatgtggagaaacctccgatgggtttacactaagggtgaaatgtatgtcaggatttgatgagctgtctgtactttccctgaactcactcagagggatgttccatctatagatgcttaacttgtattatgaactttgattttacttaactggatctctttgtggaatttttttttcaattttagaayattgcatcttcaatctagaaacatgaggaactacagaaaagcatatgaacaccgaaaacctataggccacttatccattttgatgtattttagtcatcattctgtttttttattgctgtttattaattcagtatatttccaaacagcatctataatctaagtattttttactatttttaattttgttctcagactatatcttcagttttccttaaactgtttcatgtggaaacttggtaaacaggtagttacaagtactaatatattatgacagttttaaatctattgtaaaaataagtc

SEQ ID NO: 149672 - DNA, 601 bp, Human
atcatcttcatgattctgctgagcagtggcgccctggtgaggtccaggggagagtgtgaggagggattggctggggaagggtgtagagaagccagtgggaaaaggctgaggccaaagcccagtggctctgaaaacagattggctgtggtcccaagaagaatgatctgttaaagtgctttaggctgctgctttgagcctgtgggattagaatccatacttgttcacattgtgatcctcttagcactgtccctctcatgtgtccccactgcctggtttaccccatccttagcagcccctaaartgaacttccctctcttacctaataccccagatctcttgttctttgcttttcagttacccaggatgggagggaggtgttattcctccacttactgtcccttcacagcctactggatttagagaacccatggcattagcaaatgtttagagtcagatctctggtacaaaggttatttatattcacattgtcctaagtgcttattaatcagtgaaacatacaaggccctgaacacacaggctcctccactgctgagactaattatcttggcatttgcttttatttttagctgggttataactg

SEQ ID NO: 149673 - DNA, 601 bp, Human
tcagagattaggagaagtggaatcactggtctcaaaggcccttgttattaggctggggacaggaaagttcttgccccaggccagcaggatgtcttctttttgtggctgggagaaggggtgagagaatgagatgggggctgttgggacgaaggtggtagtgggatctgtggtctctcctgctgaccattcccatgaacacttccatccaactcaagtcttgataccggactcatccaaacaagtcagtttattaggtgaggggagttcatactgaaataaaatacccccttcttcccacacrttgccattctacagtgatcatgaaacttgagaaatccttttttcctccaggttccaagactatctccgaggtttgctggccatgacctcctgtgttttttccaggttggaagtgacatcctctctttctcaccccaccatcacttgtcccttgtcagctttactaaggatgatgactggtctcttattctatgtaataactaaagcttctttctttcagccaagtcagcattttaaagaaaggatgaatgggatttgtaggaccagggcctgtggaaaatttacttccttctgagggctg

SEQ ID NO: 149674 - DNA, 601 bp, Human
cctgaatttattttttttttcatttttaaaatttttttaggtaggtctcaccctgctgcccaggctggagtgcagtggcacaatcatggctcactgcagcctccaagtcctgggctcaagcagccttctcacctcagcctcctgagtagctgggactacagacacgtgccaaggcgcccagcttgatgccctgaatttgatgtctcctcaattccttttttttgttgtttgtttgtttgttttaggtttgattctttccttaaagaatactttaagcaatgttaggattatctccaggagkggcttaacagagactcagaggattataagagagccctcaactactaaagaataacccagataagacccttattgatcctgtcctgggccagattaatcagctgagtaacagcttatctcccagcaacgtttagagccagccactgaattggcctttagacctcctccttcattctccacactgtgggcctatttgttatcagataagtcacccaccctgaagagctgggatcttcttaccttatatggtgcctatagccactcaaagcttagtttcttgcaatctttacctgacaaagtt

SEQ ID NO: 149675 - DNA, 601 bp, Human
ggactgttgagtccaggtacttggttgagaaagaatagcttcccttcagatatacttattaaggcctcatgaagaatctggcaactttcaattcttttggagttaagagttggctgcacttggcaataatagggaagtagatacctccatataaattcttattgataatgatggatagatggagagaaagggattagttggtgctactatgttctagatagggcttttgtggaccatagtttaggcagacattgaactctggaccatctgccttttcatgaaaattagggtagcctaatarggcaacatttacttccggatttgctttggacattgcccagggcttcagagaagataactacactggtggattatgagcacatgcatagatcaaggtccatatccctttttattttatttatttatttatttatttgagatggagtttctctctttttgtccacgttggagtgcaatggcaccatctccgctcactgcaacctctgcctcctgggttcaagcaattctcctgcctcagccttccaagcagctgggattacaggcatgcaccaccacgcccagctaatttatttttgtattt

SEQ ID NO: 149676 - DNA, 601 bp, Human
cagtaggaagaatttaagagctgttgatggaaatatcttaacctatcctagaatttgtgttgtaagaaacccagaacccagccaggcatggtggctcaagcctgtaatcccagcactttgggaggccaaggcaggcgaatcacctgaggtcaggagtttgagaccagcctggacaacacagtgaaaccccatctctactaaaaatacaaaattagccgggcatggtggcacatgcctgtaatccaagctactcacccaggaggctaaggcagggagaattgcttgaacccaggaggtggargttgcagtgagccaagattgtgccattgcactccagcctgagcgacagagtgagactttgtctcaaaaaaaaaaaaaaaaaaatagaaacccagaccccaaacattctggagtttgactaactaaaggtatttttaggtctgctctcccctgaaaaattctgtaactctcagctcaggcccaggaaggcataaatgtagttagcatggtgttgagaaagcatcgtggtaactgctctgagagctctggtagaacaaggtaagtttgcctctggcagagcaggaaagtgtttgaccatacg

SEQ ID NO: 149677 - DNA, 601 bp, Human
agggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcgtttgagtcaagttgaaataggcagctggtgttacccacttcctctacctggggggcccaatctgtgtctgcagtgctaggggctttattctaacactctggaacctctgttttctttctttwttttttttttttttttttttttttttttttttttttttggttaccttttttgtttttgtttttctcttctgtttctgtgtaggtctctttagtcagccttatagctaatgccctgggctactcggaactaggtgccataaagtcccttaggaccctaagagctttgagacccttaagagccttatcacgatttgaagggatgagggtaagatactaagagcagctgatccttctgcatgccagtggaaactgtttaagcatgctagaactgatcacatggtggaaagatcattcaaacac

SEQ ID NO: 149678 - DNA, 601 bp, Human
ctgcaggaagggcagttccacagtagtgtaaatttattttaatttttcaaaaaacttgggattttaagactttgtcccacagataagagaggttttagaatgtgcgcaataaggtcattgctatgctcaggctaaatttaggaagagagtttattacacaagattcagtggtttagacagccacggtgagattgaaaatgtggttaaaatgttcttctctgctccctgcacctttgcatgttttccagagggagctaataaaatgttttaataaactatactggttttgttataaagttgrtaatccactttggtgactgaaaaactgaggacaagatgcaaccaaaaaagtccactgaagacagtacttgtcctgagctcctccgcatccccttacggtgatccctgatcttccaaaaagagattggtaatacctgaagaaatccccccatccccctacaaaagaaatgcccatctgacccatctgacgcttgttactaactatttccatctagatgctcattactgtcactcctgtccaggcagacagaagcagtcctcatggccgctgaggccagtttgctcatgaggcagttatttg

SEQ ID NO: 149679 - DNA, 601 bp, Human
ggcaaaaccagaagataaggaaaccctaaactctaaattgtgtgctgctctgactgatactgtaaagcaaaatcaaagttgaaaacaacccagaaactttgattcctaaggggtttttttcttttgctttttttttattcctgagcttactgtagtcagtgactttttaacaatatgccaatttttttagtttcaagagcagtaatgatctaacccaaaactctcttaaaaaccttaagtcatccctatttctaatacactgtgatgagtggagtcaagccctggaatgagcagagagacracagcattagccaagcagggagcgactctgatttaaaagcctacaaagtcagaataaaaaggctggagaagtataatgaaccttgagtgaaagcacatctgttcagattttattttatactgtttggtagagggaatatagctttttttttcttgagcctgcaaaatatgcatgctcagctattgcctgaaataaaataactggccttgcgtagtcataaaagagacattatgtactgttaactggctctctattaaccacaacgggtagttctctgtgattttgaacaattataccttg

SEQ ID NO: 149680 - DNA, 601 bp, Human
aaataactggccttgcgtagtcataaaagagacattatgtactgttaactggctctctattaaccacaacgggtagttctctgtgattttgaacaattataccttgtttttcagagggggaatgtctgttgaaaggcaactagcaagctgaaagttactcatattttcccattgggcatattttatgaattgaggaagagggagactggactaagaaataatttttcagtcccaggctgatgcataggaaagaagacctaggtcagcttggctggggaatttgtgttagtcaaaataaagrtgtaactttttaaaattccttcaatatagtcctagacttagaaatttttggtcctacttgtcagtctgtccagttactctaattccaaagggaatgtaatgtttccatacagaacaagccacacaatgtcattcccctcctggaaatcaaaaaatgtgcttgctctcatttccacccaacactgagcaacctccccttccaatgcaggtggtggtgaatgccttggtgggcgccatcccctccatcatgaatgtgctgctggtgtgtctcatcttctggctgattttcagcatcatggga

SEQ ID NO: 149681 - DNA, 601 bp, Human
aatcaacaaaagaaaaagataggtctcctcccctcattgccagtggttggaagtcagcccagataagaggcacctttgtccctatctctagaaagaaaatgtccctctttctttctctaaaatctatattgttagctcactgtgaccctggcccccatacgttagccccaacccactctttctgttcggggctggattttgcagcatgtagtttaccacacttactagcagtcttttattcttgaggcctattactggtcttggtctcccaccagaagcaggtaggtcagagagtgcagtygagcaacagagatgaaaaggaaagaaacagatgaatagctatcgcaagaagtagaaactgtctagacttgtgattatctagtcaatctctgagcacaagcaaattgggatttgagagacccacctttggaaagtttacttccttacttgttctagatggttaacaagttttacaaagcaaattgaaaaaattgctcgttgctcattttgtaagtcaagtctatcccagcatactccaagacaccctccaaattgctttcttgcaccagaatttccaaattttgggtatcatctaaaataa

SEQ ID NO: 149682 - DNA, 601 bp, Human
aaggatgtctttgcaggatgtatctagaagttaaaatcatgcttctggttatttgtgggagcagaagagggtaaaactatgggagtctggtgccctgattccctctcttgagctgagccttttataaaacagattagggggctgagattctgctccattgttccattggtgatggttgtcttgtttcagagaaggagaaggagataccctgctcctgattccatatatccggttggatgggacatcacccccaaaagccaggcccaaagttccttcttctgtaacttccatttagcaactktaaaaaacagacacaacaccaccaaaaaaacccagcagaacctttaatacaaaagcttccctgataatctaatttgtagaaataaaagtagagtgactatgtttgaatcaagagttatagttccagaacgttttctcccctcacccccacacgccgcacgtggtacatctaccgcatcaacttttgaaggaaaagaaattctagggctttgcagggcagattgaaaaccaccaagttaaagtaatcctggaaataagcaccagcccaagtatctcagtacttcaaacaaacaaacaaaca

SEQ ID NO: 149683 - DNA, 601 bp, Human
ccatgggcatttgagctacttcctcttgtaacttacttgtgcctttaggacctgctcgagcccaatcaggtgcataccatttccatttgacgatggaatgctgctgtgcgcacccaacttcatggctagatgggtcagagagcacctagttcatgagaggcggttcaggccacatggtaactgggtgacccatggtcaaacgttcagtttccaccaaagcccagtaacaggccaagagccgtccctcaaaaggcgagtagttatctgcagaagatggcagggccttgctccaaaatcctayggacctcctctgtgattcacctatgggggcctaccaaaggctctaaacagcatccctatctgccactgatacctcaagcaccactggatctgctgggtcatatagcccaagtggcagagcagcttgcacaacagcctggacctattgcagagccttctcctgttctaaaccccactcaaaactggcagcctttcaggtgactcaataaatgggccggagtaacatactcaaatgaggaatgtgttgcccccaaaatccaaataggcccactaggcgttgtgactctttcttggttgtagg

SEQ ID NO: 149684 - DNA, 601 bp, Human
gggggcctaccaaaggctctaaacagcatccctatctgccactgatacctcaagcaccactggatctgctgggtcatatagcccaagtggcagagcagcttgcacaacagcctggacctattgcagagccttctcctgttctaaaccccactcaaaactggcagcctttcaggtgactcaataaatgggccggagtaacatactcaaatgaggaatgtgttgcccccaaaatccaaataggcccactaggcgttgtgactctttcttggttgtaggagaggccaaatgcaacaacttatcyttcaccttagaaggaatatcttgacaggcccctcagcactgggcccctagaaatttcactgaggtagaaggtccctgaattttagtctgatttatttcccatcccctggcacccaaatgtctcaccagtaagtccagtgtgtttgctacttctcgctcactgggtccagtcggcataatgtcatcaatgtaatggaccatcatgatatcttgtggaagggaaaagcgatcaagatctctgcgagcaagattatgacacaaagccagggagtttatatacccctgaggtaggacagtaaag

SEQ ID NO: 149685 - DNA, 601 bp, Human; identical to SEQ ID NO: 31274

SEQ ID NO: 149686 - DNA, 601 bp, Human; identical to SEQ ID NO: 31275

SEQ ID NO: 149687 - DNA, 601 bp, Human; identical to SEQ ID NO: 20432

SEQ ID NO: 149688 - DNA, 601 bp, Human; identical to SEQ ID NO: 20431

SEQ ID NO: 149689 - DNA, 601 bp, Human; identical to SEQ ID NO: 20430

SEQ ID NO: 149690 - DNA, 601 bp, Human; identical to SEQ ID NO: 20429

SEQ ID NO: 149691 - DNA, 601 bp, Human; identical to SEQ ID NO: 20428

SEQ ID NO: 149692 - DNA, 601 bp, Human; identical to SEQ ID NO: 20427

SEQ ID NO: 149693 - DNA, 601 bp, Human; identical to SEQ ID NO: 20426

SEQ ID NO: 149694 - DNA, 601 bp, Human; identical to SEQ ID NO: 20425

SEQ ID NO: 149695 - DNA, 601 bp, Human; identical to SEQ ID NO: 20424

SEQ ID NO: 149696 - DNA, 601 bp, Human; identical to SEQ ID NO: 20423

SEQ ID NO: 149697 - DNA, 601 bp, Human; identical to SEQ ID NO: 20422

SEQ ID NO: 149698 - DNA, 601 bp, Human; identical to SEQ ID NO: 20421

SEQ ID NO: 149699 - DNA, 601 bp, Human; identical to SEQ ID NO: 20420

SEQ ID NO: 149700 - DNA, 601 bp, Human; identical to SEQ ID NO: 20419

SEQ ID NO: 149701 - DNA, 601 bp, Human; identical to SEQ ID NO: 20418

SEQ ID NO: 149702 - DNA, 601 bp, Human; identical to SEQ ID NO: 20417

SEQ ID NO: 149703 - DNA, 601 bp, Human; identical to SEQ ID NO: 20416

SEQ ID NO: 149704 - DNA, 601 bp, Human; identical to SEQ ID NO: 20415

SEQ ID NO: 149705 - DNA, 601 bp, Human; identical to SEQ ID NO: 20414

SEQ ID NO: 149706 - DNA, 601 bp, Human; identical to SEQ ID NO: 20413

SEQ ID NO: 149707 - DNA, 601 bp, Human; identical to SEQ ID NO: 20412

SEQ ID NO: 149708 - DNA, 601 bp, Human; identical to SEQ ID NO: 20411

SEQ ID NO: 149709 - DNA, 601 bp, Human; identical to SEQ ID NO: 20410

SEQ ID NO: 149710 - DNA, 601 bp, Human; identical to SEQ ID NO: 20409

SEQ ID NO: 149711 - DNA, 601 bp, Human; identical to SEQ ID NO: 20408

SEQ ID NO: 149712 - DNA, 601 bp, Human; identical to SEQ ID NO: 20407

SEQ ID NO: 149713 - DNA, 601 bp, Human; identical to SEQ ID NO: 20406

SEQ ID NO: 149714 - DNA, 601 bp, Human; identical to SEQ ID NO: 20405

SEQ ID NO: 149715 - DNA, 601 bp, Human; identical to SEQ ID NO: 20404

SEQ ID NO: 149716 - DNA, 601 bp, Human
tataagattaaaagacaacactcccacagtctgaaaacagtatgagtcaccaagaaacaaaaacaaaaacaaaaaacagtgaaaagaagatggtaagaataaattccagtttgaaatcctttaattatgacagtgaaaaataagcaccttccctgggaatgtatttttacatttaaaatactattcgttttctcatgtgaaaaagattttctaaaaactatgttaggagttctcttcagttttattacagcatctaactatgaatgcttaaaatgccttcatagttccaaaaccaatttagttaaaataattatttagaaatgtaatgtaaagcaactgtaaaaatgcaaatcattttaacacagaaacaaatattttaaagtataccattacctttaattcatgataatctattgcttcatctttgtctgtatcaaatagttcaaaagcatctttaatttcttgtttctgttcctcagacagttctcttctttttttcctctttgttttgtccactacaagctcacttctatgaaatggaaagaaaaagcccttagtccactttaattctctttactaacagaaattagccaataattac

SEQ ID NO: 149717 - DNA, 601 bp, Human
ccattaaaaatctcaaaatactatctttcccactgtgctgaaagtaagtcccattctaccctaaacccaaatctctccttataccctgacaaataataatttacaaatctctccctacactttgacattctaggtcttaaagctgacatttttacctattagcatgtgtcaacatcaaacagcactaaagttgtttgcaccagagaaagtggattgagactatgttactaacaaatccaaattataagattaaaagacaacactcccacagtctgaaaacagtatgagtcaccaagaaacwaaaacaaaaacaaaaaacagtgaaaagaagatggtaagaataaattccagtttgaaatcctttaattatgacagtgaaaaataagcaccttccctgggaatgtatttttacatttaaaatactattcgttttctcatgtgaaaaagattttctaaaaactatgttaggagttctcttcagttttattacagcatctaactatgaatgcttaaaatgccttcatagttccaaaaccaatttagttaaaataattatttagaaatgtaatgtaaagcaactgtaaaaatgcaaatcatttta

SEQ ID NO: 149718 - DNA, 601 bp, Human
tgaaaaaagtagttggtggcaaaagtgtagagaacattcagtagaaagcaaaggaatctgaactttaagtagtatacaatgaggagttatggtttatgagcaatgaacaatttatgagcaatggtgaaagaatttttaaactatctaaattcagtggtagtgtacaaggtgaactagtaagaaatcatttaggaagctccaggtatgaaataaggtcccaaaccaagatagtcaatggttacaaatggaacagacattataaaggaagatcaaatctgggtaaccaaaaaaaaaaaaaaamaaaaaaaacagtgggaaaagagagccaaagaggactgcaagattgagaaagctagacttagcaggcctattaactgcttttatacattctatcctgtcactgcatagttcctatccctacttggaattctaatgcttaaaaatcccttacgaaattacaaaaattaaaactaccaaataaacacttacattcacctatccattaaggccattaaaaatctcaaaatactatctttcccactgtgctgaaagtaagtcccattctaccctaaacccaaatctctccttataccctgacaaa

SEQ ID NO: 149719 - DNA, 601 bp, Human
tggaacatgtttattaaatgtaacttcttggatgcaaaaatacatataatgtgataaacattacaaattagtattctataatattaactggggaaaagataatgttaccaaaaaagtcaatcacagtcatatttgtacatacttgctaaaacattttaaatgcttgacatttcaaggttctttaaacaaccctctttataatctttattctactagttcatttagcaaatccttcctttacaagtaagcttgaacatatcatgcatgtaaattagatttctaaagaatgaaaatataatamaattataaaaagaagttaaattattattttttgaacttttatatacttaaaagcctatgttaaagaataattaaaaccaggtcaccatacctcaaaggtatcaataaaaatggcaatttgaaaagattacagatgtaatcttaatcaccaaagtaatccagtaactatatagatgtaaaggcagaaaataatcatggataaggactaatttttagtttgccaaaattataaatatagtaagaatctccaatttataaaacataatgtttaagacagcaacctagaaataagaaatcagat

SEQ ID NO: 149720 - DNA, 601 bp, Human; identical to SEQ ID NO: 26667

SEQ ID NO: 149721 - DNA, 601 bp, Human; identical to SEQ ID NO: 26668

SEQ ID NO: 149722 - DNA, 601 bp, Human; identical to SEQ ID NO: 26669

SEQ ID NO: 149723 - DNA, 601 bp, Human; identical to SEQ ID NO: 26670

SEQ ID NO: 149724 - DNA, 601 bp, Human; identical to SEQ ID NO: 26671

SEQ ID NO: 149725 - DNA, 601 bp, Human; identical to SEQ ID NO: 26672

SEQ ID NO: 149726 - DNA, 601 bp, Human; identical to SEQ ID NO: 26673

SEQ ID NO: 149727 - DNA, 601 bp, Human; identical to SEQ ID NO: 26674

SEQ ID NO: 149728 - DNA, 601 bp, Human; identical to SEQ ID NO: 26675

SEQ ID NO: 149729 - DNA, 601 bp, Human; identical to SEQ ID NO: 26676

SEQ ID NO: 149730 - DNA, 601 bp, Human; identical to SEQ ID NO: 26677

SEQ ID NO: 149731 - DNA, 601 bp, Human; identical to SEQ ID NO: 26678

SEQ ID NO: 149732 - DNA, 601 bp, Human; identical to SEQ ID NO: 26679

SEQ ID NO: 149733 - DNA, 601 bp, Human; identical to SEQ ID NO: 26680

SEQ ID NO: 149734 - DNA, 601 bp, Human; identical to SEQ ID NO: 26681

SEQ ID NO: 149735 - DNA, 601 bp, Human; identical to SEQ ID NO: 26682

SEQ ID NO: 149736 - DNA, 601 bp, Human; identical to SEQ ID NO: 26683

SEQ ID NO: 149737 - DNA, 601 bp, Human; identical to SEQ ID NO: 26684

SEQ ID NO: 149738 - DNA, 601 bp, Human; identical to SEQ ID NO: 26685

SEQ ID NO: 149739 - DNA, 601 bp, Human; identical to SEQ ID NO: 26686

SEQ ID NO: 149740 - DNA, 601 bp, Human; identical to SEQ ID NO: 26687

SEQ ID NO: 149741 - DNA, 601 bp, Human; identical to SEQ ID NO: 26688

SEQ ID NO: 149742 - DNA, 601 bp, Human; identical to SEQ ID NO: 26689

SEQ ID NO: 149743 - DNA, 601 bp, Human; identical to SEQ ID NO: 26690

SEQ ID NO: 149744 - DNA, 601 bp, Human; identical to SEQ ID NO: 26691

SEQ ID NO: 149745 - DNA, 601 bp, Human; identical to SEQ ID NO: 26692

SEQ ID NO: 149746 - DNA, 601 bp, Human
tgggggggatgttaatgaattctgttagaatggggaatctggcataggtaaaaacttaaacctatgctgtctaatacaattgttgcttgccacatggagttaagtttaaattattcaaatgaaatgtaacttaaaaattcagttctgtcacatgagacacatttcaagtgctcaatagccacatgcagctagtggctattatattggaccacacaggtgtagaatattctcatcattgcagaaaatgctttcagacagggctgacatagaagatgcatcagagaagaggagggggatagaygggtgggtagatgagaggggcacataaggtaattgcaacagaatgaatgtttatgtctcccccaaattcatatgttaaaatcctaacccttaatgtgatggcattagcaggtggggccttggggaagtgattagattgtgagggtagaggcctcatgagtgagattagtgcccttataaaagggaccccagacagctcccttgtcccttttgctatgtgaagacatgataagaaaacggtcctctaagaacgaggaagtgggtgctcaccaggctctgattctgcctggtgccttgatct

SEQ ID NO: 149747 - DNA, 601 bp, Human
ctatttcagcaatggggtcaggaacaattgtatctttcctgattagccaggaaagaatcaaggagaaggagcagctgggcgtggtggctcacgcctgtaatcccagcactttgggagaccgaggcggatagatcacgaggccaggagttcaagaccagcctgaccaacatggtcaaaccctgtctctactaaaattacaaaaattagccaggcatggtggtgcacgcctgtaatcccagctactcaggaggctgaggcgggagaatcccttgaacccaggaggcggaggttgcggtgagcygaggtcgagccactgcactccagcctgggtgacagagctagactctgtctcaaaaccaaaaaacaaaacaaaacaaaacaaacaaacaaaaaacataaaaaaggcaggggaggggaagatgtccagtatgaaactgggggggatgttaatgaattctgttagaatggggaatctggcataggtaaaaacttaaacctatgctgtctaatacaattgttgcttgccacatggagttaagtttaaattattcaaatgaaatgtaacttaaaaattcagttctgtcacatgagacacatttca

SEQ ID NO: 149748 - DNA, 601 bp, Human
ctgactatttcagcaatggggtcaggaacaattgtatctttcctgattagccaggaaagaatcaaggagaaggagcagctgggcgtggtggctcacgcctgtaatcccagcactttgggagaccgaggcggatagatcacgaggccaggagttcaagaccagcctgaccaacatggtcaaaccctgtctctactaaaattacaaaaattagccaggcatggtggtgcacgcctgtaatcccagctactcaggaggctgaggcgggagaatcccttgaacccaggaggcggaggttgcggtragccgaggtcgagccactgcactccagcctgggtgacagagctagactctgtctcaaaaccaaaaaacaaaacaaaacaaaacaaacaaacaaaaaacataaaaaaggcaggggaggggaagatgtccagtatgaaactgggggggatgttaatgaattctgttagaatggggaatctggcataggtaaaaacttaaacctatgctgtctaatacaattgttgcttgccacatggagttaagtttaaattattcaaatgaaatgtaacttaaaaattcagttctgtcacatgagacacat

SEQ ID NO: 149749 - DNA, 601 bp, Human
tggaactgcagaagcaaggtttagggagagacaggaaagccctctaggcacttgcctaagggcaatctagtcaaaccttcccaagttatgaatcaattttttcactctgggccatgtcacattttagttgccattagcaaatcatttcgcttagaagcctaagtggtaattatgtgcacattaagggatccagaatactgattttactttagtacaactcacacttttttgtatgcaaagatttcccactgctcatataacagacaccaggcatttaactgactgctcacatgggcatgcwggcaagaggtattcagctgaggactccacactaatgttttggacttaacgttatgctttaacttttcatctgttttgtagaatgtagaatttggcttaatgactatgtttatttctgttcaaagcactggaaataaaaggtttgtgcagatgtttgaaggacaccatatagactattcacaaacttttgtggtcagtttagccaccatggtcaggcccagtgactcactctaaactgagttttgttgtttcttaaaatattgttttgctcttgtcctcaggaaagttggtgtattcgtca

SEQ ID NO: 149750 - DNA, 601 bp, Human
agggacagtagtcaaatgatgatataaataaatgtagaactgtaatggtgccaaggattctgaaggaagggcttgcagcactgtaatagtatctgtccagaagacctgccctagtttcatttaatcttcacaacaaccctatccctattttgtacattggaactgcagaagcaaggtttagggagagacaggaaagccctctaggcacttgcctaagggcaatctagtcaaaccttcccaagttatgaatcaattttttcactctgggccatgtcacattttagttgccattagcaaatcrtttcgcttagaagcctaagtggtaattatgtgcacattaagggatccagaatactgattttactttagtacaactcacacttttttgtatgcaaagatttcccactgctcatataacagacaccaggcatttaactgactgctcacatgggcatgcaggcaagaggtattcagctgaggactccacactaatgttttggacttaacgttatgctttaacttttcatctgttttgtagaatgtagaatttggcttaatgactatgtttatttctgttcaaagcactggaaataaaaggttt

SEQ ID NO: 149751 - DNA, 601 bp, Human
tgcaaatgacttacacatttcattcaaaagattgttgttgactcccttttatatgccaggttctatgaggaggtggtgaagcaatgttgagaaaaagttgacataaatcctgtccttatggaatgtacagtcagctgagggacagtagtcaaatgatgatataaataaatgtagaactgtaatggtgccaaggattctgaaggaagggcttgcagcactgtaatagtatctgtccagaagacctgccctagtttcatttaatcttcacaacaaccctatccctattttgtacattggaacwgcagaagcaaggtttagggagagacaggaaagccctctaggcacttgcctaagggcaatctagtcaaaccttcccaagttatgaatcaattttttcactctgggccatgtcacattttagttgccattagcaaatcatttcgcttagaagcctaagtggtaattatgtgcacattaagggatccagaatactgattttactttagtacaactcacacttttttgtatgcaaagatttcccactgctcatataacagacaccaggcatttaactgactgctcacatgggcatgcaggcaag

SEQ ID NO: 149752 - DNA, 601 bp, Human
ccaccatcatcatcatcaaaattcattagcatgtattgagtcctcactatgtaccagacactgttccaagctctttgcaagtattatcccactaaatttgtacaactattcagtcaagtagataccattattatctcccctttatagaaagcaggaactaagacaaaggcagaaacattacttgtccaagcacacagcattcaaacccggggatctgacaccagtgactgcaaatgacttacacatttcattcaaaagattgttgttgactcccttttatatgccaggttctatgaggaggtggtgaagcaatgttgagaaaaagttgacataaatcctgtccttatggaatgtacagtcagctgagggacagtagtcaaatgatgatataaataaatgtagaactgtaatggtgccaaggattctgaaggaagggcttgcagcactgtaatagtatctgtccagaagacctgccctagtttcatttaatcttcacaacaaccctatccctattttgtacattggaactgcagaagcaaggtttagggagagacaggaaagccctctaggcacttgcctaagggcaatctagtcaaacctt

SEQ ID NO: 149753 - DNA, 601 bp, Human
gatcatttacattctctgaacaaattatttccacatgagaacagattacatcctttgactatgatgagtagagacagatcctctggggaggctgatttgcaagctgggtacttgaaaatccccagggaggactggtcaaaaagccagaagaccatacaagcatggggggaagggactgggaagtaagagggagatgaaagtagggaggtgggaaaatacttggtaacttttccttggaccctagagacccgtgtaccattgtaaacatcatttgggtatctcctttgacactgcctctgtygtctgtgcctggcataacatggaaaggtaaagcagtggtcctgtgatattttaggtaactaaggaccacctatgactgataatcaagaggcaaatactgtttcaatgatgaccgtgaataacaattagaagaagagctattatttatgaagagcttattgcatgtccaccgccaccatcatcatcatcaaaattcattagcatgtattgagtcctcactatgtaccagacactgttccaagctctttgcaagtattatcccactaaatttgtacaactattcagtcaagtagataccatt

SEQ ID NO: 149754 - DNA, 601 bp, Human
aggttttctctgatcaggtgctcagtctgaaaaggaaggaaggggagaagaaagggcttgaggaagaattttaatatgaaggacactgtatgcaggatgatgagactgtctaatcattccccgtggctttaaatacttttattgacctcattgttaaaaatcctcacagaagtcagtattacagagaaaagaaattaattttcaattttaactaaacctcatttttcttccctacttgttttttaagttaaatgttacatgtggttggagttgctagtaagttatgcaattttgctcagayaaataagtaaagaataaaatatttataaaaatcagaaggtatatttgcttaggtctttgaatgtctttttcaaaaggccttaaatccctatggattaatcaagcacatctcagatattgtccttacaatgctcaggaaagaaatgacccctaataggataaaaggcacattacgatctgaacttgagaatttgcctggaaatttttctttagaactggaattactctagaaagtgtatgaaacactctgagcttttcattatttccccaaatcatctatctataggttagcaatgcattt

SEQ ID NO: 149755 - DNA, 601 bp, Human
ttgtttcaactcgttctgctttaaaactctcaaatagttttcagatgaatgggtgcaaaatggcagcttgcatatcttcctttaactctcctttttggaaaagtgtccaccaaagaatttagaaatgaaagaaatccatcaattaagcatttgtgttattaataatagccaccattgactgagacactgtgtgccaagaattgtgctgatctacattacccttcaccagtctataaggtagactgatgttggtctctcgatattaaatccttcactcatccatttggagagttttatgaayagccacaggactacaccctgggaatacagtactgaaaaaagtagacctcctgccccttacccctccccaccccagccctctacaaacacacaaacatcccatggagtctaatggggaacagacatcccaatgcagtgagtgtcaagaaagagggaaactgaggagcatataccaggggtcctaacctagacagggatgggaagaaaaacctcacggataaaaaagatgtttaagcctggacattaaaagttattctggcaaacagggaggcgttactggtgctggaggtgaaaatcactc

SEQ ID NO: 149756 - DNA, 601 bp, Human
aataaaagaagtctcacacttataatgtttaaataaaagaagatacaagtctgttacaccaagctgtacataacatggtcctcattatgaaaatcctacctcagaattctaactgtagttagagtgttcacctttcattattcatgtagaagcctcagatgtaagactttcatgtggattccataattatcttttgcaaattttgtttttatgtgatactcactgtagtcattttccaagtgctaacatgtagattcctataggcaccactcatatttctgtttaaaaaacaacagaaacsttcaaactggtaacatctgattgatagactgggttagggatgcttacacctggagtgtagccagacccgaggcccttgcaaacacacaattatactagatccatcacatcaaagccattttctgtgttgcttccaattttaggtctggcacattgtttcaactcgttctgctttaaaactctcaaatagttttcagatgaatgggtgcaaaatggcagcttgcatatcttcctttaactctcctttttggaaaagtgtccaccaaagaatttagaaatgaaagaaatccatcaattaagc

SEQ ID NO: 149757 - DNA, 601 bp, Human
gacctgtcacatcttctcttcttcatccactccccaccaagagagcatgattgatgacccagagcagtcaatccccttctgtttcccatctgcaactgggctaataggaagcaactaagccgagtgtagcatcacttttggttacttatccggtatccgcttccccttttccccacttccccagccactgagacataagtagatatttgcctggggttctggtaaaagcttttggtttccttttttcttttctttctttttgttgagacagagtttcactcttgtcacccgggtgtcaatkaaaagcccccattttaaaacatcggctctgacccatgacatagcaacattatggcctcgttcctttaactcacagtttcttccagtgctaagaattatgacaaactgtcctacctatgttaaattttcagcaaagtttataacttaagagacctggtcagttggaaataaaagaagtctcacacttataatgtttaaataaaagaagatacaagtctgttacaccaagctgtacataacatggtcctcattatgaaaatcctacctcagaattctaactgtagttagagtgttcaccttt

SEQ ID NO: 149758 - DNA, 601 bp, Human
cttgcctgctgccatgtaagatgtaacttttgcctttcaccatgtgaggcctccccagccatgtggaactgtgagtccattaaatctctctcttttttttttaattaattacccagtctcgggtatgtctttatcagcagcatgaaaatggattaatacaaccatggagatgcaaattaaagccactgtgagacaccatctcatactcattagataccatttcacacccttttgataataggactattattgaaaagtcaagaaataacaaatattggtgagatggtagagaaaagagaaygcttgtacaatgttggtgggaatttagattgatacagccatgagggaaaacagtatggaggctcctaaagaaatttaaaaatggaactaccatatgacccagcaatccctcttctgggtatacacacaaagatgaaatcacccactcataaagatacctgcactctcatgttcattgtggtactgttccatagccaagacatggaaacaacctaagtgtcaacaaatgaatggataaagaaaatgtggtatatatgcatatacacacatacacaaacacacacactggaatattatttag

SEQ ID NO: 149759 - DNA, 601 bp, Human
attcctccctatactcagagcagagtgccttgcacatacgtaacgtgttcaattgatgcttgcttgttacgtagagctgctgttgaactgaaggccaaaattatgagttataaatttcatgatcagtaatatggtacaacttataacacttttttgatcttgcattctaacatatgctaatattttcatgatacatggagaatggagtgtttctagtattaatcatatgctttatgttaagtaatgtagattttcactttcatatataagcaccatgcaaggctttttggaaacgaaccarttctcatgagaacttattagtgtattaagaaaacactgacaccaaaagttcaggctaaaaaagcaaaaataaataaatgagactacaacaaactataaagcttctgcactgcaaaggaaacagtcaacaaaaagaaaaggcaacctacagactgggaaaaagtacttgcaaaacacgtatctgataaggggttaatacccaaaatttataaagaacatttataactcaatagcagaaaaataaataacctgatttaaaaaggggtaaagaagctaaacagacatttctccagagaagaca

SEQ ID NO: 149760 - DNA, 601 bp, Human
aaaaagacaaggccagcaaaattatctccatgaaccaccagtaagcttcatctttagtaacctttttggacaatactaaatcaaattgctaggttttcagtgttacctccaaagtactgcagattcatcccctgccagcatttcactggcactgtcttagtttcggttctcatcactgttaatctgcacttttatcacaatgcttacttggtttccttctgcccagggaattccctgctgccacttcctcagcacccttcaatcaagaagctattcatcaggcattgccttccttctgaamcctctctgacgccctatcttcaccgtcctccaacagagttaaatccggtctctgtgtaactttttatcattgtgtttgatcgcattgcattgtaattatttgtttatttgtctgtttcctcttgatggaataagagtcgtttgagaacaggcactgcagtatgctaattcctccctatactcagagcagagtgccttgcacatacgtaacgtgttcaattgatgcttgcttgttacgtagagctgctgttgaactgaaggccaaaattatgagttataaatttcatgatcagtaatatgg

SEQ ID NO: 149761 - DNA, 601 bp, Human
gccaaaattgaccttaaatggggcagggaaatataaacctgtcacagggagatggaacaagtaattggaaacaataatgtgatctcgcacagtatcctatatttgaaatgccaccacacattcctccttttccccattcttcaaaccttcaaagctgcattatcacttcctttgtgaagcgtttcttttgccaccaggtagagttagctcacttctccgcattcttgcaagcctcacttctaagaatgtgcttattacactggacaaatgaccacttctttttttttccttttttttttttctttttttagagatggtgtcctctctgttgcccaggctgaagtgcagtctcatgatcatagatcactgcagcctcgaactcctgggctcaagtgatccctgctcctcagcctcccaagtagcacgtgacaccatgcctggctacagccttttcttgatttctctgtctccagttccaagcatctcagaacatactgacagaatgaataaatcaggcagtttgttgcttggcaatttattagacaggattgggaactaatatgcagaggtaggtgaccaagtaaatccttcaatcaggcag

SEQ ID NO: 149762 - DNA, 601 bp, Human
atgtgataaaactgatttcatacatgcttccaggaattccaaggaggaccctccatggtgccttcttaaattgaaatgacatttatttaaatgcatgttatcacatgactgttaatcaaacagtggctttagagtggcatttttccaaggtgtggttaacagacaagctgcattggtaacatctagtttaaaattcagattcctaggacccatccaaggcccattaaatcagaatctctgagaattgagcctgagaatattcttttattttcctttttcttttcttttctttttcttttttttttttttttttttttgagacagagttttgctcttgttgcccaggctggagtgcaatggtgtgatctcggctcaccgcaacgtctgcctcccggtttcaagtgattcccctgcctcagcctcctgagtagctggtattacaggcatggaccaccacacccagctaattttgtatttttagtagagacggggtttctccatgttggtcaggctggtctcgaactcccaacttcaggtgacccgcctgccttggcctcccgaagtgctcagattataggcatgagacaccacgcccaaccaa

SEQ ID NO: 149763 - DNA, 601 bp, Human
ataggctcatccctgctctgggttctgggaccaatcttgtccttagggggaaatttaaagagacagatttgggtaactgaggtgacccgggctcaagtcggtttagctcagatacttggaatggtaggcctggaaaggaaccttgtgaagattgctctttctaggatttattcctgtgtcactggttttgcattttgtttgagaaagagatacagaggaaggtgatgggggaagggcatcataatgctgtggaaagaccatggctttgaaatcagactgctgggcccacatactaatgccrtggtttaatcagccacgtggcctggttatattcctccctgagcctctgtttcctcatctctatggtagggataaaagaaccaaatttaaagttgtgaacctcaaaaaccaccttgctggtctaagtcactatcatctcttgtctgttattgcaataatctgctaacagtcctctctgcttcctgcttgctccactgccatctgtggtcaacatcatatccagaacaatcctgtttaaaaatgtaacttggatgattcttccttttgcttaaaacctgatcatgcctttcaatttcttaca

SEQ ID NO: 149764 - DNA, 601 bp, Human
caaatagtatgcactagtcggctgggcacagtggctcatgcctgtaagcccagcactttgggaggctgaggcgggcggatcacttgaagtcaggagttcgagaccagcctggccaatatggtgaaaccctgtctctactaaaaatacaaaaacaattagttgggggtcgtggtgggtgtctgtagtcccagctacttaagaggctggggcaggagagtcacctgaatctgggaagcagaggttgcagtgagccaagattgtgccactgcattccagctcaaaaaaaaaaaaaaaaaaaaaagcactagcctccttctcctcctctcctttgctcctactgattgagctgtacaaaagccagaagaaaaaagatgacatgacattaccaattttgtagcacaatgtcttgttatcataatgcaatattaatgcaggcattatgtttctatgagatgttaagcataaagtgaaaaaatatcccatggtcaatgaatttggaaacttctggttaaacaaccttaaaaatgtgtcttttagtgtgcttccctttctgaacttttagcatgctaatatgcatcatgaacctctaagagaggcctaa

SEQ ID NO: 149765 - DNA, 601 bp, Human
tcagattcagagccaaggtgctgctatatacaaccagttatcattaagtgagcatctttcactagaaacgaacaaatagtatgcactagtcggctgggcacagtggctcatgcctgtaagcccagcactttgggaggctgaggcgggcggatcacttgaagtcaggagttcgagaccagcctggccaatatggtgaaaccctgtctctactaaaaatacaaaaacaattagttgggggtcgtggtgggtgtctgtagtcccagctacttaagaggctggggcaggagagtcacctgaatcygggaagcagaggttgcagtgagccaagattgtgccactgcattccagctcaaaaaaaaaaaaaaaaaaaaaagcactagcctccttctcctcctctcctttgctcctactgattgagctgtacaaaagccagaagaaaaaagatgacatgacattaccaattttgtagcacaatgtcttgttatcataatgcaatattaatgcaggcattatgtttctatgagatgttaagcataaagtgaaaaaatatcccatggtcaatgaatttggaaacttctggttaaacaaccttaaaaatgtg

SEQ ID NO: 149766 - DNA, 601 bp, Human
ctttgattttaaatcccttttagtggctcaaagttaaaataaagtttgcagacgtatcagttggtttaaaatcaatattttcttcattttaggcattttctatttgccattcaagggagaggaaaacattaagaatcttttttcccccagccactaacacagcaatagatctacatataaattgttagttcccttcttttgtattaatatctctatactcttgttcactattttccaaaggcattgagaagttaatcagaagtttatgaaaaaggagactttctaatcacagaaggttggmtaacactgagttaaacagctttataagtcacaggcctttttagaacccttagttcattgtggatcctcaattataacataatgtaatgtaataatataatatatgggaggacgcttcccaacagtcatcccttttcctggtaacaatatcttgattgtcctttagggaacctattcctcattcttagtccctgagttctggtgaatctgtcccccattcctggctttagaaatgttcatatgacaagtgattcattggtaagtgttaaaaaccaattctaaaaaaaaagaagaaaatcct

SEQ ID NO: 149767 - DNA, 601 bp, Human
cacctcccgggttcaagtgattctcctgcctcagcctcccaagtagctgggacttcaggcatgcactgccatgcctggctaattttgtatttttagtagagacagggtttctccatgttaggctggtctcgaactccagacctcaggtgatcccccacacctcggcatcccaaagtgctgggattacaggcgtgagccactgctcccagccccattgttgatttttaaaacttagtgttcaacaaatatttattgagtacttaatacatatgcatgctaaggaaacaacagtgagtgagayaaagccctttgtcttatgaagactctgatgaagcttacgtattaagactctcaaaacatggtcagaatgtccttgattagcctgagttgccaaaaaagaaaagaaaaaaagaaactattttaaaattaatttttattgctttctgtctttcattttttcttcctatcatagcactagatgaagttttagatataagcttaaaagcctgagtatttgatttctcaatgaccgaaggttaattacagctcataaaaatattagaattaacatataatattcagcctaaaagatataggaaat

SEQ ID NO: 149768 - DNA, 601 bp, Human
cagtgaaaattgttcaatgaagattcctttcctgcaagtggtagaaatacagccctcactaatttaggcaaacaaggaagggggaaatatcatgaaaaagaatattaagtcccaaatggcagcatagctattgcctaactaatttaggcaaaaagggaagggagaaaggccacgtaaaagaatataaagtcccggatggtgacatagctattgggggaaggtaaattcctacatgaaggaaggtgggaagggcagacagtgccttcatatgtccacaaaacatatgaaatgagatgatgtrtatgagaaagcatcaagtggataaaatatacctctgtcatgattgttgatttttttttttttttttttagacggagtttcgctcttgttgcccaggctggagtacaatggcgcagtctcggctcactgcagcccccacctcccgggttcaagtgattctcctgcctcagcctcccaagtagctgggacttcaggcatgcactgccatgcctggctaattttgtatttttagtagagacagggtttctccatgttaggctggtctcgaactccagacctcaggtgatcccccacacctcgg

SEQ ID NO: 149769 - DNA, 601 bp, Human
aattttttgtatttttagtagagacagggtttcgccacattggccaactgatctcaaactcctggcctcaagcaatccatccaccttggcctcccaaagtgctgggattacaggtgtgagctttcatctttattttgcacagcagtttagtaaggaatttgttgaaattatactagacttatattcagtattgagccttggatgtttaatactttatctttagaaaataaaaattttcagttgaagaacaaagcatatcagtattccattaatatagttttcagtataacagatataacartgaaaattgttcaatgaagattcctttcctgcaagtggtagaaatacagccctcactaatttaggcaaacaaggaagggggaaatatcatgaaaaagaatattaagtcccaaatggcagcatagctattgcctaactaatttaggcaaaaagggaagggagaaaggccacgtaaaagaatataaagtcccggatggtgacatagctattgggggaaggtaaattcctacatgaaggaaggtgggaagggcagacagtgccttcatatgtccacaaaacatatgaaatgagatgatgtgta

SEQ ID NO: 149770 - DNA, 601 bp, Human
actcctgggctcaaaggatcctcccatctcagcctcccaaagtgttgggattacaggtgtgagccaccacacccagtcccccatgactggattctcatactgctattcatctctggtgggttactcctttcttcaacctgaaagtgatgttatattcaaaaccaccaacagccgggagcatccctagacacttccattggctttagagagtgttatttttgtctccattggatttagagagtgttatacatatgcatatgtatatatatacacacaatatatatatacacacacactacayacacacacacacacacacacacacacacacacacacacatatattttttttttgagtcagagtctcacttgtcacccaggctggagtgcagtggtgcaatctcggctcactgcaacctacaccttctaggttcaagtgattctcctgcctcagcctgccgagtagctgggattacaggcgcctgccaccatgcctggctaattttttgtatttttagtagagacagggtttcgccacattggccaactgatctcaaactcctggcctcaagcaatccatccaccttggcctcccaaagtg

SEQ ID NO: 149771 - DNA, 601 bp, Human
aggcttgtctcaaactcctgggctcaaaggatcctcccatctcagcctcccaaagtgttgggattacaggtgtgagccaccacacccagtcccccatgactggattctcatactgctattcatctctggtgggttactcctttcttcaacctgaaagtgatgttatattcaaaaccaccaacagccgggagcatccctagacacttccattggctttagagagtgttatttttgtctccattggatttagagagtgttatacatatgcatatgtatatatatacacacaatatatatatayacacacactacacacacacacacacacacacacacacacacacacacacacatatattttttttttgagtcagagtctcacttgtcacccaggctggagtgcagtggtgcaatctcggctcactgcaacctacaccttctaggttcaagtgattctcctgcctcagcctgccgagtagctgggattacaggcgcctgccaccatgcctggctaattttttgtatttttagtagagacagggtttcgccacattggccaactgatctcaaactcctggcctcaagcaatccatccaccttg

SEQ ID NO: 149772 - DNA, 601 bp, Human
cacggttactgacaacagtgtgattcaaaccatggcagtctggctccaaagcccacactcctcattcctgaacgctatgttccacttcagtgctggccactgaaccttctcctgccacttctagtttcaggagcttcactaggatctcacctacaccgtagtgccgctgtgagtgaggctttgacaaagttgggttttgactgagtgctgtcaaaggctcttctcaacccaaaggacatgctctgaattctgtctctctttagtccaaatggctcctgtcctttgtctctgtagggttgartctaactctttctctcctgcattcctgtttcagattgtattgctagttgagatagagacttgctctttccttcgggtgttgtttgagtgcagaattgtgtctctgtaggatcagcccatcccccttccccacactactcttctgctttgagaccccatgattggatttttttttttttagactactgcccaggctagagtgcagtggcaccatcacagctcactgcagccttgacctcctgggttcaggtgatcctcccacctcagcctcccaagtagctgggactacagacacaccacc

SEQ ID NO: 149773 - DNA, 601 bp, Human
tatattcttattcttagctgttgaccagagtcatttagggaggcaaagcaaaacatttaaattgatgctaccttctttcttatagcccatcgtacatccagaatactgagctaatattctcaattaagctaatggatcccacaaaaaagcaatttactcccttttgagtggtgatattaagcccattattgaatgtattcctatgctactgcactcagtgcgttgccagaggcatcttgtgcagatggagaaagaagccaaaagattaagggattgagctgaggtccagccaggggtggtsgagtggttcaaaattgaactcaaattccttaaatccttgaatatattattctaaatattgcacttaatccaccaccttcaatattatgtacaaaaccaaaaaacctaaaactacaggggtgaatttttctttccagtttctgactgtgaagaattttcagtggttacacatttgccaataggcataattcaaggtctctgaaacactgggtagctgaaaaataactagtcagttaaataattaatttaaataacagtaatatccccagggttttcttcgggtacctaatctggaacactg

SEQ ID NO: 149774 - DNA, 601 bp, Human
ctgtaacatgaagacatttgagagtaatcagataattttctctagattttatgttctttacccaaagtggtttggaatgctatttgagagacatgaaaaatatgacaaagaccatcaaaaatagtatctgctcaaaattctgtttaggatattctcttttagatgcaatgatttcagggtgctatgtcaagtaatttgataaattatatctctagcttggccccaacaggattgcattttgttttgttttgttttgttttgttttttgtttttttttttttaggcagagtcttgctctgtygtccaggctggagtgcagtggtgcaatctcggctcactgcaacctccgcctcccaggtgcaagcaattatctgcctcagcctcctgagtagctgggattacaggtgtccgccaccacgtctggctaatttttttgtatttttagtagagacagggtttcaccatcttggccaggctggtcttgaactcctgacctcataatccacccacctcggcctcccaaagtgttgggattacatgcatgagccaccacgcccagcctgtcttttgtttatttataccgtgccttcttccaaaaggg

SEQ ID NO: 149775 - DNA, 601 bp, Human
ctaatctgaaactgaacaggaatcggaagacaaactttaaactgaaacttttctgttgaaagaatgtatcttttaaagacacataaaaagaaatgcaaagaaccgatttccatataaatgccactcaataacaatacaggttataacaatatttgactgcattaaacattcaaaaaggaacacaaagatacccaactgcaaataaaagacctcatatatttttggtagcggaatgtggggggtggggggcaaaaatcacattaattcagattaatcatgtaaattcagaacacgtgatgtrcagttttgtgtcgctcagaactcctgaatccagctttgtgcttttacacaacataacagaaatggcatctttcacaaagcctaactttgacctccaacactttaactttgggtttaaccagtacaccaccttcggaagttagcacataaaaatacaggtaagtcaaatgcactacggatacagaaaggacgaggaacaggtttaaaggggagttgaagcagaggggcacgaaatcacctggcaggtcacctctccgaaggaaaaacatttcaagctccctcccatcccccaggtaacctc

SEQ ID NO: 149776 - DNA, 601 bp, Human
aacgatactactatatcacattaatcttacttcaagcaaatactttttaaaattaaaaactaatctgaaactgaacaggaatcggaagacaaactttaaactgaaacttttctgttgaaagaatgtatcttttaaagacacataaaaagaaatgcaaagaaccgatttccatataaatgccactcaataacaatacaggttataacaatatttgactgcattaaacattcaaaaaggaacacaaagatacccaactgcaaataaaagacctcatatatttttggtagcggaatgtggggggtggggggcaaaaatcacattaattcagattaatcatgtaaattcagaacacgtgatgtgcagttttgtgtcgctcagaactcctgaatccagctttgtgcttttacacaacataacagaaatggcatctttcacaaagcctaactttgacctccaacactttaactttgggtttaaccagtacaccaccttcggaagttagcacataaaaatacaggtaagtcaaatgcactacggatacagaaaggacgaggaacaggtttaaaggggagttgaagcagaggggcacgaaatcacctgg

SEQ ID NO: 149777 - DNA, 601 bp, Human
ggagaaggcacacttatttcctggaaggtgatataaagaaacaaatgactactgcctttaggcctttgggaataaccaaatccacttaaaaacctcaaaaactaatgctttacaatttcatagcaaattattagaaacaacctacatatatcacaatgaagagattaaataaattatggtccatccctaatggagtactcagcagctgttagagaatgaggcagattctcttagataccaatggagactgccatgatttagtactctggggagggaagcggggcagggggagctggtgcasagtatacaatgggtcctcatctttaggaatacaaacaaaaagaacacgtacagaatgtttacatgagcataggctatgtctggaaagacatacacaaggagccagtagctgtggaacatgatgggagagaggtatactccgtatcttttatatctattgaatcttctccagtgtgaatagattacctgctgcacaattaatgtaagaaaaatgcacactattaccaacatatttgtcaaggatgaccattcagaagcaaatttttcaaaaatcacaaaagttttgctccttcaacagcag

SEQ ID NO: 149778 - DNA, 601 bp, Human
gccagctactacctatttcatagaagaagtacccacatgtggggacacttgaacgtttagcaacttgagggtaaggcatcaataaatctgtgtttgagagctttaaataacacatccttttttattatgtaagtttaatcagaagctttataaaaaggacatgatagaagacggtagaggcagcatgatgcctctagttatgactaccacttgtgccactccctcaactttaccaggtaaataaggacaaacctccagagtcgggcctagttggggcctctttccctcagcctgcacaaakgcaatgcttctaaccggtctcaggacttctgatcctcccatagcacaaattcagttttgtatgcctagaatcctccatggctctccctggcctacagggaaaggtcccaagttgaacagggcatgaggctctagctttttcatgccagcctaagtccccagtgccatctctgtgcacctcctcacagtggccccgtgcttaagttccaccaaatgtgtaaacatgtcaggctctgtggtgcctcagtgttcccgcacagacagatcatctacctggaatgtccttcccactccactcttc

SEQ ID NO: 149779 - DNA, 601 bp, Human
aaaatcgtgtcctccagtggtattaaaattggaggattcattttagtttgaaaaataagtagataatctaatatcaaagtattaacatgaaacataaattatgattgttggttttattactgcccaagtcatcataaattcttgctcaatgtaaatcttactctagtaaatcccatctcaccgtaagtgccagctactacctatttcatagaagaagtacccacatgtggggacacttgaacgtttagcaacttgagggtaaggcatcaataaatctgtgtttgagagctttaaataacamatccttttttattatgtaagtttaatcagaagctttataaaaaggacatgatagaagacggtagaggcagcatgatgcctctagttatgactaccacttgtgccactccctcaactttaccaggtaaataaggacaaacctccagagtcgggcctagttggggcctctttccctcagcctgcacaaatgcaatgcttctaaccggtctcaggacttctgatcctcccatagcacaaattcagttttgtatgcctagaatcctccatggctctccctggcctacagggaaaggtcccaagt

SEQ ID NO: 149780 - DNA, 601 bp, Human
acacacgggaaaaccacaaaaaaaggttaataagctgggccaatattgtaagatggccataaaaatattaagaaggactacttttttgtcttctcactttatcagacacataatgtctaaaatcgtgtcctccagtggtattaaaattggaggattcattttagtttgaaaaataagtagataatctaatatcaaagtattaacatgaaacataaattatgattgttggttttattactgcccaagtcatcataaattcttgctcaatgtaaatcttactctagtaaatcccatctcaccrtaagtgccagctactacctatttcatagaagaagtacccacatgtggggacacttgaacgtttagcaacttgagggtaaggcatcaataaatctgtgtttgagagctttaaataacacatccttttttattatgtaagtttaatcagaagctttataaaaaggacatgatagaagacggtagaggcagcatgatgcctctagttatgactaccacttgtgccactccctcaactttaccaggtaaataaggacaaacctccagagtcgggcctagttggggcctctttccctcagcctgc

SEQ ID NO: 149781 - DNA, 601 bp, Human
tgatgtcaacctggacaaaagtgatatagacagatatcaaaaacttctgtttttcttggtatcttcattaatgagttgcatgaagatataggaatcatatccaacttatctgtggatggaaaaaaatgggcaaaatagcaaatatacagggtgtaataataggattctaataaataaatccaataaaataaattcagcatggatgtcagggtccaaaatgaaatgataatgttgataacaataacacacagaaaatgaacaaatacagatgggaggagatatgatttagcagcaacacacrggaaaaccacaaaaaaaggttaataagctgggccaatattgtaagatggccataaaaatattaagaaggactacttttttgtcttctcactttatcagacacataatgtctaaaatcgtgtcctccagtggtattaaaattggaggattcattttagtttgaaaaataagtagataatctaatatcaaagtattaacatgaaacataaattatgattgttggttttattactgcccaagtcatcataaattcttgctcaatgtaaatcttactctagtaaatcccatctcaccgtaagtg

SEQ ID NO: 149782 - DNA, 601 bp, Human
tcaaaacaacaactaaaataaagcctttagctctggcttcagaccacggtctacaacatctaagcaggtgaaacatcttctatgtaagagtggaacagcatatgaaaaacataacagcacctaaaataactgatatttggcaaagctatttcagaaaggggcattcttgttaagaaataaaatcctacagacacagaggcctgtgagcttgataactgatcctggataagatgatcaacagtactaagaaaggaatcctagaaaacctcagacccatgcacgtcagcccatccttagcctygacttgataagctgttgtactgggaaaagcaaggatcagaaacaacaaaatgtatctctgtttgaacaaaatcttttctaatacatgaaagatgagtattagcaaggtaaagaaattcaagctgtgtaaacagagtgaagaggctgcttttatcacatgatcaaccttactcagagtgctaattcataggatgatgtcaacctggacaaaagtgatatagacagatatcaaaaacttctgtttttcttggtatcttcattaatgagttgcatgaagatataggaatcatatccaacttat

SEQ ID NO: 149783 - DNA, 601 bp, Human
tttttaaatgctggcaattaattccaattaaaaaaaaaacactatgtgggccaaacaaaatacatttgcaagccaaatatagttcttagggagccagttaacctgtcacaaaatgtactggcattaaaaaattcttgtcttgctgctgaaataatcttaaaatataaactgttttaagacctagatttcaatgcacagatgttgaccaaaatgtgcctgaatgctttcttaacattctttagggtcagaatctgaagctttccactccaaaataattcaaaatttttttctttatgacatkatttaaccccagatatcaaaatcttaagcatcatcttagattatgcttctcaaaacaacaactaaaataaagcctttagctctggcttcagaccacggtctacaacatctaagcaggtgaaacatcttctatgtaagagtggaacagcatatgaaaaacataacagcacctaaaataactgatatttggcaaagctatttcagaaaggggcattcttgttaagaaataaaatcctacagacacagaggcctgtgagcttgataactgatcctggataagatgatcaacagtactaagaaa

SEQ ID NO: 149784 - DNA, 601 bp, Human
gtacacttttaattggttaagctctcaactcagcaggtgcaaactcaaacatactccaagagccagccagatgaaatgactggagccattcacatgacacaggctggcgggcagcccctcgccagctccttgtgtctgtattacaccacagaggacgagcggccagtacagccacagatcttccagtttttccaaaagggcaggaaatccaggttgttgcttttttagttttttttattattattattatgaaatatccttatttttaaatgctggcaattaattccaattaaaaaaaaaacactatgtgggccaaacaaaatacatttgcaagccaaatatagttcttagggagccagttaacctgtcacaaaatgtactggcattaaaaaattcttgtcttgctgctgaaataatcttaaaatataaactgttttaagacctagatttcaatgcacagatgttgaccaaaatgtgcctgaatgctttcttaacattctttagggtcagaatctgaagctttccactccaaaataattcaaaatttttttctttatgacattatttaaccccagatatcaaaatcttaagcatcatctta

SEQ ID NO: 149785 - DNA, 601 bp, Human
agggagggactagtaattgctgggataaaacacaagtactacccaaacaaatcaatgtagaaatggaaatgagggtgctggtttccaagatttgggaagctatgcagtactcaatagcttcacacatctcatcagtaattaaggctttttaagaatgaaataaaaatactaccatagacccttcatatcccagggttctgcaaccacagattcaaccaaccttggattgaaaatattcagaaaacaaaaccaataaaagacaacagtacaacaataaaaaaacagtaaaaaaaaaagtacygtttaacaactgcttacatagcattaacactgtattagggatgatttaaagtaatctagagatgatttaaatcatatgagaggataagcacaggttatatacaaataccacaccattttatattagggacttggcatccaaagattttcacatctgtgaaggtcttggaacgtgcccccacagagatagagggacaattatatttttccttttaagtggatacacgttatttcttcaaactgctactaaagtgcttgatcataaatactcattaaattgtttggacccagctatttcata

SEQ ID NO: 149786 - DNA, 601 bp, Human
gacagagctatcacagaatatctaagtttttgaaggaaataaagtgacatctgtccaacactctgaaaaccgttagttcaaggtagtccacagtttcaatatttgctcatgctacatttttttgtgtgacatcgtatctttatctttggtgaagagagggagggactagtaattgctgggataaaacacaagtactacccaaacaaatcaatgtagaaatggaaatgagggtgctggtttccaagatttgggaagctatgcagtactcaatagcttcacacatctcatcagtaattaaggytttttaagaatgaaataaaaatactaccatagacccttcatatcccagggttctgcaaccacagattcaaccaaccttggattgaaaatattcagaaaacaaaaccaataaaagacaacagtacaacaataaaaaaacagtaaaaaaaaaagtaccgtttaacaactgcttacatagcattaacactgtattagggatgatttaaagtaatctagagatgatttaaatcatatgagaggataagcacaggttatatacaaataccacaccattttatattagggacttggcatccaaaga

SEQ ID NO: 149787 - DNA, 601 bp, Human
taagcaggataataaagaagactttctggtgtgatacatttacacagagaattctgggcaagtctatttgggcaatacaatattgtgcttataacacatcagacttccccaccaagcaaaactttcaaatggacttactgtgggccagaacaatacatgaacagagccttccgaagtactttcagaaaaaaagtgatgcttgtgaagcttttctctgctcactcctgatagaaacattgtcagaattcacttttttcccctgtcaatgccttattccttagaggagcacaaatttttataygatttcaggagctaactttcaaaattaggatgcagcaacagggtgcaaatgcaaatatgcaggggcaaagcaagtaacaaacgtgttcacagcaggtgcaaactgcagcccctctgcctagcataaaagtggcagccaccagcctcattttgccaaatatgctgatttttccagatgaggtagaaatctggcattttaaatgaaacaccaaagtttgtaaatgtgagaaaataatgcatatgttttacacattctaaaggccagacaaaatatgctcatgggcagtatccttcctgccca

SEQ ID NO: 149788 - DNA, 601 bp, Human; identical to SEQ ID NO: 24725

SEQ ID NO: 149789 - DNA, 601 bp, Human; identical to SEQ ID NO: 24726

SEQ ID NO: 149790 - DNA, 601 bp, Human; identical to SEQ ID NO: 24727

SEQ ID NO: 149791 - DNA, 601 bp, Human; identical to SEQ ID NO: 24728

SEQ ID NO: 149792 - DNA, 601 bp, Human
gtcaaacttttcataaatgttgttcattactccttagaggccattcataaacaggaatgaaaaaacgagagagggaaaaagcatgtactgataaattcaagcttatagatttataaaaaaaaattctctatggctaagttctggctaaacatgcttcaaaacattagacaaaggtaaaataatacactaaattaaatgtgcactttcatttacataaaaacatgcatataaacaagtccagacaggaatacacaaaaacagtacttactattttcaagtggtagaatcacggcttatttcycccctaatttcctatgctatctgtaatggttacacatcatttaataattaacaagtgatttttaaatcatgcatgatgtttttaatgaaccctgaaaggtatctgatttacttcctaaataatccaaaagttcactgataccaccttaaggcttcttaaaaaaaattattcagtttctttaatgtcataggaagaaaatctatgttcaaacttactaattttacgagctccatactctctttacgtagaactttaatttcccagataacatttgagcggtgtggaaaaactgaacccctg

SEQ ID NO: 149793 - DNA, 601 bp, Human
cccgactgctctggctaggacttccagtactattgttgaataagagtggcgtaagtggtccagtctttgggtcccggcagtggaagtggtaagccgagtatgcctgtctttggaccccaggatggcattcactggccccattgttagtgggtccaagggggccaattcttgagcgtccaagtggcttgcttggatgctggtattgagagtggtgggctgggtacgttctcaggcccctggccagcaggtgtggtgtgggtgatggcagtagcagtggtaggataaccctctgggtcttgarcagtgcactctggtgctgacagtagatacaatgtgctgagtgggccagtcttcaggcccgcaggtagcatgtgcagtaggtgccagctgtggtggtagcagcagggtgtgtgggcctaatctcaggcccctagaagaggtgctcaggtgctgatggtggtagactaggctaggtgattcctaggtccataggctgtaagttctggcaccagggcaagggaacaaagctgggtgggcttgtcctcaggccctctcgtagtacatgtagacactagctgtggtaggcaggcatgcggtgttc

SEQ ID NO: 149794 - DNA, 601 bp, Human
acagatctaagttttttgggggagtctttacacttttctagatacaagattatatcaccagcaaagagggacaatttgactctctctttcccaatttggatcccttttattttctctcttgcccgactgctctggctaggacttccagtactattgttgaataagagtggcgtaagtggtccagtctttgggtcccggcagtggaagtggtaagccgagtatgcctgtctttggaccccaggatggcattcactggccccattgttagtgggtccaagggggccaattcttgagcgtccargtggcttgcttggatgctggtattgagagtggtgggctgggtacgttctcaggcccctggccagcaggtgtggtgtgggtgatggcagtagcagtggtaggataaccctctgggtcttgagcagtgcactctggtgctgacagtagatacaatgtgctgagtgggccagtcttcaggcccgcaggtagcatgtgcagtaggtgccagctgtggtggtagcagcagggtgtgtgggcctaatctcaggcccctagaagaggtgctcaggtgctgatggtggtagactaggctaggtgattc

SEQ ID NO: 149795 - DNA, 601 bp, Human
taccaaagaaagataaaaagttttataagtttagtgtggtctaattgtaccatgtagactacagtggtgaatagtcatgtcctaggccctcaattcactcactgactcacccagagaaacttttagtcctgcaagctccattcacggtaagtgccttatacaggtgtaccattttttatctctttaaacattttattgatacatagtatttatgggatacatgtgagtattggttacatgcacagaatgtgtaatgatcaagtcagggtatttggggtatccattatctcatgagtattaycatttctgtgttgggaacatttcaagtcttctagctaccttgaaatatataatacatggatgctaactacagtcaccctacttgactatctaacacagaacttatatcttctatctaactgtacatttgtacccattcaccaacctctcttcctgccccgtcccaccaacacacccttctcagtctctagtatctatcattctgttactaataatatctttacctccatgagatcagcttttttagtctccatgagtgagtgagaacatactatatttatctttctgtgcctggcttatt

SEQ ID NO: 149796 - DNA, 601 bp, Human
ctaagtgttaatacaaaagagtcaaaatattttttaaaaattaaaagttctgaagtaaaaaagttacagtaagctaaggttaatttattaccaaagaaagataaaaagttttataagtttagtgtggtctaattgtaccatgtagactacagtggtgaatagtcatgtcctaggccctcaattcactcactgactcacccagagaaacttttagtcctgcaagctccattcacggtaagtgccttatacaggtgtaccattttttatctctttaaacattttattgatacatagtatttaygggatacatgtgagtattggttacatgcacagaatgtgtaatgatcaagtcagggtatttggggtatccattatctcatgagtattatcatttctgtgttgggaacatttcaagtcttctagctaccttgaaatatataatacatggatgctaactacagtcaccctacttgactatctaacacagaacttatatcttctatctaactgtacatttgtacccattcaccaacctctcttcctgccccgtcccaccaacacacccttctcagtctctagtatctatcattctgttactaat

SEQ ID NO: 149797 - DNA, 601 bp, Human
gcagcacacagctcccactgctggacacagagaccacagacagacaagtgcctcacaaatgaaacatgaatgcaaagtgttcttgatttttaaattattataaaataatagcattagtgcaaaataataggatatcataaaatgactgatcacaagcaattttgtcttaaatactgacattaataacgtactattaataaaaatgccctgaggcattttcccttactttacagttctaaagaaatgtgttctttctcattgcttcttgctattattttcccaaattttttcccaaaagtarggaattactgccttgtcattggctgacttacacatgttgtagaatgagctatatggttttagcctaacagtcccttcatttaagtttgatttcactcacatttcagagtgtccctctttaattctagtattctctagttagttcctcctcaagttacattaaaaattaaaaaagcctcgtccctatccatctgacaaagggctaatatccagaatctacaaggaacttaaacaaatttacaagaaaaaaatcaaacaaccccatcaaaaaagcgggcaaacgatatgcacagacacttct

SEQ ID NO: 149798 - DNA, 601 bp, Human
agaaaaagaaaaaatgtgaggaaacagggcatgtagaaaaaaactttaaatcattactatcctcagagataagacattgcatcatgaaacaaaaactggatacattaaaaaaataacataaatcctttcaaagaaaggatcttctataaattaataaacatatgaatagaaattcaatagcaggatgcaaaatccagtttagaaaaaatttctgagaaaatagaaaatacatagaaaacaagaaagataaaaacaattagaggattgttgtggaaggttcatgaagaacagaagttctaaraaaaaaggagaagacagagaaggacaaatcaaagaaataaaacaagaaattcccaagctgacacacatgtgtttttagactgacaggggcccaatgagtgtccagaagaacagataaagattgatccacactaagaaacaatggaatcataccttcaaaatcttgacaaaatttcccaacctgtaattctacacccagttaaactagtaatcacgcacgagtgcagaatagacattttcataaatgtggtatctccatgtattcctttggtaagcattttacactctgcccagtaacgta

SEQ ID NO: 149799 - DNA, 601 bp, Human
aaagaaaaagaaaaaatgtgaggaaacagggcatgtagaaaaaaactttaaatcattactatcctcagagataagacattgcatcatgaaacaaaaactggatacattaaaaaaataacataaatcctttcaaagaaaggatcttctataaattaataaacatatgaatagaaattcaatagcaggatgcaaaatccagtttagaaaaaatttctgagaaaatagaaaatacatagaaaacaagaaagataaaaacaattagaggattgttgtggaaggttcatgaagaacagaagttctmagaaaaaaggagaagacagagaaggacaaatcaaagaaataaaacaagaaattcccaagctgacacacatgtgtttttagactgacaggggcccaatgagtgtccagaagaacagataaagattgatccacactaagaaacaatggaatcataccttcaaaatcttgacaaaatttcccaacctgtaattctacacccagttaaactagtaatcacgcacgagtgcagaatagacattttcataaatgtggtatctccatgtattcctttggtaagcattttacactctgcccagtaacg

SEQ ID NO: 149800 - DNA, 601 bp, Human
cattccaaaaacagggggattgctaacctatgccttcttcctctgctcagctcccaggatactggtttgccagactaatcctcaccaggtaatagtctaaatgaacttttctgagtcacataaacatgtcaaaatgaaatacctaaaataatatttggcgtttgccacctgcatagcccatcctcatcactctagagggaaggcccccatcaacaagtcctatccagagaaaccaaagttccaattagattaaaaaaaaatttttaacagcccctcgcttaactgtgagcagcaaccaggrtgaccagaaagtgtacaagaaattctaatacgaaagtcaataattgaaaagaaaagaaaaagaaaaaatgtgaggaaacagggcatgtagaaaaaaactttaaatcattactatcctcagagataagacattgcatcatgaaacaaaaactggatacattaaaaaaataacataaatcctttcaaagaaaggatcttctataaattaataaacatatgaatagaaattcaatagcaggatgcaaaatccagtttagaaaaaatttctgagaaaatagaaaatacatagaaaacaagaaag

SEQ ID NO: 149801 - DNA, 601 bp, Human
cagattagggatgctcaacctgtataccactgcctaatgatctaaatttttcatagagtagaagtaattaatggggttgcactttcaaaagcttaagtcaaggagaggggcagcatttcaataaaatagttttagactagatttgttttttatataagtattctatatagttgcttttatttttaaatagaagattaaatatgtaagttatactaatacaaattattattaattgtgagaaatgagcaagatttcaataaaatattgaggtgctataaaagataacttgggacttctaggyaaacacaatagattaaacaactatttccttctcccttacctcctgaaatcactccaaagagtaaacagattttttttaaaggtgtgaatggacaaagacaaaatatagaaataaagcaacatcactaaaatctggaagctggaaagcagatggataatggtaactgatgtagaagacctgagaaaacaaaatcttaagcatccaatgggaaatacaggaaaacagcttgtttctatcacagaaatgccaaagggctcagtgagtggctatcccaggctcccctggaaataaagagctcaa

SEQ ID NO: 149802 - DNA, 601 bp, Human
taaataaaataacaaaaatcccaagtctgaaatgctccagtgagcatttcctttgagcatcatggtggtgctcaaaaagttttgaattttaaaacattttgagttttggattttcagattagggatgctcaacctgtataccactgcctaatgatctaaatttttcatagagtagaagtaattaatggggttgcactttcaaaagcttaagtcaaggagaggggcagcatttcaataaaatagttttagactagatttgttttttatataagtattctatatagttgcttttatttttaartagaagattaaatatgtaagttatactaatacaaattattattaattgtgagaaatgagcaagatttcaataaaatattgaggtgctataaaagataacttgggacttctaggtaaacacaatagattaaacaactatttccttctcccttacctcctgaaatcactccaaagagtaaacagattttttttaaaggtgtgaatggacaaagacaaaatatagaaataaagcaacatcactaaaatctggaagctggaaagcagatggataatggtaactgatgtagaagacctgagaaaa

SEQ ID NO: 149803 - DNA, 601 bp, Human; identical to SEQ ID NO: 24729

SEQ ID NO: 149804 - DNA, 601 bp, Human; identical to SEQ ID NO: 24730

SEQ ID NO: 149805 - DNA, 601 bp, Human; identical to SEQ ID NO: 24731

SEQ ID NO: 149806 - DNA, 601 bp, Human; identical to SEQ ID NO: 24732

SEQ ID NO: 149807 - DNA, 601 bp, Human; identical to SEQ ID NO: 24733

SEQ ID NO: 149808 - DNA, 601 bp, Human; identical to SEQ ID NO: 24734

SEQ ID NO: 149809 - DNA, 601 bp, Human; identical to SEQ ID NO: 24735

SEQ ID NO: 149810 - DNA, 601 bp, Human; identical to SEQ ID NO: 24736

SEQ ID NO: 149811 - DNA, 601 bp, Human; identical to SEQ ID NO: 24737

SEQ ID NO: 149812 - DNA, 601 bp, Human; identical to SEQ ID NO: 24738

SEQ ID NO: 149813 - DNA, 601 bp, Human; identical to SEQ ID NO: 24739

SEQ ID NO: 149814 - DNA, 601 bp, Human; identical to SEQ ID NO: 24740

SEQ ID NO: 149815 - DNA, 601 bp, Human; identical to SEQ ID NO: 24741

SEQ ID NO: 149816 - DNA, 601 bp, Human; identical to SEQ ID NO: 24742

SEQ ID NO: 149817 - DNA, 601 bp, Human; identical to SEQ ID NO: 24743

SEQ ID NO: 149818 - DNA, 601 bp, Human; identical to SEQ ID NO: 24744

SEQ ID NO: 149819 - DNA, 601 bp, Human; identical to SEQ ID NO: 24745

SEQ ID NO: 149820 - DNA, 601 bp, Human; identical to SEQ ID NO: 24746

SEQ ID NO: 149821 - DNA, 601 bp, Human
ttgaaattgtcaacagcctctaaaataatcactgaaatatatattaaaacatggtggatttcaagtttactaattctgtttaaaagtattgaacttacaggcctactgtatctaaagactggagaaaagaataaatataccctaaattctaaagaataaaatcaagaaatctgtcttcagaatttaaaaaaatgataagtcaaactaagctgaatttaaataagttttcttcttctaaagttattatgacttctaacctggatgagggtaacagccactgtagctgcaactatatataaawaaagaaaagatattcaattattagctcaaaagtgcgacattaagattctttgtttgtttgttttttgtttttttgagacagggtctcactctgttgcccaggttgaagtgtagtagtaacatgatcacggctcactgcagttttgacatctcgggtcctagtggtccccaagtggttgggaacacaggtgcatgccactaccacacccagttaatttttttttaactttttaaaataagagattgcatctccttatgttgcccaggctggtcttgaactcctgggctccagtgatctgca

SEQ ID NO: 149822 - DNA, 601 bp, Human
atgaaagacagctaaagtaaaggtaaaattcaatttaaacagccattctatttcacaacagttttatttcttaatgatatacaacttataacatcagtgctgtaatatttcatttcacacttgaagtcagtatttctttttctggaaaaaacataacttattctgtgtatagctaaataaacaagtgcaatggcagagcagtctttgacaacttttaagaaaagatgacagtgagccattgcatgaggttctactggacagtctacagtggggcagcttcaaagagggcaaagcatttttytttgcaacatgtgaatacacagttgaaagaaagcccaggttacgggtgcctctacacagtatgatatgctgtttcggatttgctggttttgtttattagaagtgacctacataatttaggctctttcccaaatgactcttacaactgctctcatagtaggtgagaggtgcacaagacaagcatttatatgtaagatgtttgaaattgtcaacagcctctaaaataatcactgaaatatatattaaaacatggtggatttcaagtttactaattctgtttaaaagtattgaacttacaggc

SEQ ID NO: 149823 - DNA, 601 bp, Human
ggtatttcaagggtaaaaaaaaaatgccgacggagagactgaaactgtagtgttagcataagctagaagctggtagtgataaaaatggtgaggagtagttaaaaataatttggtcagtaacatatatttgaaaacaggtcccacaagcataacatttaggaaacgacttctccccatccttgtcataaatcctctgcaaacgtcctgtgtgatctttccttcctgtccacaaactatcctctctgcatcagctcactcctgctctggtatcattctctagccccttgttggcttctgaagkctcctttgtgctcctgctctacctgttccacttttccatccatctcctcaatacccttttaaaataaaaccctcatgaaatgaaggtttaggtaacattctttattgtgctacacagtacaagagttgttttgatagaaatcacattaactataatagctaatggttcaaagagcctgagtcttaataggaatagctaataggtaaatttattgagcacttattatttggtgggtgctttacatttattgcttcatttaattgtcttaaagacctaatgagaaaggtactaacttttttt

SEQ ID NO: 149824 - DNA, 601 bp, Human
acagaaaaaaatctgtttcaggagcatgattaaaaattggtaccatgtgaaagagggtaagactgcctaactgatggaggtatttcaagggtaaaaaaaaaatgccgacggagagactgaaactgtagtgttagcataagctagaagctggtagtgataaaaatggtgaggagtagttaaaaataatttggtcagtaacatatatttgaaaacaggtcccacaagcataacatttaggaaacgacttctccccatccttgtcataaatcctctgcaaacgtcctgtgtgatctttccttcytgtccacaaactatcctctctgcatcagctcactcctgctctggtatcattctctagccccttgttggcttctgaaggctcctttgtgctcctgctctacctgttccacttttccatccatctcctcaatacccttttaaaataaaaccctcatgaaatgaaggtttaggtaacattctttattgtgctacacagtacaagagttgttttgatagaaatcacattaactataatagctaatggttcaaagagcctgagtcttaataggaatagctaataggtaaatttattgagcactta

SEQ ID NO: 149825 - DNA, 601 bp, Human
ttatttttttgaagcaattaatttgtatttctcaattatccagttactcacatttaaagagtgaatgtatctctctttcaacaaattttctattaggttattaagatgtaactcccaaatttagaactgtaattaacttgatgaaaaccaggaaaaagtaaggagtaaaattttttctttttaaagagtcacttgagggaatctatacatctctttttatttttcagtttagtgtcgaatagaccagatttagtttgaaaacacatcagtatgtagaaactgtcagaagctgcatctacaytgaacacatttttccagcttttttcctagttcatcttatataatttataattcatatgaagagactgagatggggacataagaagagggaaagttagaaaatgtaacagctatgaactctgaattcttttagtcataaggggattctcctgttctattaacagaatgttgcaaattgtctttagtttgtgctccagttattgcactgataattacatgaagttttgtttgctggcaaaaactattagtgtgccagatctgatgaaagaaaagaaaacttaaggcatttaaatatatttct

SEQ ID NO: 149826 - DNA, 601 bp, Human
gaggagcttttaagaaggcatccccaatatgtggcaatagaccctataattcaattctgatgggtatgatgtcctaaaatattactatgacacacccttattttatttatatgaaataagtttagtataatttttaatacaagtgttggggaggcaggcatctgttaagaaatgatactaagaaaaaacaatcatcatcatcattattatgaggtatttgcaggcttattttggattaaaagataggaaaatcaataatttttcactgattgagctttttttcactaggtctgaaagagawtccagatacttcttgattaacaagtataattcttctacagtatttaaagaaaaactcacaagtctggaaattctgtttgtggaggtggccaaaaaaagtgcatttagcagtggagactgcatcttccatctattctccaacttatggtttggaattcaccgaaaaattatttttttgaagcaattaatttgtatttctcaattatccagttactcacatttaaagagtgaatgtatctctctttcaacaaattttctattaggttattaagatgtaactcccaaatttagaactgtaatt

SEQ ID NO: 149827 - DNA, 601 bp, Human
atctacataagagatataatttgaatctgagaagaatcaaataaaccagattaatattttgggggcaaaaacatgtttactagttcaacaaagccaaatgtacctaagggaaaggtcaaaggatacttcattccctgctgagcaaatgctcaggaagcacatttgtctacattttcctgtcataacaggaagagtgtaacttcttcctttccacaatagcctaggttttacctcctaactccaatattttctcccccagggccttccaaatcaatccttgcaagacagaaggctgtctccsttatagtttccaaacagttacatttgttgaaatgttatttaaatgttagtgatttctttagttaaactgttccaatttaaaattaaaagtcaaatttccaaacatttagactggttctctaattcttattaatggtccaacatatttcaaaagaaacacaaatacacattacatattatcaatttttaatttttttccttaatgatgtcatttacttaattttttaaaatttttgccaaagccattatcctcagaaaaaataagtttccaaactaccttcaacaagaatacattgggatg

SEQ ID NO: 149828 - DNA, 601 bp, Human
cagtctgtcattagaaaggctcgcgagctttaggcccgatgattactctcggtgggaggaagcagtgcctctgcagacttgtgttctagacaagcgttcctttatacaatgacggggcctgccatcgtaaatgaaaggctctttaaagagcagcgagggactcttttaagcagactgctaccacgtgcttgtaaccctccagcataacttgcgaggatgagacagcagtgtgttctgccgcaaaggggactattgtcctcgttagcctcaagcaaattgagcctccgtttcgctgaaatayagtagtatttccaaaggattttcaagcagtagttcctaaaattctgaacatgataaaaggattaaaataaggggcttagagtgtggaatttagaactctaccaacccctcaccctaagtcaacatcccaaatcccaaaataaaactccaaatcttatgcattggagggaaaataataaatcacagttagatctaaattaaataatcgaatgcacattaatgaaacgagtgtttattaacaaactcataaaagtttgagttttaaaatttgtgacagctgaattctgatgcatttgtctgc

SEQ ID NO: 149829 - DNA, 601 bp, Human
ttcttcagttttattttgtttaattcagtctgtcattagaaaggctcgcgagctttaggcccgatgattactctcggtgggaggaagcagtgcctctgcagacttgtgttctagacaagcgttcctttatacaatgacggggcctgccatcgtaaatgaaaggctctttaaagagcagcgagggactcttttaagcagactgctaccacgtgcttgtaaccctccagcataacttgcgaggatgagacagcagtgtgttctgccgcaaaggggactattgtcctcgttagcctcaagcaarttgagcctccgtttcgctgaaatacagtagtatttccaaaggattttcaagcagtagttcctaaaattctgaacatgataaaaggattaaaataaggggcttagagtgtggaatttagaactctaccaacccctcaccctaagtcaacatcccaaatcccaaaataaaactccaaatcttatgcattggagggaaaataataaatcacagttagatctaaattaaataatcgaatgcacattaatgaaacgagtgtttattaacaaactcataaaagtttgagttttaaaatttgtgaca

SEQ ID NO: 149830 - DNA, 601 bp, Human
tttactacaatgtttagcttattagtgacacaaatcttaagataaagtaattacactatcttggaatttataataaagaaggtaaatgatgtctggagaaaaatatatatgtaaatatgctgtagacttcaagaaaaatatacttcaaaaaattcagagaaaagtttttttcttttttatcccttgcctggataaaaaagatgaaagacaaaaaagtctgaagataaaaatttaattttacaatcacaggatacagaaagaatggggaggatccatgggttcaggatgactgagtttgttagcaaaaatgtactgaactttctgatgagttcagattttcaaagaataagcatttggaaaagtgatgaaatcctcatgcacaatttgagactggatggtagtaatttagctgatttaaatatggctgatgaactataattaatgaggccgacttaattgatcaatgttaagtttatcaaaaagtctctagtaaagtgccatagaattcagtacttttcccatcccaggagacatttttgtcattggtttagatgggtatataggaaggcaggcttatcagatctgcatgcaacgtaaatct

SEQ ID NO: 149831 - DNA, 601 bp, Human
tataattttatgttagagtagatgcttttttacttgccttttaaataatttaatctctcaaaaatagagattttggacacatatacctttattttactacaatgtttagcttattagtgacacaaatcttaagataaagtaattacactatcttggaatttataataaagaaggtaaatgatgtctggagaaaaatatatatgtaaatatgctgtagacttcaagaaaaatatacttcaaaaaattcagagaaaagtttttttcttttttatcccttgcctggataaaaaagatgaaagayaaaaaagtctgaagataaaaatttaattttacaatcacaggatacagaaagaatggggaggatccatgggttcaggatgactgagtttgttcgcaaaaatgtactgaactttctgatgagttcagattttcaaagaataagcatttggaaaagtgatgaaatcctcatgcacaatttgagactggatggtagtaatttagctgatttaaatatggctgatgaactataattaatgaggccgacttaattgatcaatgttaagtttatcaaaaagtctctagtaaagtgccatagaattca

SEQ ID NO: 149832 - DNA, 601 bp, Human
tttaatcagacttcatgaccacaagctatatgtggaatgtctcaatacagtatggtttctgttgtactcagacctcagaattttgcacgttacaacactcataatcaaagtacatttcagtacagaaatatcattaatgtcactatttgtgtttacttttagtgctcctcaatttttgtgtaaccaaataggctgctggataatgaatacttatttaataatacccatcaaagaagtcagtgcatatagcttcttctgcaatttaaaactgcaaactgaaatgatgactgtattaaagcaygtaagaaaatatcttcaaaatctactcttaattgctctaaatttaattctgcattatgttcatattcttcatagcattctcaaaatgtattttataatgctttttctcattgttcatagttagataaaattatttttaagcattaggctttctaaagagatctggaatataactcttcatttaaaatatgccactcaataacaaagatttcaattctgcgcttttatacttaaataatgccttgtgatggttacatttttcttaacttgataatagtttgtaatggggacaagtccatat

SEQ ID NO: 149833 - DNA, 601 bp, Human
tacagaatacgttcaatacagaaggcactgacctagactactttcatatatctaaaaccacttttaatcagacttcatgaccacaagctatatgtggaatgtctcaatacagtatggtttctgttgtactcagacctcagaattttgcacgttacaacactcataatcaaagtacatttcagtacagaaatatcattaatgtcactatttgtgtttacttttagtgctcctcaatttttgtgtaaccaaataggctgctggataatgaatacttatttaataatacccatcaaagaagtcrgtgcatatagcttcttctgcaatttaaaactgcaaactgaaatgatgactgtattaaagcacgtaagaaaatatcttcaaaatctactcttaattgctctaaatttaattctgcattatgttcatattcttcatagcattctcaaaatgtattttataatgctttttctcattgttcatagttagataaaattatttttaagcattaggctttctaaagagatctggaatataactcttcatttaaaatatgccactcaataacaaagatttcaattctgcgcttttatacttaaataat

SEQ ID NO: 149834 - DNA, 601 bp, Human
tacactattttatcatatgacattgaaggtagtatggtagaaagcaaagaacatagggtttgtatttagagaactctgaatttgaatgccgaatttgctagtcatgcgaaattcacttaacaacttctcttttgtttgtttgttttttgagacagggtctccccgtctcctaggctggagtgtagcggtactagaatagctaactgcagcctccactttccagggtcaaaccatcctcccgcctcaacctccggagtagctggtactacaggcgtgcaccaacatgttctggctttatctytgtttgtatttatttttactagaaacgaggtttccctatgttacccaggctgttctcaaacttctgagctcaagcgatcctcccgcttaagcctttcaaagtgctaggattacaggcataagccaccgtgcctcgcctcactttaaataaagttctttgagtttgatttttcacatttgtaaaacagagatttatacctactcttaaggctgttgtgaggattgtatccaataatgtgtgtatagtattgagtataatgcttagagtaggtgctcaataaatattagttcccccaaattt

SEQ ID NO: 149835 - DNA, 601 bp, Human
tgcaaaatatattttgtatataaaatatgcaaaataaaaaatacaaaactgtttatattttcctgtgtgatctgtttaacctctcttccactacagcgcatgctccacaagggtatatgccgtttttattttgctcactactttatccccagtgcttagaccagtagacatgtgtgggcacatggtaaaaatccatggtataaaaattgataggggaagctactatgtgaaatcttcagaaagatacaattgatgtatgtatatatgtgataaattttcccatgaaatttttttaacaacycatatgcaaaatgttttaacaatacatatattccttacttaataataattacactattttatcatatgacattgaaggtagtatggtagaaagcaaagaacatagggtttgtatttagagaactctgaatttgaatgccgaatttgctagtcatgcgaaattcacttaacaacttctcttttgtttgtttgttttttgagacagggtctccccgtctcctaggctggagtgtagcggtactagaatagctaactgcagcctccactttccagggtcaaaccatcctcccgcctcaacctc

SEQ ID NO: 149836 - DNA, 601 bp, Human
tcttttcattctgagaaagcaggcacaatctagggaagccagagtagacaaatagattaagaaaataggcagatgggaaccatccttattatacctcttcctttgttttgtagtcttaatcattgctcatgaagggtactacaaagtatttaaataggatcgatgctgaaaaggtttaaaatgttccagccaatgtaactaacctgcacaatgtgcacatgtaccctaaaacttaatgtataataaaaataaaataaaataaaataaaatgggaaaaaaaatgttccagccaaaactgtayggtatgttacttatgctaacacatctaaaacatttttgactttcagcatcatgcttatttattttgggcacaataaaacaattttttaaatctgacattgattaaacactgagctaacatttagaaattcattttcatctgatttctgattccatgtatattaacagttttcattgatatatataatgatataatttttaggaaaaaacatttctaggagaataattgcctttactcttccagcaagaaagcattcagaataatgagttacaaagaagagacataaatcgaaaaactgaa

SEQ ID NO: 149837 - DNA, 601 bp, Human
ttaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttgagacggagtctcaccctgtcgcctgcgccagagtgcagtggcgcgatctcggcttgctgcaagctctccctcccgtgttcaggccattctcctgyctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgcaacttccaatccagattccctcttcaccaagtgtctcaagtatcctaatttcagtgatgcagcactttgaaaaatattccatgtgaagatgatgta

SEQ ID NO: 149838 - DNA, 601 bp, Human
gtaatggtccaaatgggaaatataaaactaatgacccttcatgaaacatattatgctcctcattaaacttattcagttaaatgtattccattaaattaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttragacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgca

SEQ ID NO: 149839 - DNA, 601 bp, Human
ggtaatggtccaaatgggaaatataaaactaatgacccttcatgaaacatattatgctcctcattaaacttattcagttaaatgtattccattaaattaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttgagacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgc

SEQ ID NO: 149840 - DNA, 601 bp, Human
ttgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacagagagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatggagg

SEQ ID NO: 149841 - DNA, 601 bp, Human
attgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacagasagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatggag

SEQ ID NO: 149842 - DNA, 601 bp, Human
ccattgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacasagagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatgg

SEQ ID NO: 149843 - DNA, 601 bp, Human
ctggtcctggacttcttttggttggtagcctattaattactgcctcaatttcagcacttgttattggtctattcagtatttgacttcttcctggttttgtcttgggagggtgtgtgtgtccaggaatttattcatttcttttagattttctagtttatttgcatagaggtgtttatagtattctttaatggtagtttgtatttctgtgtgatcagtggtaatatcttctttatcattttttactgcatctgattcttctctctcttcttttttattaagtctggctagcagtctattttgytaatcttttcaaaaaatcagctcctagattcactgattttttgaagggtttttcgtgtctctatctccttcagttcggctcttagttatttcttgtcttctgccagcttttgtttgttcttgcttctctagttcttttaattgtgatgttagggtgtcaattttagatctttctcactttgtcctgtaggcattcagtgctataaattcacctcctctaaacactgctttagttgtgtctctgagattctggtacactatgtctttgttctcattggtttcaaagaacttacttatttct

SEQ ID NO: 149844 - DNA, 601 bp, Human
acatcacacttcctgaatgtctggacttggactcagcatcttccttaactgtgtgctccaggcagccagtacaaagtgatgggcacacactaaggagtgaaatgtgccagagtcccacctcactgggtagtgatgtgccttttatgaatgtatcacacttccagaaaaacctaagacacttcctttcaagaattagtttcacagaatttcagttgtaagaacctgttttatagcatgattctaaccctccataaaattacaaagaggaaatagtctacagacacacttccaaattccatgmagaaggaaatacatgtttggaaaaggaaatctagatcctttctactccagcagcatcagcatcacctggtcagaaataaagggatcctgggccctgccctatacccactgagttagaatcagcattttagcaagatactctggtgattcacactgggccacaggcatttcatttgacccaatactggccaaagcactaacaggtttcttctctcttctccagtaatcaaaatactgtaccttggtctggaagtcctttcctttccaccagcaccacaagcaatacttttacttggtttcc

SEQ ID NO: 149845 - DNA, 601 bp, Human
ccctaaccaatcacatcacacttcctgaatgtctggacttggactcagcatcttccttaactgtgtgctccaggcagccagtacaaagtgatgggcacacactaaggagtgaaatgtgccagagtcccacctcactgggtagtgatgtgccttttatgaatgtatcacacttccagaaaaacctaagacacttcctttcaagaattagtttcacagaatttcagttgtaagaacctgttttatagcatgattctaaccctccataaaattacaaagaggaaatagtctacagacacacttycaaattccatgaagaaggaaatacatgtttggaaaaggaaatctagatcctttctactccagcagcatcagcatcacctggtcagaaataaagggatcctgggccctgccctatacccactgagttagaatcagcattttagcaagatactctggtgattcacactgggccacaggcatttcatttgacccaatactggccaaagcactaacaggtttcttctctcttctccagtaatcaaaatactgtaccttggtctggaagtcctttcctttccaccagcaccacaagcaatacttt

SEQ ID NO: 149846 - DNA, 601 bp, Human
gtctctgtatgttgcccaggctggtcttgaactcctaggctcaagtaatcctcctgtctcagcctcccaaagtgctgggattacaggtgtgagccaccatgcctgctataactatttttttttttaatgtgaggaaaaaacccaaacacccattgtgtagttttactgtttacaacgtttcttaccctagaacagtagctctaaatagttattcagtttatttactaaaacataaagataagagatttaattgatatgaagaggttttcagaatctaattaaccttccagctagtcattawctctatgacctttagaaataattgacagagaattttttttcttattcataacttcttccaggtggttaaatttcagagtagtgcagaatacactaaacaccattgagacatgactggataatatgccaaatagctataaaatggggtatatttccaataatataatctatttacttaatctgttgtacacatatgcagcatttacctaattacagtccttttaatgactgactttgattaagtcttttcccagaatgtcctattgattattttgaccaagaaaataatgaaaaagttatg

SEQ ID NO: 149847 - DNA, 601 bp, Human
gcttcagtgatccctccattttctcgtctttctccacaaaatcacatagactttaacaaatattctgttccttggagtaaatgccaactgagtgattcaactttcctggttggatttctctgccctggctcaggtcctgactgacgcacagtgggcatgtcataaatgcctgctgcaggaatggaaggtgaagtagccaggtgcaacctctccagtttacatatcctttattgggctgtatctattaaccatcatgccagtttgtttgtttgtttatttatttatttatttatttatttawttatttatttagagactgtgtctcgctctgtcacccaggctggagtgctggagtgcagtggcacaatctcagtttactgcaacctccgcctcccgggctcaagcaattctcctgcttcatcctcccgagtagctgggattacaagcgtgtgccatcacgcctggctaattttttttttttttgtatttttagtagagatgaggtttcaccatgtaggccaggctggtcttgaactcctgacttcaaatgatccgcctgcctcggcctcccaaagtgctgggattacaggcatgagccacc

SEQ ID NO: 149848 - DNA, 601 bp, Human
ttacaacctatgaggaaaaaaaaaaaagtatcctggggctaaaatgtttattggcacctagaagtctgaagagagagtcgggcctgtggttttttgagggcactttatcatcgcccgcattctcaaaggtttctctgaatgaatagaactggattactcagccttctattccacgcctattcctctccattttccttggcacgactgagagccaggctatttttagttaagcagttttctatttttagacaactaccagttagaagacatttgttagggaaaaattaaaaaaaaagcacacacacacaaagggaggagggaaagaagcttcctccacatattgtgaagcagccttcaacctgtaactccaggcatttcagctgctttcaatcttggaaaaataaagaaaaattcagagttcagggttttaaaaataaacctaccctctggcaaacagaccaaaatacaacaagctgttactatgtgaaacagtgactacaaaaacaaagaacattctccaatgattaaactgcgagaaaagttgaagaactgattaggttgtaagaatgttgcacaggcatgtaacaattttccagcctct

SEQ ID NO: 149849 - DNA, 601 bp, Human
agaaatgctatttttcaaagtagtttctacatcattttaaagattaaaagtaaaaatctgcttgagtgaaaataataattttaagaaagagactaaatgttggcatgttaaggggatacagactgaacaagagaatttcatgtctcagggagctaaactaaaatgagtcagctgctctcttaaggtacaatgagtcacaggaataattttcttgctgtgaaactccttaaagttttgagtttaattgcaagcagtaagtggtttttattataacagagtttcctctgttaattattacacracgtacattattttacaatactttcatttaagattctcttttaaaatacatcttacaaatatgaatttttaagaccttaggaaagttagttatttatggcagtttgtcaggttccctgaaacaaagccttgtctttcagaaaatgtttacaacctatgaggaaaaaaaaaaaagtatcctggggctaaaatgtttattggcacctagaagtctgaagagagagtcgggcctgtggttttttgagggcactttatcatcgcccgcattctcaaaggtttctctgaatgaatagaactggat

SEQ ID NO: 149850 - DNA, 601 bp, Human
ataaataccagttgtatgagcatcatgtgctaatggctatatatgtacataagttaattcttacaggaagaccaaaagtgagttttattatcccttttttactgcttcagaagctgaagcttggtggaaattcagaatgttgcccaagatcacagagtttatgaaagtggcagaaaccaggtttgtctgacgctaaaatgtgtgtctgtccctcctccagcaccacactgtcttttttatgaaagggcagggcttttattatatggatgtgaaagtgtaaggggagagttttcatatttgrcagtattgtattcagaatcctgacctgtttaggtgatcattaaaagtgcacatgtcctggctgggtgtggtggctcacacctgtaatctcagcactttgggaagccgaggcaagcggaccacttgaggtcaggagttcaagacccagcctggccaacatggtgaaaccccgtatctactaaaaatacaaaaattagccaggtgtggtggcacatgcctgtagtcccagctactcgggagactgaggcaggagaattgcttgagcccaggaggtggaggttgcagtgagccgagatcgtgc

SEQ ID NO: 149851 - DNA, 601 bp, Human
atttctgaagaatttcatcacgttattacacaagaaatatacatacattatatgataatttataaaatgtgacattttatttaaatgtaagcaccaaatacactgaagatttcagtgtccaaagtatgcgtgtgtatatacaagtgaaagtttaaaatttttgcctaaatttacatatgcaaaaaggaacagcaggaaaataaataccagttgtatgagcatcatgtgctaatggctatatatgtacataagttaattcttacaggaagaccaaaagtgagttttattatcccttttttaytgcttcagaagctgaagcttggtggaaattcagaatgttgcccaagatcacagagtttatgaaagtggcagaaaccaggtttgtctgacgctaaaatgtgtgtctgtccctcctccagcaccacactgtcttttttatgaaagggcagggcttttattatatggatgtgaaagtgtaaggggagagttttcatatttgacagtattgtattcagaatcctgacctgtttaggtgatcattaaaagtgcacatgtcctggctgggtgtggtggctcacacctgtaatctcagcactttggg

SEQ ID NO: 149852 - DNA, 601 bp, Human
actatcgactaattgtcaaaggaatccagtctataccgagatgaatgaagcatgaggttaaggcaggtggctgggagaagttagaaactctccctccccgattgcattacattattgtcgaagccaagcagatagatagaaatcaatgaaagttttgttgatctgacacaggaacttgtgcacagtgaaatggaagctatgtattttgtgctggaaactgccagtctcacattaactgcatgtatatgtgaatatatgtaggtttgtgtaggtttgtgtgtgtgtgtgtgtgtgtgtgtggacagcatgaagcagaacatctgaaagaatcttcagaattatttctcgttagatgtacttttgggtagattttatctttttcccccagaaagtaatatttcaatatagaaatttaggcctcagcaaagtgaggtttttttttttttttatgttacaatgcttgcaaacttaatggtggtttctaatggaaaacaaatttcttcccctaatcataatataagaatttgcaggccaggcacagtgtctcatgtctcacgcctataatcccagcactttgggaggccaaggcgggtgggtcact

SEQ ID NO: 149853 - DNA, 601 bp, Human
aataaaataaatgacttaaacttcccaattttttcaacagttacaaggaagacacagtaagatgtgatcttctaaagtgaaaatttcccaaagtaccaaggaaaaggagaaactgcagaagagcttcaagaaccacaaacacttgggttttgcatcttgccagaaaatctgcactgttggtagaagcctggggtagggctggcaggacctgactcagcggagaaaatgccacccacagtcactgactctgcttccgcagtagcggagctcccctgttttctctggaggtttcccacagccrggccaatacccatgtctctcagatgggaaactggacttttggaaaattgaaactaaataaagttgtataacttttaaaagaagtttacaattatgatgctttgcttttcacatgcgcttaaagtccattttctgttgaataaataatattaaccacatattaaccacctaatagttttaaaatgtctcaaacagccatcaccatcattctgaacagaatcacacttctttttaaaagatcactgttaaaagatgaggggaaacagtaccattaaaaggaagcaaaacatagttcaaagtc

SEQ ID NO: 149854 - DNA, 601 bp, Human
tttgttagttcagtgatgagcttaagggtatcatttgcaaaatcatttcttccagattcttcattaggtaattataaaaacaacatttcctcttctatggcatgaagaggaaattaaaccagtcttccatcactatcaaaatattaattttcttaatattttaattgaatccattcctcagcaataacacctaccatttaccaagcatgtacatgtgccagggactgagcccgtggctttgcatgggtctttttttaatcctcacaagctactcttccacaatgactgccaatctacagawgaaaaaaagaggcacacagtggcccaagaacttgctgaagtttacaaagttagtgagtggtggaaccaagtctatgaacccatgaatgagctccagaattttctctcttagctatcaaattattctgcgtctgcaaggttgtttaacaataaggattgcctaaaccatgcctgtgtatctgtgtatcctttgaacacttactctcagctgaaattggtgaaatgactgacaaatcttattttttcataaagggatgtgtttgtaacggaattcattttctgataaaaaatattatctaaa

SEQ ID NO: 149855 - DNA, 601 bp, Human
atggaagggtatagagagtatttttgtgtgtgtgatttatatacattttatttttttatctcattttgttccattgactaggccctcagtatgacttaaagcagagatgggagcatatttatctcatttataactttaaaaggaatgagccaaatgtttcaccattatacacttactatgaaccctttttgttgatatatttcataaacttaaggaaatttctattcctagtccattaagaatttttattaatagaaactgaatttcatcaaatgcctcttctacttttattttgatgatsctttggtgttcataaaattgttaagataaatttcattaatcaatttgttaactgttatgatgaacttttccccataattaaaaaaattattagtaatattattttaaattgacaaacaatacttgtatatatttatatggtataatgtgccattttgttatgtgtatacaatgtggcatgattaaatctaactaattaacatatctatcacctctcttattttttatggtgagacatttgaaatttattctcttagttattttgaaatataaatacattattattgaccatagccaccct

SEQ ID NO: 149856 - DNA, 601 bp, Human
gcatttcagagttagggtcctctgctcaactttccactgggacttgcctgctagtttcctggctcatttgttattgggggttgctgtgcctggactcacattgcagttcctgctgttttatggtattaatgtgaaggatcctttttcactagtgtaggcaattatgaattgagtgtaattgctcggagaggacacgagtcatgaataaatacaatctgaaaattcctaacatacattgcattatggcaaatagatccttctttctaggttaaatacttacaaataaaatataattcataaraaatattttgcaaagtgtactattactgatactgcatgctaatcaaggcctatatagactaagttactttattatcaggttaatttttttcaaaatttatgtttccaaattaaattaataattaaaatcaaattcatctcaatttattttccttattctctgaatgctatccatatatgaatcgacagtccagaatcatggaccaattattacttcacaaaatctcatttcccatgactgcatatattatgcagatgataatattcttaggtgtgcattgtcaccttggatttcacatga

SEQ ID NO: 149857 - DNA, 601 bp, Human
aaataattgtttcttttctgcaaataagtttctacctcttttttttttttttctcgctctgtcgcccaggctggagtgcagtggggcgatctcggctcactgcaagctccgccttccaggttcaggccattctcccgcctcagcttcccgagtagctgggactacaggcgcccgccaccacgccaggttaattttttgtatttttagtagagacggggtttcaccgtgttagccagcatggtctcgatctcctgacctcgtgatctgcccgcctcggcctcccaaagtaagtttctacctyttatctctcctgtcacattatagattacttgtagagatggagagaattgaatccatttatcctctgtagctgttatctcattaccactcacctaatatgtgaatttataataagtggtggattttacgttcagttgacttgggtaggtgtctgatgaaagaaagtttgataggactgtttgataagagcttcaggtgcttaaaaataaatgtgcttcaaaattctgaggcagtttctcaaggcttctgctgcaaacacactgacatcattccagtggctttctttatttaaactcgtctt

SEQ ID NO: 149858 - DNA, 601 bp, Human
agcataaggacaggaaaccaggatgtactctctagtgaacaagaggcagaaaggccgactggaagtcagagatctggggaaaaggctccttgcaggttcaacagttgacctggaggtagaagttgttagagtttcaggatgttgtcaaatggtcagagaacaaacctctatctaccaacaactacatcatgcattaagaaagtctcacagactaaatctccaaaactcacagcagtaaacttaaaatgcaaataattgtttcttttctgcaaataagtttctacctcttttttttttttttctcgctctgtcgcccaggctggagtgcagtggggcgatctcggctcactgcaagctccgccttccaggttcaggccattctcccgcctcagcttcccgagtagctgggactacaggcgcccgccaccacgccaggttaattttttgtatttttagtagagacggggtttcaccgtgttagccagcatggtctcgatctcctgacctcgtgatctgcccgcctcggcctcccaaagtaagtttctaccttttatctctcctgtcacattatagattacttgtagagatggagagaattgaa

SEQ ID NO: 149859 - DNA, 601 bp, Human
tatataatgaacagttatttcatattgttgctatctgttttctgcttttatatcattttctagattataagattcttgcagacaggaagtctcctgacgactttccatccttggcaactagtaggatatctgacagtagaatgttgctacaaattggttaacttttctggataggtgtcctacaggggactaatggtaaggacagcctgatgatatacaatggagaggctcaggcagactaagcaaaagctagtggctaggaatccaaatgttcccccttgaaaaccaaacctctctcgckttttagtcaggtttgccaggtctgtaaaaggtgagcagtcttggtctctagtcttacttgtatattacttctccctttccatgtaaaatctctcctgggacttggctaatgcaatattagtgttttcactgtattggttcatatactggcaaaccttctgcttaacagaggcagtgaaaggtataatgggtagatggttgctggtcaggggacagttgctgatccagggccagttaagccagcagacagacatcctggggtttcatcagacttagcataaggacaggaaaccaggatgta

SEQ ID NO: 149860 - DNA, 601 bp, Human
cactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaagtgatcttcccacttcagtctcccaagtagctggaattacaggtgtgtgccatcaagtctggctaatttttgtaktttttggtagagatggggtctcacaatgttgtccaggctggtcttgaactcttgacctcatgtaatccacccacctaagcctcctaaagtgctaggattatgggcatgggccactgtgtccagcctatcctaataatctttataatgcaagttaagaaaagaaaggctggaatgcaaagaatcaagttgtaggttgttttgaagaatgggcaatgttagtgatttcttaaatgaggaaggaaaagacaagacagaactataaattaaacaaaggttgagagaggaaaggagtaaattaat

SEQ ID NO: 149861 - DNA, 601 bp, Human
gctgtaaaacactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaagtgatcttcccacttcagtctcccaagtagctggaattacaggtgtgtgccatcaagtctggctartttttgtagtttttggtagagatggggtctcacaatgttgtccaggctggtcttgaactcttgacctcatgtaatccacccacctaagcctcctaaagtgctaggattatgggcatgggccactgtgtccagcctatcctaataatctttataatgcaagttaagaaaagaaaggctggaatgcaaagaatcaagttgtaggttgttttgaagaatgggcaatgttagtgatttcttaaatgaggaaggaaaagacaagacagaactataaattaaacaaaggttgagagaggaaaggag

SEQ ID NO: 149862 - DNA, 601 bp, Human
ttgtaggaaagagcacagggaaatttgtgaatgtgagtcagatactataaatctgaattaagcatgctttcaaattcttgggcaaagttcatcattttcccccattcttggatgctagtctactgctccactattctcctgggcttttacattggtcttattctgggccaacatttgcctgagggaattcatggaaaatcagggtgattctggggccaatcagatgattcaggcttcctcaggacagatcaaggatttggtgtttgtaaggattcttccgccaaacctctattggaacccrgacagggcatgcatcatgagttggcctagaatgggactgagatggggaagtctggcacacgttagctgtaaaacactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaag

SEQ ID NO: 149863 - DNA, 601 bp, Human
tcaaatgttagagggaggaagattagtctcagtgcagtattttgcaactgcaatctcttttttttccatttattactaccatttcacactacgttaaaactcaatgtttttattccctcttaataactcccaaatttactactttttgaaatgtacagtttttaagttagaaagcagtgcaatgtaggtgtgatttgtactatgtatgaaacattataactcacaaattttacattattgaacgcttaaaatttaggggtactagtctaaatagacaccctcagaaaaactgagcagtcartgaaatcttttaatgccagaaagtcataagcatataatctcagtgatcaaaagtgtagctgaaagagggcacagaattttcagcatggaaagagaaaaaagggagtgatattttaggcagaaggtaaaggttagcaaaggaaaaacaaaacctttgtaggaaagagcacagggaaatttgtgaatgtgagtcagatactataaatctgaattaagcatgctttcaaattcttgggcaaagttcatcattttcccccattcttggatgctagtctactgctccactattctcctgggcttt

SEQ ID NO: 149864 - DNA, 601 bp, Human
tggatgagaccgccaagcatcatccggcccttcctcatgcccacagtgggtgaggaataatggtgcaaacgctgcatgcctttccttctgcatcccttctcaagctgggctctccttcaggaatgagcccaccaatatctgttcctccttcaaagagcagctgacacattgtctcctctctttagactttctgatcgctcaggctgaatcagtttctccttcattcaggcactcattttattctacacattttcccactatagtcttaatcatacattattgatcctttatgtgctttttyccctctgctagattgagaggtccttaacaaagcactttgctttattcactttggagtttcaccagagagcagtctgacctactgtagttgctcaataaatgctagatgaatgaatggaacacacatttccacttcaatgttaatgtatgtggaggtttcttgacttgaccaaggctgtctggctggctggaggcaaaggctgtagtagggtccagaccccttgatacatatttactaactgctactatatgtcaggtgctgccagtggtcctctggatgctaagatgatttttctggaca

SEQ ID NO: 149865 - DNA, 601 bp, Human
aatttgagacaggattttgctctgtcgcccaggctggagtatagtggagtgatcttggctcactacaacctctgccttctgggttcaagtgattctcctgcctcagcctcctgagtggctgggtacatcaccatgcccagctaatttctgtatatttagtagggaatgggtttctccatgttggccaggttggtctcaaattccttgcctcatgtgatctgcctgcctcagcctcccaaagtgctgggattacaggctgagccaccacaacctggcctgctttattattattatttttttttactaacggttgtcaacttaattgtatacaattcgatttacagagataatgttatgtttttagagatcataaaacttctgattaatcatagtttgtcatgttaattattaatagactagcaacatttctgaattttcctggtaccaccaagatccgttataaagagatgcatacctaagtgtctctcattaatggaaagttcagcagagctcatctttattaaagacagaattcacatacaaataaagcaaaagctgtgacatcaagctaaggaattcaaagctgagataacaccccatc

SEQ ID NO: 149866 - DNA, 601 bp, Human
actgaaaacaggtaaccaagtcaataactaccaaactagcaagggttcctcctagtttttcagctgagtaggaatcaccctgagactgacacatgaaagtaaaaagtcagtgcctcatcttgaacctcctgtctcctggatgtgggtctggtctagtctcagctgtcacagaagaataaatactaatgtaacattgtaacagaaaaagtataagttaggagtcttgagttttacttggttttttaaatttgagacaggattttgctctgtcgcccaggctggagtatagtggagtgatctyggctcactacaacctctgccttctgggttcaagtgattctcctgcctcagcctcctgagtggctgggtacatcaccatgcccagctaatttctgtatatttagtagggaatgggtttctccatgttggccaggttggtctcaaattccttgcctcatgtgatctgcctgcctcagcctcccaaagtgctgggattacaggctgagccaccacaacctggcctgctttattattattatttttttttactaacggttgtcaacttaattgtatacaattcgatttacagagataatgttat

SEQ ID NO: 149867 - DNA, 601 bp, Human
tgtccccacagcctccacttctgatgtacttgacagctaaagggtgtaagagaacacagctaatatccccaccaagcatcggtgaagaatgctcagacgctgtgcttatatggagaactacttttgtttgttagggttctatatatgtgaaaatcttatcaaaatttataatactgagaaggtctcttcctaaacacaggtggaaagaaaagtgaaaacagctgagctgagtaaggaagacgaagaacactgaaaacaggtaaccaagtcaataactaccaaactagcaagggttcctccyagtttttcagctgagtaggaatcaccctgagactgacacatgaaagtaaaaagtcagtgcctcatcttgaacctcctgtctcctggatgtgggtctggtctagtctcagctgtcacagaagaataaatactaatgtaacattgtaacagaaaaagtataagttaggagtcttgagttttacttggttttttaaatttgagacaggattttgctctgtcgcccaggctggagtatagtggagtgatcttggctcactacaacctctgccttctgggttcaagtgattctcctgcctcagcc

SEQ ID NO: 149868 - DNA, 601 bp, Human
gcccactatgaatgtgcgcatataatagtcagttttatgaaacccttaagaatttacagcacttagctttccttcatgatacagtgtattaataattctgattcaacaaaagttctactgctgacatttcatttaacaaaagaagcagataggtatttataaggatagaaattttaatatgcacacattttgtaaataagttttaaagtgttcaatttaattcaattcaggtttgagtgtgcagctactatggtaaagtattaatttatcttgtgagtgcagttgtgaatttggcctcgarctttgtccccacatatctgcacttgtaatcaccaaaacatattttcacttcagtctctctcatttctcaggtttaggctgttttgctaacttacaaaaaatgaacttttttcaaaaggaactgattgcctactgaggagcttgtatacaattaaggttcagacactaacattagttatttagaaggtatgtgagccttgggtttcacccctttaagccacaaaattaacattatttgattgatgacagaatctaataaaaagtatgtactttcctcctatatatgtggacaacaaaataa

SEQ ID NO: 149869 - DNA, 601 bp, Human
cctgggaagcagaggttgcggtgagtggagatcgtgccattgcactccagcctgggcaacaagagtgaaactccgtctcaaaaataaaaataaataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgcgcatataatagtcagttttatgaaacccttaagaatttayagcacttagctttccttcatgatacagtgtattaataattctgattcaacaaaagttctactgctgacatttcatttaacaaaagaagcagataggtatttataaggatagaaattttaatatgcacacattttgtaaataagttttaaagtgttcaatttaattcaattcaggtttgagtgtgcagctactatggtaaagtattaatttatcttgtgagtgcagttgtgaatttggcctcgaactttgtccccacatatctgcacttgtaatcaccaaaacatattttcacttcagtct

SEQ ID NO: 149870 - DNA, 601 bp, Human
caaatggcgtggcgcagtggctcacgcctgtaatcccagcaccttgggaggcccaggcgggtggatcacctaaggtcaggagtttgagaccagcctgaccaacatggagaaattccatctctgctaaaaatacaaaattagccgggagtggtggcacatgcttgtaatcctagctattcgggaggctgaggcaggagaattgcttgaacctgggaagcagaggttgcggtgagtggagatcgtgccattgcactccagcctgggcaacaagagtgaaactccgtctcaaaaataaaaatarataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgcgcatataatagtcagttttatgaaacccttaagaatttacagcacttagctttccttcatgatacagtgtattaataattctgattcaacaaaagttctactgctgacatttcatttaacaaaagaagcaga

SEQ ID NO: 149871 - DNA, 601 bp, Human
cctacacttacaaaccttaatgcacagctgctccacaccaatgtattatatagcaagataaactcagatcataagaactaaaaattggcccaaatggcgtggcgcagtggctcacgcctgtaatcccagcaccttgggaggcccaggcgggtggatcacctaaggtcaggagtttgagaccagcctgaccaacatggagaaattccatctctgctaaaaatacaaaattagccgggagtggtggcacatgcttgtaatcctagctattcgggaggctgaggcaggagaattgcttgaaccygggaagcagaggttgcggtgagtggagatcgtgccattgcactccagcctgggcaacaagagtgaaactccgtctcaaaaataaaaataaataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgcgcatataatagtcagttttatgaaacccttaagaatttacag

SEQ ID NO: 149872 - DNA, 601 bp, Human
atcagcagtactgcatacatctgtctttattccaactgtgcaggggattcttactatctgacacacctaaggtactccgccttaacatcctacacttacaaaccttaatgcacagctgctccacaccaatgtattatatagcaagataaactcagatcataagaactaaaaattggcccaaatggcgtggcgcagtggctcacgcctgtaatcccagcaccttgggaggcccaggcgggtggatcacctaaggtcaggagtttgagaccagcctgaccaacatggagaaattccatctctrctaaaaatacaaaattagccgggagtggtggcacatgcttgtaatcctagctattcgggaggctgaggcaggagaattgcttgaacctgggaagcagaggttgcggtgagtggagatcgtgccattgcactccagcctgggcaacaagagtgaaactccgtctcaaaaataaaaataaataaataaaaataaaaattggcccaaatgagccgcttctttttttcttctaggcaaaataaaataccaatggatattttattatttaataattctggacataacaagtatgcatggctacat

SEQ ID NO: 149873 - DNA, 601 bp, Human
aactttcaacaaaattgacttccagcaactcagagcgatgtgcaaaaactgggcttttcatcgtgaagactgaagcacttactaaagagatggagactctgtggcatagctcggagctgggtggctccttctcacagctctgcccgtaaactctaatgtggtttttcagcccctaccacacaccactgcaccccttaagaaatcacgtatcttgatcttgaactctttacgtaacaggctgaaatcctgtgagggaatacaggtgtgtattacatgtctctctccctaaagtatgagaaamaagatccaatgtgcattcttccagaactttaggggttaaaactccacctatatgatcgcttccattgagtgatcagcagtactgcatacatctgtctttattccaactgtgcaggggattcttactatctgacacacctaaggtactccgccttaacatcctacacttacaaaccttaatgcacagctgctccacaccaatgtattatatagcaagataaactcagatcataagaactaaaaattggcccaaatggcgtggcgcagtggctcacgcctgtaatcccagcaccttgggagg

SEQ ID NO: 149874 - DNA, 601 bp, Human
tttagagtttgccatctgtttcctgctgcaaccttgggccataatagtaactctctagatctagaacactggtactctacaggggtgggactgtctccttagggagcattttggaaatctgttggactatctttgggtatcaaaatgactggagggtgtgactattacactggctcaagcagtgccatctcttgcctagataactgcagtcacgtcctaacagatttacctgctccggtccttgccatcctttatattttcaaaccagaaattagattgaccctttaaaagcttaagtcatgccaacactcctctgctcaaaaccctgtgagggctctcatcttagaataaaaactcaagatgagaatttttttcttccaagggtccacaggccctattaagctctagcttttgccaacctccgttatctcatcgcctaacaccttctgcctccctgcctcatttccatgacgaactgcatcacctccttcaagtctctgctcaaaatctggccttctcttggaagcccacgctgaccaccctatttaatcctgcaatttgtcctgccccttgcccatatcctgatctctttctcctgctc

SEQ ID NO: 149875 - DNA, 601 bp, Human
aacactatgcttcatattttggtgtgtaccgccactgacaaatggcaagacctgtatctcaattgtgaaagttggcaaatatttagtgaactgaagctgtgtggatgtctaattagattaatccaggtttcaatgattgatttttgagtaattattttgtcaatttaagcaaaatcatgtttatgtttctgctgtactaactagatgaacataggaacataattgtagctacttttttttaagcattacgagtaaaaatactctttgaatataatgccagagaactcatatggtatcaaarcatatggcattcttaatataaaatggacatatatatggaataggatttatagaaggcattaaggcattcccttgggggttctcaataagttattgtgcaaatttaaatgcatatgtgcttgaggctcagttggttgttttttttggtcccattttgtttttactattgtttgcccttagtgctgacatccactttctgttactgtttggttggctggcctgcatcatacatctttctgtgtaatatttctctgtttatcttggtgatgatcacaatacttttctttgtttatgtttatgc

SEQ ID NO: 149876 - DNA, 601 bp, Human
cagtgagctgacagggttgctgtacaccaaactgttgtggctggacactgggatggagactggcatctcgaagttgggaggtggaacagcctgcaggaacagaaaacaaaacaaaggtaaaagaaaagaattaataacagaagctcttcaagacagacagcccttatttttccaagaaaaattctacattccaaactactttgtgtctagaagaccattaagaagagccctcaagacgttcagatcataaattgatttcttaaatgtgcttagaactccttctttgcaaccattaaaaaaygtttcacttttgtttaaaacaaagccccatttcattagactccattgtctttggattccattctattaagtagtaattgttcatttgtgatatctgaatctggtgccagaaatgactgcaagatcaaaggtgcctgattgtgatgacttcacagagaaaaaggattaaaatgcaaaccgaagcctttgatttaattgcttattgaagcatatttatgtagaagtttaatgatagaaaatcatctccaagcatgtgcatagcacatataccttaattatcattttttaaagtctatgtttt

SEQ ID NO: 149877 - DNA, 601 bp, Human
gttgagattacaggcgtgacccactgcatctggccttcgttacagtttaagcaaatgtttattatttccaatcagataatattttggaaataccgtatcaaattcaaaaaaatgagcatgagtttatcaaataggaaagtgaactgcattctagtatgatctgaaaggaatacatgtggttactgaaaattcatacgaaaattttcaaatatattcaaaagtcaagagaatggctcaatgaagtcctttgtatacatttcccagactcaagattaaaattttttatttggatgaatttaaytgtattttctatataaagcttctgtaacaaaaatagtaatacatgtttggttttaattgtaaggcagatatataagtattctacaggaaaattcctccatgaataaactattttcatacagctatgtgtatgtaggatacattaaaaatttcctatagagtacttttaaaaatatgaaatgcaaatatataatggtttgctgtatgtgacttagaaatacaattatttttgatgctgcttctggaaacataaaggaataattttgttatattcaatacgcattgacttggttcctactgt

SEQ ID NO: 149878 - DNA, 601 bp, Human
atttataaaaatgtatttgtaaaccaattttctttatcttctttcttataattagcaggctattctacttgaccctggcaaaatattttaattaggctatccatgtctatttcaataaacttgattttttttgacatttcaaacataaccttgtgtcattcatgcctgcctcctactattttaaatgtatagcatgttccagctgcagaaattaccatggttacttgttatgccaatagtgaactgcagttggcatttgaaagtattgtgctatcttgcctctgcattgaaaatgacatcratatctcaataatctcaatattacaaattaacacggaaacctggagaaatgtgactgagacaattattggtcacagtgtaagaagttcttagctgaaatatattttagggtcttttggggatgcattatattcatgttgtctaagagctcattttaatgccaatgtgattttattttattaacagtattgttgaataattaaaatcttaacccctccttttctttatgtactcttctttagaaatgcatagaagttcaatacttctttggctggaaaatgattcatatttaatgtgaaat

SEQ ID NO: 149879 - DNA, 601 bp, Human
ttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcatgagactctccctccctctcacttttttttttttttacaaagtgagatgacttgattyagaaaaaaactgcagctgctaaaaagtaacgtaattgcagtctcgccacttggcctcaagagtttcaaactttatctgaaaccttgaatttcaatgacaatatgcaaaatttggaagctatattttggcctttttgctttggttttcttctctgaaaatgtagcaacattctggctggccttgttttcctctggtgttatgtgattctctgacatcagcacggatatattcagcctgacatatgatactggttggcatgagaaagaaggggaagatggctgagtttatgagtaggacatg

SEQ ID NO: 149880 - DNA, 601 bp, Human
gacctacagttagcttaaggttttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcatgagactctccctccctctcactttttttttttttaacaaagtgagatgacttgattcagaaaaaaactgcagctgctaaaaagtaacgtaattgcagtctcgccacttggcctcaagagtttcaaactttatctgaaaccttgaatttcaatgacaatatgcaaaatttggaagctatattttggcctttttgctttggttttcttctctgaaaatgtagcaacattctggctggccttgttttcctctggtgttatgtgattctctgacatcagcacggatatattcagcctgacatatgatactggttggcatgagaaagaaggggaagatgg

SEQ ID NO: 149881 - DNA, 601 bp, Human
tcaggaaaggcttttctcaaatggctgaactgaattctgtgggatgacaaagagtgctcaatagcatgaagcagaagaaggaaaggcatgctaggattgcataggtaagagtaagcggccgtgacattgccaagtggcggcacagtgtagcaattaagagcacacactgaggccgggtgcagaggctcacgcctgtaatcctagcactttgggaagccaaggagagaggattgcttgaatccaggagttcaagaccagcctgaaaaccatagcaagaccccatctctataaggaaaaaaaattaaaaaattagccaggcatggtggtgcatgcctgtggtcccagctactcagtaggctgagggaggtggactgcttgagaccaggagattgaggctgcagtgagcctagatcgtgccactgcactccaacctgggtgacagagcaagacactgtctcaaaacacacacatacaaacacacagtatgggacctgactacctgggctcttccttgtgcaattacttaatttccctgtgcctcagtttcctaatctgtagaaagggcataatgtgaacacttaatttaaacgactattatgag

SEQ ID NO: 149882 - DNA, 601 bp, Human
actacaaaacaaccgaacttgatcttaccatcatcaataaccactcagattagcatgttaaaagctttaatgtggtcaggcatggtggctcacgcctgtaatcccagcactttgggaggccgaggtgggcggattgcctgagctcaggagtttgtgaccagcctggacaacgggtgaaaccccatctctactaaaatacagaatattagctgggcatggcagcgtgcacctgtagtcccagctactcaggaggctgaggcaggagagttgcttgaacccaggaggcggaggttgcagtgasctgagatcacaccactgcactccagcctgggtgacagaacaagactccgtctcaaaaaaaaaagttttatagagttatgacaaaatgttattttaaaagcagtgacttttcatttaggttgttaagaggaaagaattaagtagtggatgaataaccatcaactgaaaccttagaaaagtcactgttactaactaatgtattataatgacttgctgtatatttctcttataccaagagtacaactccatcctgctacttctttattaccctttgtcttcatctttgaaagtatttcaagtt

SEQ ID NO: 149883 - DNA, 601 bp, Human
gcaaaattttatgattatattatcataaaacattgcgtgtaaatggattgtaaaaatatttgtttcttatctccaatctgagtaagtactaagttcaaaggtgctgagtcatgacctaaggtcttgctagatggagtctttccagagtctggaaaccagatctcttattcactgctcaatatttatccacggcagtacactgccaccatcaactctccatgtatttagctgacataaattaagcattccagaagtgacaatgcttgataaccaaatgcataaaatagtcaacaattaacawtcaaaataagaaaacagatgttagtttcttttttataaaattatatctaatttacaataaatgccaattaaaattattaaccaatatacataaatctcctttgccttactgtcaaatagctatgtagattgtaaaattatcttaaatgttcaaaggaattcctaaaggtttttcatttcttttttctctttttttgatctcaactatgaatcaataactccttgagcatactggtcctttctactcaataaaaggcaatcgtattatcaaagtgaaaacaaaggatactaacgggatagt

SEQ ID NO: 149884 - DNA, 601 bp, Human
tctttgacctgcctttcccacttcaacatgagcccctagagaatggtatcaaggtaatggtttatctataatttgcttggttttgtatatggaaagtgaacactgattttcttggcagtagctgcataccacatgctgtagctatctaatttgaggactaggtttttttttttctttaatcttgataaacttggtttgggttaaaaatatcattgttacttaatttcataaataataataataaagcaatgccgttagttatttacttatgttttgggtgaactcccaaggtaaaactgcyaatgaattcagaatttttaattcagaacaattcaaactaatggaacaatactttcaaaacagaacccaactattaacctagatttttttcatttgctgcttaataatattttaaaaataatataaaaattatatctttatactaacaattagttttcttatttgagggtaattaagtatctttctccctttcttgaatattgcaatcttaagttatgttttcctgggcaacaaaaaatgcaaacttgttaaagccaactttttaaactaaatttttaaccacttcactgatattttaagt

SEQ ID NO: 149885 - DNA, 601 bp, Human
atcttatcatgatgccaaagatagggaagaggaacctaataggtgtataaagagaaaagactgctttgagaaaaaaagacaaattctgaataaaactagtatttcagggggaaatattaacggcttgaatttaatattaaaaacaaccaaggttttcttatccttcacactattaggttaaatcaatgggatatgagtaaagaaaccaatcttcacagtactttactgtagatatagaaggatagagaataaaaaggatacaatttgtgaagtcagaaatcaggataaacaaagggctctraaatctgctaaaacactctctaggaagttataacctaaaattttctttttttcctctggaaatcaaactccttaagaatgaagtcaaaccaaaggggtcgaaggcatattttacaacatcctgacttaacctgtaacatttttcatttgtcttgtctttgacctgcctttcccacttcaacatgagcccctagagaatggtatcaaggtaatggtttatctataatttgcttggttttgtatatggaaagtgaacactgattttcttggcagtagctgcataccacatgctgtagctatc

SEQ ID NO: 149886 - DNA, 601 bp, Human
tactaagttgtttttccaaagattgagagtccatcaagtaggtttgtgttggcgaacattttctcatttgtcctaactgtcatgcggatttaggcatcaccatcccagcttttgacagatgaggaaactgaggcttaagaagcttccgttacttgactgagatcaccctgtcagcaaggaagaggctttgatttgaatccaaaatgcaggttgctaccactacattacaaaagccagatgtctgagatttagcatgcatccttgtatttgcaaataaggaagaaattgacaatctgatgtytccagtacaaaaaaaaaaaaaacccaaatatcattctcctttgggtactgatttactgaagggatagtttttaattgcaccataaaaatgctattgaaccacactatctttaaaaaattccatttaactatgaatgatagatttatgactcatttaattgttcacttcttgagattttggggctgtctctttgctaaaaatgagggggtgtcttcattattgacacaatcgctcattctttcagtcatttttataaacaaaaatattgagacagtataaattagagagagcatgacagaa

SEQ ID NO: 149887 - DNA, 601 bp, Human
tgcataatgttaaactatgaagaaacttctctgaaacctcagtgcattttgtggtatattcttagagaaataccccaagactataccaaagccaagaattattcttggccataccagttcaggggcatcagacgttctaaaaagagagctgtctcttctctttgaccatgtcacctgatgctggaccagagcttcaggaatttcatatctagcctatttgtccttgacgtttcttgggctgtgttttgttcagcgattttgcgtgtgtgtgtgtgtgtgtgtgtgtgtgtgtgtgtgtgttaaattaacagtctgtcaatgagacaatgagcttttaacgtacagcacatactgtgtaagctctggattgtgagggagaggtaaagaaattttacttattactaagttgtttttccaaagattgagagtccatcaagtaggtttgtgttggcgaacattttctcatttgtcctaactgtcatgcggatttaggcatcaccatcccagcttttgacagatgaggaaactgaggcttaagaagcttccgttacttgactgagatcaccctgtcagcaaggaagaggctttgatttgaatccaa

SEQ ID NO: 149888 - DNA, 601 bp, Human
tagctctaagagaaaaggcaaccacaaaacattcaggggtcagaaatctgggtatgatgaaaatttcaatatgcttaatgtagaaagggggcaaatcagatttctgattcttatcttgctaaagactcctaattagggattcttacacacaaaataaaggctccactttttctgggggtttcttagggaaattatataataatgcataatgttaaactatgaagaaacttctctgaaacctcagtgcattttgtggtatattcttagagaaataccccaagactataccaaagccaagaaytattcttggccataccagttcaggggcatcagacgttctaaaaagagagctgtctcttctctttgaccatgtcacctgatgctggaccagagcttcaggaatttcatatctagcctatttgtccttgacgtttcttgggctgtgttttgttcagcgattttgcgtgtgtgtgtgtgtgtgtgtgtgtgtgtgtgtgtgtgtgaaattaacagtctgtcaatgagacaatgagcttttaacgtacagcacatactgtgtaagctctggattgtgagggagaggtaaagaaattttacttat

SEQ ID NO: 149889 - DNA, 601 bp, Human
cactcccctctgctgcaattagtggcagcgataatacacagagtactagttctttatatgtttcaggtgcttcacaaatagatatatagaatatgctagaaaaattaagaattattcaggaaaggcactaaaaggtaagttattgagggacaatgaggtgagaactgaaaatgtaatgagtaacttgttaaattgaaacatcaagggtctcttctctttatgctacttgagaaaattttatattttagataatgattgcaaattgatgaccaagtacactattgagacaaactgcttatcyaccatatatatgaaagccaggaaatcatgtaagtgcccacctactaaatttgtttatagagagttaattaaagcgtcttttctacctgttgcacctgttaatcatttcacagcacattaccttagctaactgcaagtggtagaattaaacaagtcagacattttccctaatgaaaatgaaaagttgaagtctctgatattttcttccacactgacgagtatttgttgccacaggttgtcgttatatcaaggtaaatctcaatactaatttactcatacagaacttttcaccaaaagataa

SEQ ID NO: 149890 - DNA, 601 bp, Human
cctctcctccttccatctccatatccaatgagataccaaatcttattcatttttcttcagaaatgcctgtctctacttccactgccaccatcttagctttggcttccatcaccatttgaataaatatttcagcaactctccatctgggcctctggtctctacttgaggggttcttcaccaggccttaagaggagtttcaggccttcagaggagttccttaaagctgtatgcaaacttttgtgcatttgtgtgatgctaaccaacccactcaaggaagtctttctgaactgctacttccatyatgttcctttttcatacatgagtgcttaacacagttgagtcagtgccctgcctggctctcagaactgtctacagttgacacactctatctatgaaacctaatttccaatggtcacagcctgccttatggtcctcggaatatatgcaaatctttgctctagcagttcaataactggcagtattggctctcctgtttaattcaaatttatcttttaaggatcaactaaagttccaactctttcatgatgcctttcagacaacttcagcccacactgaattcactcccctctgctgcaattag

SEQ ID NO: 149891 - DNA, 601 bp, Human
tttttctccccagttaacttgcaaacacttgctgcattttttttattgactcctattttaagaagtcgtaaattcaaagaacatattcctggcttaagatattatgaggaaggcattttgccttgtctcacagagctcacttgaacatgtagctctctttgagctcaaagttctgaaactttcttttatttggatgtttaggcattttgagttttcttcacttgtttctttttcttttctaggactttgaattatgaatacaagcatataagactaataagcataaacagaattagtcacyatggaccatggctaattctgccattggcataaccattttttaatctaccaaactgtcatcttctattatcccctctcctccttccatctccatatccaatgagataccaaatcttattcatttttcttcagaaatgcctgtctctacttccactgccaccatcttagctttggcttccatcaccatttgaataaatatttcagcaactctccatctgggcctctggtctctacttgaggggttcttcaccaggccttaagaggagtttcaggccttcagaggagttccttaaagctgtat

SEQ ID NO: 149892 - DNA, 601 bp, Human
ttgagaaaagtttgttttttttttttttttttttttttttttttttagcattttctacagtaaactctctgagaaattccaacaaagcctatgtctttttgcccacattttaaacagtgattcagggcagcagtaggggaaaaaaaagtaaatatacattgtagcttttcattcagtaaatacctcaaaactaaaaaaattgattttaaaagccttctatttttctcttggaatatttcctgttatttggaaattacgccattttagaagattagtcacatattttaaggtgtttacataytgaaatgtaaaatattttgaaccatgatgacacttcttaaattcatatttttagagcatcaagttatttttaagaacaaataaattctgctttttgctagtgaatttctgctgtttttagcatattgtgccagctagcattttggagccgtataataaccatttctgtttccagccaccaaattgttattctttggacataatatagattcaggaatgcaagactgtggatcctaaaccagtgatatagaaacctatgatttgaaaatcaatgatgaatacatgcgtgtggtttactgct

SEQ ID NO: 149893 - DNA, 601 bp, Human
aattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcatgttgaggacataaatattgtaaaaatactatgttataaagtacctcattacctattattactctgcytatgggacgtagagattgaccgatggtagtgtctgatttttttccaactataaattgaaagccttaaaagaaaatgtttttcttatcctagaacatcagcctagtgaagttcaccagatatatatatatattttttttacacggaaaagggaaatgcaaaccagttaccagaaataatagctaaatacaagcaaggctctgtcaatggcactgttatgttaattttctgggagaatgttaagtaattcatcaagttagacaaatataaaaacagcaaaacatatacaaaacattatcaat

SEQ ID NO: 149894 - DNA, 601 bp, Human
tgacagggtctggggatataatctctatttaaaatttcttatttatttatctttcttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcrtgttgaggacataaatattgtaaaaatactatgttataaagtacctcattacctattattactctgcttatgggacgtagagattgaccgatggtagtgtctgatttttttccaactataaattgaaagccttaaaagaaaatgtttttcttatcctagaacatcagcctagtgaagttcaccagatatatatatatattttttttacacggaaaagggaaatgcaaaccagttaccagaaataatagctaaatacaagcaaggctctgtcaatggcactgttatgttaattttctggga

SEQ ID NO: 149895 - DNA, 601 bp, Human
gtgccataataaactaatcagctcacaggactgttttaccctgaagcttgccacagagcagagaaagaaaaaagaaataaatgtgtttgcagaatgatctaaatttgtctaccgaatcttggttttaaacgttcttgctcttaagcaaagctaatttgtagaacactgatgtaagtctctttgttgttgaatttggtcccataacattatcttcatcttaggcatgcagacccagaagaaagaaaaatgacagggtctggggatataatctctatttaaaatttcttatttatttatcttycttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcatgttgaggacataaatattgtaaaaatactatgttataaagtacctcattacc

SEQ ID NO: 149896 - DNA, 601 bp, Human
tttttggttgatattcaaaattaatctgcactgtgccataataaactaatcagctcacaggactgttttaccctgaagcttgccacagagcagagaaagaaaaaagaaataaatgtgtttgcagaatgatctaaatttgtctaccgaatcttggttttaaacgttcttgctcttaagcaaagctaatttgtagaacactgatgtaagtctctttgttgttgaatttggtcccataacattatcttcatcttaggcatgcagacccagaagaaagaaaaatgacagggtctggggatataayctctatttaaaatttcttatttatttatctttcttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcatgttgaggacataaatattgt

SEQ ID NO: 149897 - DNA, 601 bp, Human
gcagagagcaaatgagtaggggctcatgttatattttgaccagcaggtggtgctgtgaccactttgttcagattcttctaaacttccctcaaactagatggcaaagcagctaatgcgaatatttaactcattacagtaaagagataaaagatccaccacataaacttaaaatcatgagactttaattcccagaagaagaaatattttagttttatgtaatgaaagaatatttttgtttgaattttactataaattgtcctaaaatattgaaaacagaaaaaatattgaaacaaaaaaaaaacctgacattcttttcacctgtgagtgatgccagaaattaatggtatttaaacataatcaatgttgacatactgtggtaacttccaatatcttccaattttatcaaagctaccacctctacctaaaagtagctttgcacatgccatttgagggaagcgctctcaccacttaccaaaagcaggtcgacatcctcagactgagagcatgcggaaggagttttattaattagtgtccgtaaatatttataattgggcaaaatcttttcaacaaaaggaaaagcatcttccgatagacacaacag

SEQ ID NO: 149898 - DNA, 601 bp, Human
tcaatatgtaatgtatcttcaaagttaactatctttcaagaaagctgaccaacagtatcacgtgaatttatcttactatttaaatgaaaggttagattttcaatgacagtgattagcgggtaggatgaacataagcaaacagtgtacgggtgaatatttcataatcagatcactaatatatgctaaatcactatcatgtgaaagctagtgggtggggggagagagggcaccagcaaacataagagacacaaagttgtggtataaatcagtgacttttatactaatcagtgttttattctcwctgtctccttagacatatggatatataactagttaactaatacagctaagtgattaacgataacaaatggctaagcagaaaagtaaaagtgggctaggcagacagaatatttttaaaatataaaagcttgttatctttaaatattttatatcctcctggtattttcttttgaagattaattgcaattttggacttattaaatttacagtcaggctttcagttaacgttttaagcttttttaaaaaaatgatttgttttatatgaaatagtgtgattgtgaattcagagctttttaaaggt

SEQ ID NO: 149899 - DNA, 601 bp, Human
caaaagaatgtgagcccgcaacacaaatctctgcgacaactttggcctggaaaatgtatcaattctttttaaattgatttacactgtaaagaattaaggatgctcatgtgaattactttacataagtattgcagcttgggattttttaaaaaaacagtttaacatttaatcgtgtgaatatgaggtagtccatgtgaaggaacctcctttcaaaaagctactctgtgtgtgattgtgagagggagaaaagagtgtgtgtgaagcagagagagagaagggccaacagtggaaggactggaarggtcattccattgatttgaggggtaagggaagtgattaagtgcaattaaaactcacagagaaaactaagagtcaaattaagcacaacgaaattaagtgttgaaaggaaccgggagctgaacaaaatgcttaacctttggctgttgtaattcagttcctttctgtctaaggctgtccctcctttctcattttctgaaacctctattagaggcagcagagaattagattcttccttgtaatagaaaagagttttaaaattgtagtacagctaaaatatgtaaataaatatgtgtttatatgt

SEQ ID NO: 149900 - DNA, 601 bp, Human
ggtggagctgaaatatattccactctgctatgaacattgtctctagccaaaagaatgtgagcccgcaacacaaatctctgcgacaactttggcctggaaaatgtatcaattctttttaaattgatttacactgtaaagaattaaggatgctcatgtgaattactttacataagtattgcagcttgggattttttaaaaaaacagtttaacatttaatcgtgtgaatatgaggtagtccatgtgaaggaacctcctttcaaaaagctactctgtgtgtgattgtgagagggagaaaagagtrtgtgtgaagcagagagagagaagggccaacagtggaaggactggaagggtcattccattgatttgaggggtaagggaagtgattaagtgcaattaaaactcacagagaaaactaagagtcaaattaagcacaacgaaattaagtgttgaaaggaaccgggagctgaacaaaatgcttaacctttggctgttgtaattcagttcctttctgtctaaggctgtccctcctttctcattttctgaaacctctattagaggcagcagagaattagattcttccttgtaatagaaaagagtttta

SEQ ID NO: 149901 - DNA, 601 bp, Human
tattttcttgaaaagaaaaaagtagcattaaaataacttaactgcatatatgctaggttcagatataagcatgttggtctacttgagaacaaaatatagacacgaataattatagaccctgataattgtgaaatactgcatatgtgtgggtgggtgataaagaggtgggtggggagatagaagccagatatgcaagttacccatatcaagtcctctatgcaaattttcatctattacagatgcttttgaattgggaaaactcctaccctttcccataattgttcagaaatcaaacatgackggatagttttattcaaaatttttactgcctccgcctggaaattagactatcaaactatatttaacctaaccttttataagtcatctctactcagagttatctctctcagtatgtactgaacacccacatcaacaaagttgacgtatggaaatgcttccagaaaacaggctgccctttttataggtggtggtttagaaaaacactaaaacttagtgttacactaaatcaaatattagtattcaaaggactttcattaactcttgatggcaagttcctctgtcagccatctctctccctata

SEQ ID NO: 149902 - DNA, 601 bp, Human
aaaaggattcataatggtagactattttatcttggttcaaagttacttagtgattcattctgatgtttgaggaaatcgtcttttgatttctggaataaagaattttcctggctctaagaaagaccatttcactaaaatttaattaaatgcttctgctatgaatcacacaactatttaataatgaatatgaattaggagtctgaaaataaaaagtgatatgtcaataaatacttttgcttgctctttgacatacagattatgtcttcacagggagggtgacatagaaaattagaagaaaaarttggtgagttggacagtctaagcagttaatctagacaaggtaagggaaaaataatataaccaaaattctgtttctttaatacagtttttggaagctgcattattcacctctttgcatcatcttcctatgttaactggcctgtataggtttagctgtgtatcttccccatgaaagatgtaacaattattggttatcccttcctacaaacagactagcttaaatttatcttttggtggaatttcatttgacactgaaaacatacatgaagcattttgagtagttctggggactaaatccaca

SEQ ID NO: 149903 - DNA, 601 bp, Human
tttcttcatccttttgcagttacatgagatgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggatgtagtgtgattttactgtgtttataatccttaatcctcatatattcccagagagaataatttttcctttttccaaaatctgggaaaatttagaaacttggaattctagaggaaaaaastattaagcccttaagtgtagattagcaatcacaatgactttgatcaggataaaccatagtggcattgctcgcatcaattttaagatgcttttactcttcttacactaattacactgacttccagagctagagtcaggattacttgactatattgtcaaaagagcatggtactctcttttactgaggaagaatccaagtgaagaattatccatacagacacacccattttaaacaaaggaaagcaagcctacttactaatgtatgtaattatgctgctttccagtggagagaattagttgg

SEQ ID NO: 149904 - DNA, 601 bp, Human
gctttggaggtggaaaaaatggaaagggggagggaaattgaaaattatctgcagaaagtttaaacgttggttttcaaacacttaagactttctactccattaaaactgataatttgactttcttcatccttttgcagttacatgagatgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggaygtagtgtgattttactgtgtttataatccttaatcctcatatattcccagagagaataatttttcctttttccaaaatctgggaaaatttagaaacttggaattctagaggaaaaaactattaagcccttaagtgtagattagcaatcacaatgactttgatcaggataaaccatagtggcattgctcgcatcaattttaagatgcttttactcttcttacactaattacactgacttccagagctagagtcaggattacttgactatattgtcaaaagagcatggtactctcttttact

SEQ ID NO: 149905 - DNA, 601 bp, Human
atattatttttaaaagcttattatcaatataaatatttgcctccaattaataagcacatacagatggaatcacatagtcttcagagaaagtgaagggagttaaattttaaatgactagaactcaaatgctgcacaataactgtatctggtaaaaagctttggaggtggaaaaaatggaaagggggagggaaattgaaaattatctgcagaaagtttaaacgttggttttcaaacacttaagactttctactccattaaaactgataatttgactttcttcatccttttgcagttacatgaratgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggatgtagtgtgattttactgtgtttataatccttaatcctcatatattcccagagagaataatttttcctttttccaaaatctgggaaaatttagaaacttggaattctagaggaaaaaactattaagcccttaagtgtagattagca

SEQ ID NO: 149906 - DNA, 601 bp, Human
attatattagttgggctgttgtttaagaaaagtcgataagagggcctgagttagggtaatggcaacaagaaaagattaagagaggtttggaaagatatttactgaacagaaacatctttttttatataaacataaataaggatagtgtggggatatgtttgcagatacgattttcatgaattttaataaaaattgattaatagttaattatataaaatactgtcttaatgtcttccctttagggccgggaagaagatccacatgaaggaaaaatgtgagtttgtgttaattattaaaatgaaaaaaaaaatctatattgtaaatttactaattggaaaactttggccaaaaaaattgttttttaaggttttggactgacttaacttttaaatttggcttagggaactgatttctaaatattttcttaaggatctagtgataaagtcttgtttttaaataaaaggtagctgataactaaatataactctttttatcaccacactgaagactttgaataaacactacatttataacattatgaatgtcacaatttggcacattttaaaattattcatagtatttcttggttattcatagtatt

SEQ ID NO: 149907 - DNA, 601 bp, Human
gattctccacctttaccttagcagagcctaaaaaatgatctgttatctggttattttgtcgtttactactcctagcacttatcatctgtagtttcctaatctccagcatgtaggtcttcaaattcataatacttttttctttattgttttagagataggttcttgccattgcccaagccggagtgcagtagtgctatcatagttcacctcaaactcctgggctcaagtgatcttcctgcctgagcctcccgagtagctgagactacaggtgtgtaccaccacacctggcaaatgttgtaatttttttttttttttttttttgtaaagatgaggtcttactatgctgcccagactggtctcaaacgcctggcctcaagtgatcctcccaccttggccttccaaagtgttgggattacaggtgtgagccattgctcctagctatttttctttatacctttgctcaagctgcttcctaggccagaattcttccattcatacttagctcattcatcacttccccctagaaaatcttcctttattttcctctctacacactcaacagtattggtacccttctctgttactcccaaaatgcctttgg

SEQ ID NO: 149908 - DNA, 601 bp, Human
cagagtattcttaagcaaactggtcttcactttttagaatcttcttattacgaagatttacatacagaatttagcagttttagccagtattccctaactatgcttaggttccttccaaattaggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggkgaaaatttacatatgtttatgactttgaatgcactttgtaataatactacttaacatcttttcttttttatttgataattagggaaaaactaacagcttaattcttacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacaggtaaatcataattttttagctatcttttacttttcgcaa

SEQ ID NO: 149909 - DNA, 601 bp, Human
tcatttgtgaacgtaaaggttttcctataactaataactctctatttcctatttcagaggctggcataatcttgttctaaaatgcttatatttgcctagtttaacccctcagtaccacagcagtattctctatctgaattagaatttgtcaaactagacatttgagtgaatagagattctgtagcttgtttatctgaaaaaaaccaaaaaacaaaaacaagttcttctagttgcttgctggaagctcagttgactgttaaaagacatcaaatgtaagatgtgagtctaggcagctgtaccyttttgcctacctcatatacaggttgcttgagtactttatacatgacaatctgagttctagatgtcctcactgaaaatacagctagctgcaatttgagttctttaagaatgtaatttttcccaattccagttttctggagatttagaacatacaaaataatgcactgaaaatatatcatcttcttaactgaataaatgtccatattgagatcctttttaaagataaaataatttacatgaatttatttttttgaagttcgttttgttactaacttaaacttccttatgatacatcacacaa

SEQ ID NO: 149910 - DNA, 601 bp, Human
aggctccccagtagctaggactgcaggtgtacaccaccgtgcctagctaatattttttgtagagatagagtcttgctctgttgcccaggctagtcttgaattccaaggcagaagccttggtctcccaaaatgctgggattacagttgtgagccactttggttgccccaacagtttttagtaataaaatatttttaaattaacacgtgtacattgttagacataatgctattacacacttagtagactacagtatagttgtaaacataacttatacgtgcactgcgaaaccaaaaaattcayatggctggctttattgtggtggtctggagccaaatctgaaatacctccaaggtatgcctatattttccttcattcccgcatgctttcctagtagaatttaaggtctatgagaacagagatttttgtttgcattgttttttcccagtgcttagaacagtacctgacattagatattcaataaatattgattgaatgaatgattctctgctttccagcaagaaatacctactttacccttgcctgtattgttactaaggtcttacactttaatgtgctccttcctatcaccatgtcagtctt

SEQ ID NO: 149911 - DNA, 601 bp, Human
caaggcaaatagcattaacaaagtacatttcaaggaaatgagaagacatctgtaccatataataggacaagtagaaaaataggttgataaattatgtattaccataggatgcaaataccagaggacaaaaggggaaattataaatgaatgttaatatctttttctttattatcaaattaatgccaggcattgaacatttcctgctttgtgtacacatagaacctgatatgctgacctttagcatttagaagaagactaatgtgaaagttaacagccaccttgtgcagtaggtgattagtgygcatgctcagcctgatgctgaacgaatgttggatggcaatgctgttttcttgcatggctttagttgcacagctgtgcaatttttccagattattttcaatattaagagatctctaagcactccatttccttgtattaaacttctaacttttaatactgcattacttagaaagatgtcttagtgacacaaagttattctagtgactatccatgtggtaattaatttttacaccatcttttcatagctggatctcactgtggtatttattgctttacatttatttatgaaaatgttttgctg

SEQ ID NO: 149912 - DNA, 601 bp, Human
ttccatgattacttttaagacattctcaaagcatgaaaatatagtctttatctttaataagtgttaagcttgtcctctgtgtatttttgctatggcctcctaacattagcatgatataaaatctttaaagcaggaaacagaagtaacatttattgagttccaaaaacatgcaggcccttaataaagattttaccaatattttcaagtctagttggaaagatagcacatttccaaaatgatataaattattacctaatattgtacttacatatcaaatgatttgaaataatactaaaggaakacaagaacatttgttgtacacaactgttcacttaaactctagaacaagcatatgtatgaagagatgatgtttccattttaacaggtgaagaaaaatgatcagtttagaaaaatttgaaaatacagaatcacctacaatctccttagagataattacttagaacatttttggtctaagaacatttctagtctttttccagtgcatataaagcttttcaaattagctgtgtgcagttctagcagttcagcttcaatctgtttgtaactttatttctaatgtattttacaattaattgaaatt

SEQ ID NO: 149913 - DNA, 601 bp, Human
tacatattgaagaagcccataaactcccagtaaaacattttactaatccatattgtaacatctacctgaatagtgtccaagtagcaaaaactcatgcaagggaagggcaaaacccagtatggtcagaagagtttgtctttgagtaagtcttattttatcattacattaatcattttcttttaccatattgcatttctttctgtttttttggtctctgtatctaaaccatcagaacaaggtaccatatccaggtgttctaatagcatatatatatatatatattttttttttttttttctgktgtttgttcacctttatttgtgaagtgctatgcccttggtttttccacttagttattaacatgaattagcaagtcaaaaaacatttactaacccacaaatacaaaacatttactagggtttccagtacttatttgaatgaattattagtttaggaggttaaagatggtaggaaaagtgtgtaatctgcgtgtcttctgtataccaaataataaaatatgttgtgaatctggttttaggtctagcacactgtttttttttttaaagcagaaatagggggtttatttgatactagaactaaa

SEQ ID NO: 149914 - DNA, 601 bp, Human
atattgaagaagcccataaactcccagtaaaacattttactaatccatattgtaacatctacctgaatagtgtccaagtagcaaaaactcatgcaagggaagggcaaaacccagtatggtcagaagagtttgtctttgagtaagtcttattttatcattacattaatcattttcttttaccatattgcatttctttctgtttttttggtctctgtatctaaaccatcagaacaaggtaccatatccaggtgttctaatagcatatatatatatatatattttttttttttttttctgttgkttgttcacctttatttgtgaagtgctatgcccttggtttttccacttagttattaacatgaattagcaagtcaaaaaacatttactaacccacaaatacaaaacatttactagggtttccagtacttatttgaatgaattattagtttaggaggttaaagatggtaggaaaagtgtgtaatctgcgtgtcttctgtataccaaataataaaatatgttgtgaatctggttttaggtctagcacactgtttttttttttaaagcagaaatagggggtttatttgatactagaactaaagaa

SEQ ID NO: 149915 - DNA, 601 bp, Human
tgaagaagcccataaactcccagtaaaacattttactaatccatattgtaacatctacctgaatagtgtccaagtagcaaaaactcatgcaagggaagggcaaaacccagtatggtcagaagagtttgtctttgagtaagtcttattttatcattacattaatcattttcttttaccatattgcatttctttctgtttttttggtctctgtatctaaaccatcagaacaaggtaccatatccaggtgttctaatagcatatatatatatatatattttttttttttttttctgttgtttgktcacctttatttgtgaagtgctatgcccttggtttttccacttagttattaacatgaattagcaagtcaaaaaacatttactaacccacaaatacaaaacatttactagggtttccagtacttatttgaatgaattattagtttaggaggttaaagatggtaggaaaagtgtgtaatctgcgtgtcttctgtataccaaataataaaatatgttgtgaatctggttttaggtctagcacactgtttttttttttaaagcagaaatagggggtttatttgatactagaactaaagaaataa

SEQ ID NO: 149916 - DNA, 601 bp, Human
aagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaatargtagactacgaattcattctattttaaataaatttattcaatgggacatcattttaaatataagaacttgtgaaagaacatatttcttgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagaga

SEQ ID NO: 149917 - DNA, 601 bp, Human
aataaaccctaaaatttcaaagcatggggtcaatgggcagcaaagctgatttatggtcctaattttatcattagctgtctaattgatcttaagtcatataacaattctgagtcttcatttttccatatgaacatggcagtgttaatcccttctgttcatgatctaatgaggtaatacatatgaaagtcttacagagttaagtctgtagaagtataggatgtcattgtaattagtactttcaacgctgcacgcaaaaagcacatttaagtggctattcctgttgaggtaaaatgaattcacktaatttccaatttggtcacattaggtcagtcctttacaaataatcttctaatgtaaatatttgtgtagatgaagccactaccctatttcgagccacaacacttgcaagcaccttgatggagcagtatatgaaagccactgctacacagtttgttcatcatgctttgaaagactctattttaaagataatggaaagcaagcagtcttgtgaggtaagaatttaatgttttaataagtatttttgcaaagaacatattttaataggtaataatttgtagccaattacattttaaggaaaata

SEQ ID NO: 149918 - DNA, 601 bp, Human
gggacttcattatcattattctataggaagaactgctttggcaaatcatggaatttgggagcttacgtaaggttacttcattatcattattctaacttatttttccaatgaagaagcagatctgtctggagaggttaagttgaactaaggttttatagaaagctggtggctaaggcagaactaaaggtaactttctaagacccaatctgatatccttgagtcttattgtaggcttttgcttttgttaagcatactccaactaataccccaactaattccaggcaaatggaagtttaatgcraaagcgtcatggaatacagcagttttctaataatataatttgttatttagaatatacactgtcatgtcatgctatatgtaaaataattaggcaaccattaacaccattattacacagtttgttttgaaaatgtgttaatcctgcctccaacctaaattttgtcaaggggcttctatttctttttttggggggcaggtaatatttctcttggttatgatatgacataatatttaagaactacagattctgtttttcttggcattagtggtgattgggaggaatagaaaagaattacaagca

SEQ ID NO: 149919 - DNA, 601 bp, Human
tctcctcaaaataaagcagaggtcctagactttatcttgcttcttgagctttaagcgaattatttggactgcaaataatgttgggagcagggaattgctcagattgctaacctgagtaggttgaaattagctttgtgaactgtcataaaagatgtgaggagtgacaatcttttttagtgataaaggtaaagctttgaggtcctttgaaatagtatcaaccgttggaaactgctgagttttgtagtacccttttcgcaagcctagaagcactgataagcatattcactttttctcttttaaytcaagttcttttgaattttatggatcataaatttttcaaaaaacatttttccaaaaacattctgagttccgaatggaagaatgggtagtagtttaacagtaaagaaatattaaagtgctaaatttataatggtttagctggaagtgctgttggacttggtgtcattagctgtgcccaattctgttacagattctccatctcctattgctgcaagaacactgatattagtggctaaatctgtgcagaacttagcaaatcttgtggaatttggagctaaggtaaaaacattttgatacttta

SEQ ID NO: 149920 - DNA, 601 bp, Human; identical to SEQ ID NO: 149906

SEQ ID NO: 149921 - DNA, 601 bp, Human; identical to SEQ ID NO: 149907

SEQ ID NO: 149922 - DNA, 601 bp, Human; identical to SEQ ID NO: 149908

SEQ ID NO: 149923 - DNA, 601 bp, Human; identical to SEQ ID NO: 149909

SEQ ID NO: 149924 - DNA, 601 bp, Human; identical to SEQ ID NO: 149910

SEQ ID NO: 149925 - DNA, 601 bp, Human; identical to SEQ ID NO: 149911

SEQ ID NO: 149926 - DNA, 601 bp, Human; identical to SEQ ID NO: 149912

SEQ ID NO: 149927 - DNA, 601 bp, Human; identical to SEQ ID NO: 149913

SEQ ID NO: 149928 - DNA, 601 bp, Human; identical to SEQ ID NO: 149914

SEQ ID NO: 149929 - DNA, 601 bp, Human; identical to SEQ ID NO: 149915

SEQ ID NO: 149930 - DNA, 601 bp, Human; identical to SEQ ID NO: 149916

SEQ ID NO: 149931 - DNA, 601 bp, Human; identical to SEQ ID NO: 149917

SEQ ID NO: 149932 - DNA, 601 bp, Human; identical to SEQ ID NO: 149918

SEQ ID NO: 149933 - DNA, 601 bp, Human; identical to SEQ ID NO: 149919

SEQ ID NO: 149934 - DNA, 601 bp, Human
tagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcacgcta

SEQ ID NO: 149935 - DNA, 601 bp, Human
aaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcaygctagatttggccaaaatgtaattatatacaatgtcagttgcacttaaaactaatttatacaattagtacacctaaaatgacatgttggttccaaatagtaattatattctaactggtgctgacttgaagctgagtatcaacgcttaggcacagagaccgaatattttatgtgtttgcactctctcacccagcaactgggaaaggtagattggggaaaatgttaacacagatctctttcattcattgctttgcagagcctgccataaccagctatacctttttttgaatcatttccatct

SEQ ID NO: 149936 - DNA, 601 bp, Human
gtgaatataaaggctctatttagcttgtcactgggttccatgtctaccagtcctaagagataggaaaagaatgtgtctgtacaccaactcttaatttatttgctgtagcataagaaaaaacaagaaagatgctagcaaggaagaaggagataattattttcccccaagatgagagatgagaagagctatagttattacctagttttcaaattcctaggtttttattgcttttagtaaaaaaaaaaaaaaaaaaatcactgggaaaacctatgtactgggttgaatcttttgtttagactgttttttttttttgcctttttgaaataaaatgtatatgatttaatgtgtagaagtggaaactagaaaaatattatgataaagacatgtgaatccatatattcaaaataaagcagaaaattataaatattttgatataaattcatctacaagcataagcatagaaccatttgtacaattttatgtcatttctactgtcatttctaagcaatgtcaaagtctgaatgtgccatgccatgacaaaagctcatgtaacaagagcggttagcaatccgagagaacacagtgccaagctccacatccc

SEQ ID NO: 149937 - DNA, 601 bp, Human
tctctaatactctggcaatgaatttaaattgcactaaaattcagtggagggaggatcacttgagccaggagttcaagatcaatctgggtaacatagtaagttctcatctctccaaaaacattttttaaaaaagtatccgggtgtagtggtacatgtctgtagtcccagctacttgggggggctgaagtgggaggaggatcacttaagcccaggaggttgaggctgcagtgagccatgttcatgccattgcactccagcctggatgacagagcgagaccctgtctccaaataagaaaaaaawaataataataataataataataatggtaatagctaacactcacaatgtatggaaagcactattgtgtttaagtgtattaactttatttaattctcacaacaacccagagagggaggtaattttattactctcattgtacagatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctg

SEQ ID NO: 149938 - DNA, 601 bp, Human
gtatggaaagcactattgtgtttaagtgtattaactttatttaattctcacaacaacccagagagggaggtaattttattactctcattgtacagatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggtagcaacggaagagatggaaaagagaggtcgaactgaaagcccrctggtgagacttggcaattgattcaatgagagaaggtggactgcagaccaatggcccgctttctggtttaggtggcagagtggctgatgatgccacatttgaaggtaggatacaggagaaagactggggccttgggggtgcacgaggataagttcagtttggacctgttgagtttgtggggcgggatgccaccgaggtgcatatacaatggaagaagcttgctgcaaatcaagatttagaaggtattcctacaacctccaaactgaacgaagacagttctgtctttggatttcaagtgaa

SEQ ID NO: 149939 - DNA, 601 bp, Human
aacacaattagtgactttcctctccatggcctaaactaagtaaactcctcgttaaagcaaattaaagcaggattgaggagaaatcaacccagactcaaagcgacattttagaaagatgcaggcatccagcaaaaatattgcagaaaagaatccaataagattaaaaaagaaagagggagaaaaggttgcgggcttttttttttttttttttttttggcctattttattttacttatgtagtaaataaattaacatagtccaaaataaaaaaatagaaaagcttataaaaagaaagtatctyattgacccctgtcccccaaggttcccgtttatcttgttattcatttctcgtatgcctttggagaaatgttatgactataaaaataaatatgtatttattccttttttgactctttgtatacaaataatagcatagtatacatagcccacttttcaccttgcttttttcactttacaatatacctgggatattattccttagcacgtagaaaggcccctcattcttagggctacattgtatgggcataatataacttatttaagcaattaccaattgatggacacttcggttgtttccagt

SEQ ID NO: 149940 - DNA, 601 bp, Human
agtatacatagcccacttttcaccttgcttttttcactttacaatatacctgggatattattccttagcacgtagaaaggcccctcattcttagggctacattgtatgggcataatataacttatttaagcaattaccaattgatggacacttcggttgtttccagtctttagacatttttatttaaaaacgttgtaatgaatgatctttcacccatgtatctggatatacctagaagtgaaattgctgggtctaaaggtatactcattcataatgttgataagtattgctaatttgtacyccatagaatttgtagtcatttgctacaaatgtgggatttaaaaaagagttagcctcggtactgtactgcctctgccaaaggtaagcatgagtggactttgcagtttgtgcgggttccgcagacagactgaggaaactaaggaaatcagtgcattggaaaactgcaatttcaggatagaatcaggtagatgcaggtatctccctgcttctaaagcccaaatttaatccatatacaacacccaaagctttaatttgtatgttacattcaacttttgaagccctttcacatctcttaccatct

SEQ ID NO: 149941 - DNA, 601 bp, Human
tgtagtccttgctactcagaaggctgaggcgggaggatcacttgaggccagaagttcgagaccagcctgggcaacagagtaagaccctagctctaaaaataatgaaaataagcgaatggaaatttatgtccaacagcttcatcaaactgtagtttgtaagcaaacataaaaatcataagtgtgagacaggcttatgatttctccaaattgggccaattcctgaaatagaaatttttatttgatttctcatataattattgcatgcctgccataataattgtaatggctaaattgctaaaayattttttgactcattaaatgctctcatatgcattatcaaggagtttagaattcattaacagaaacaagatgaattagtataaagcagctaagatttataatgcttttgatgaacatggttcttttaaactcagaacttaaagttcaggaggatcttagacaccacccattccaattgatctctctcattttgcagatttttttaaaaaagaaaaaagaggcctgaagagattgtgtgatttgaagatatggaaacaggcagacctaagtttgccatcccatcctctcatatcacttaccg

SEQ ID NO: 149942 - DNA, 601 bp, Human
cattccaattgatctctctcattttgcagatttttttaaaaaagaaaaaagaggcctgaagagattgtgtgatttgaagatatggaaacaggcagacctaagtttgccatcccatcctctcatatcacttaccgcaatgtgccttgggcaagtggcttattctttctaggcctcaatcttttcattaatgagatactgatattaaacgctacaggtttgatgtgaaaattaaatcatttagataaagcatcgcctaccctaagttactgacaggatcaggcccagaactgtctttctacarcatcacacttgctctcccttctactcaaaaaaacctaccttaggagcaaattcgggatccatagctgtcattcctcatttgtgaatttagaaagctaagcctatgagaaatcataattcagtcaagatccagtcccacagaccatgagagcaaaatcacatggttttgtacagaggggacattccttagggtaggctactatgttcagggattgcagtagggaatcagatttactggggagcacagaacagagagattcctgcattcagaaagtgtgctcagcaccagctggggcccagg

SEQ ID NO: 149943 - DNA, 601 bp, Human
agcttacatttagcaggcagagaaaataataaacaacaagcataataaatagaaaattatattgtattttggaaggtgataggaactattaaaacaaataaaaccagctaagggataggaaagttcaaggtagacctcattcagaaagtgacatttgagctaggtctttttttttttttaggcagggtctctctctgtcacctaggctggagtgcagtggtgcaatctcggctcactacaacctccacctcccaggttcaagcgattctcctgcctcagcctcctgagtagctgggacaayaggtgtgcaccaccacacctggctaatttttgtatttttagtagagagggggtttcaccatcttggcctggcaggtctccaactcctgacctcaggtgatccacccacctcggcctcccaaagtgctggagttacaggcgtgagccaccacgcctggccgaactaaatcttaaaggaggtaagtgttgtggatatgtgggaatgatgttttaggcagaaggaagagccagtgcaaggaccataaagggggatcctgtctaagatgatggagaaatgacaaggagggaagtgtggaaacag

SEQ ID NO: 149944 - DNA, 601 bp, Human
tacatttagcaggcagagaaaataataaacaacaagcataataaatagaaaattatattgtattttggaaggtgataggaactattaaaacaaataaaaccagctaagggataggaaagttcaaggtagacctcattcagaaagtgacatttgagctaggtctttttttttttttaggcagggtctctctctgtcacctaggctggagtgcagtggtgcaatctcggctcactacaacctccacctcccaggttcaagcgattctcctgcctcagcctcctgagtagctgggacaacaggygtgcaccaccacacctggctaatttttgtatttttagtagagagggggtttcaccatcttggcctggcaggtctccaactcctgacctcaggtgatccacccacctcggcctcccaaagtgctggagttacaggcgtgagccaccacgcctggccgaactaaatcttaaaggaggtaagtgttgtggatatgtgggaatgatgttttaggcagaaggaagagccagtgcaaggaccataaagggggatcctgtctaagatgatggagaaatgacaaggagggaagtgtggaaacaggtga

SEQ ID NO: 149945 - DNA, 601 bp, Human
ttcaccatcttggcctggcaggtctccaactcctgacctcaggtgatccacccacctcggcctcccaaagtgctggagttacaggcgtgagccaccacgcctggccgaactaaatcttaaaggaggtaagtgttgtggatatgtgggaatgatgttttaggcagaaggaagagccagtgcaaggaccataaagggggatcctgtctaagatgatggagaaatgacaaggagggaagtgtggaaacaggtgagagggagcagagtaggagatgggttctgaggcaaggtggatctagggggrcttgccaggagcacccattgattgcatggtcttgggctttgactacatgagaggaggagtcagtggagggagtaggggagagagatcctgacctaggtctcagtgttcttttgggaataggctggagagaggtgaagtagaggcagagaaaccagttagaagactactgcaatagtccagccaataaggagggtgactttttaatcttggagccttcttcatttacaaattagaaaaaaaatttgaagcatagaaggcaatagagttatccaggatcacacggggagttaagggctagga

SEQ ID NO: 149946 - DNA, 601 bp, Human
ctcatgacatccatatattgtataacatcacctagatgcaaactttgcaaaatttgtttcagctctaacaaattctgctaggaagttattttgattttcattgctatttttgcagagtaatctataataaaggattcgttcttttgcactgaggatctggtggccataaagctttttgtcagctttgggactatcaatcaatgtgtttcaaataagtgaccactaatgaagctcagttttgcaaagggtgagctgctttaccacagagaaagactggttgtggccgggagaggtggttcaygcctgtaatcccaaaactttgggaggctgaggtgggtggatcacgaggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggttgcagtgagccgagattgcgccactgcactccagcctgggcgacagagcaagacaccgtctcaaaaaaaaaaaaaaaagaaaagaaaaagaaa

SEQ ID NO: 149947 - DNA, 601 bp, Human
tgcaaaatttgtttcagctctaacaaattctgctaggaagttattttgattttcattgctatttttgcagagtaatctataataaaggattcgttcttttgcactgaggatctggtggccataaagctttttgtcagctttgggactatcaatcaatgtgtttcaaataagtgaccactaatgaagctcagttttgcaaagggtgagctgctttaccacagagaaagactggttgtggccgggagaggtggttcacgcctgtaatcccaaaactttgggaggctgaggtgggtggatcacraggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggttgcagtgagccgagattgcgccactgcactccagcctgggcgacagagcaagacaccgtctcaaaaaaaaaaaaaaaagaaaagaaaaagaaagactggtcatgctacgtctccttggtcggaaagacagagcaaaga

SEQ ID NO: 149948 - DNA, 601 bp, Human
ttttgcagagtaatctataataaaggattcgttcttttgcactgaggatctggtggccataaagctttttgtcagctttgggactatcaatcaatgtgtttcaaataagtgaccactaatgaagctcagttttgcaaagggtgagctgctttaccacagagaaagactggttgtggccgggagaggtggttcacgcctgtaatcccaaaactttgggaggctgaggtgggtggatcacgaggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggttgcagtgagccgagattgcgccactgcactccagcctgggcgacagagcaagacaccgtctcaaaaaaaaaaaaaaaagaaaagaaaaagaaagactggtcatgctacgtctccttggtcggaaagacagagcaaagagggctctgagaagtctgtgtatcaggctgtgtttccatgaaggcttttttcattgctggggt

SEQ ID NO: 149949 - DNA, 601 bp, Human
acttcgttaagtaaaatcaacaaaacttttcctcagcttaagctctagatttagttaatgtcattcaaaatagatgaaaaagtaggcaaaatattgtgtacccatttagactccttcagtcagtaccatggctgttgagaggctgcgaggacagtagagtgggtgagtctggaccctggagctggacagtgtgggtatcaggtccacctcagccactccatggacttaggtgagcacgtaacccctctttaagcctactgtggcgccagcctgccagctgtgtggttttggcaatttaccygccctctcaatgactctgattcctcatctgtgagatgtggataacaataatagtcctggcctcgatacaatgcgtgaggcaatgtgcttgtgaggacttggtatctgccacgtggtcaatgactaggagctgttgctgttaaggatgcaaacgttgacacacgtcttcattaaattcttaattaaatgtccttctcacgttactaccgatggtttctagtgactgaaaatgtgtgcagtggagggaaaggcagactattttaattaataagctttatataagttttattaaatcatgaaa

SEQ ID NO: 149950 - DNA, 601 bp, Human
caccatgtaggagttcaagatgctaaagacccaggaaccaggctcttttgagacctatactcaggcctaggctacaagagcatgtttgtgtttgagaggcattaaaagagtaacggaaagagcactgggctttgtgtagaatccctccactcaaccacttatgagatctataagcctgagcaagttaactgacttctgagcatcagtttattaatatttaaaatagacacaaggcctggtacagtggctcacgcctgtaatcctagcacttcgggaagccgaggcaggcggatcacgtgaygtcaggagtttgagaccagcctggccaacatggcagaaccccatctctactaaaaatacaaaaattagctgggcctgttggttcatgcctgtaatcacagctactcaggaggctgaggcatgagaattgcttgaaccaggaggcggaggttgcagtgagccgagattgtgccactgcactccagcttgggtgacggagtaagactctatctcaaaaaaataaaaagaaaataaaatagatacaataatatctacctcataaagttgtgatgagtgttaaacaccatcgttaacacatagt

SEQ ID NO: 149951 - DNA, 601 bp, Human
tgtttgagaggcattaaaagagtaacggaaagagcactgggctttgtgtagaatccctccactcaaccacttatgagatctataagcctgagcaagttaactgacttctgagcatcagtttattaatatttaaaatagacacaaggcctggtacagtggctcacgcctgtaatcctagcacttcgggaagccgaggcaggcggatcacgtgacgtcaggagtttgagaccagcctggccaacatggcagaaccccatctctactaaaaatacaaaaattagctgggcctgttggttcatgyctgtaatcacagctactcaggaggctgaggcatgagaattgcttgaaccaggaggcggaggttgcagtgagccgagattgtgccactgcactccagcttgggtgacggagtaagactctatctcaaaaaaataaaaagaaaataaaatagatacaataatatctacctcataaagttgtgatgagtgttaaacaccatcgttaacacatagtaagggctcaataaattttcccctttcccagtgtaatctcatctttttcaagagtagaaatagctcacctggtaaacccagaaatagta

SEQ ID NO: 149952 - DNA, 601 bp, Human
gaaataaagcctcattcactaatagagcattaagctacccagccaacccacgcagaaagcaatttcgtaacatggattcaggtagtcgtatcctctgaggtagcagttccctttctctaaaactacactaaaaaaaaaaaatcccagatgtaaaatagccttcatatattcatcatgatatgcttcataaaagtgaaaaatgccaaacaacctaaatgttcaacaatagagtgaggacaaagtaaagcctgatacagtgaacgaatctgatatcaggagacctaaaagtgatgtttatggkgaccgtatatggaaaagtatattctgtatgatttccatgtgtttaactatgtattggaacattctgcaaaagagacacacaaagtggttgcctttgctctacaggagaagaggaaacacataaaggggttaagaacctgggatctgagtccaaattgtctgtttttaaatcctagctctgccacttgagtatatttgactttaagcaagttttaagttcatcgtgattaggtttctccctcagtaagttagtggtaaaatagtaccctcctcctggggttgttgcaaggattaaatttgc

SEQ ID NO: 149953 - DNA, 601 bp, Human
acaaagtggttgcctttgctctacaggagaagaggaaacacataaaggggttaagaacctgggatctgagtccaaattgtctgtttttaaatcctagctctgccacttgagtatatttgactttaagcaagttttaagttcatcgtgattaggtttctccctcagtaagttagtggtaaaatagtaccctcctcctggggttgttgcaaggattaaatttgctgctaacctaggcaacacccagcatatagcaagagctcagtaagcattagttatttactatttatttcagtgatacaamcaatatgggcaggattttgccccacctttctgcgttttccaattcaacttttctccttgaccatattactgttacattggaaaaaagcaataaatatttacctgaaggccctgagagctgggtcagctggattttttttagccacgtagattaagattcttattagaatatcacagtttagagacaaagaatggatactttatggttgctaagacccaagaattgaaattggagttgcagtgacaattcaaatgaactttgtgtcccatttcataagaagttaagacagttcagtttccg

SEQ ID NO: 149954 - DNA, 601 bp, Human
ccacgtgggtgatgcatgtacatgaagctgccctttcaggctattttttgttttcctattttgatagagtcatggatacagagaaatatttctcttcaacaagagaactaagagggacaagtatgatgataaacggagagggacccaactacagaataatatggcaaaaggcaggcaaagagactattgagacaagggccagatcttcctgtttttcaagagtatccagaaatctcaaattttttaagaacctgcagattctttgatacaattcacgaaacaaaccagtgcaaagcaaacrcagtacacccattccaatgtaattccaatggcaggcccattccaaccctcagactaccaatatttgaactcaggtttgaatgtcagaatccaatcattggcagtcctgtgccaaagcttaactgataatgtggaattcactactgaacatcatgtttactgctgactaaacaaattgctattggaaagcctcttctctccatcttctgggtataactgcattgtgtagtagccattctggtcttttctgcaccagaaggaacactggagtaagaactcagaggtcatgctcccataggaa

SEQ ID NO: 149955 - DNA, 601 bp, Human
attgcctaacaaaggctctgggagcctgagacccgactcccccgctcttgtagtatttttaaatggctgggcgtcgtggctcatgcctgtaatcccagcactttgggagactaaagctggcagatcacttgaggtcacatgttcgagaccagcctggccaacatggtgaaaccccatctctactaaaaatacaaaaattagccaggagtggtggcgtgtgcctgtaatcccagctactcgggagtctgaggcaggagaatcacttgaacccaggaggctgaggttacagtgagccaagatygcgccactgtagtccagcctgggtaacggagtgaggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggatttccacaccaccagaacacctatcccactttggaaagcactgatctggtggtccagacattcctgcagtgtcc

SEQ ID NO: 149956 - DNA, 601 bp, Human
gggagcctgagacccgactcccccgctcttgtagtatttttaaatggctgggcgtcgtggctcatgcctgtaatcccagcactttgggagactaaagctggcagatcacttgaggtcacatgttcgagaccagcctggccaacatggtgaaaccccatctctactaaaaatacaaaaattagccaggagtggtggcgtgtgcctgtaatcccagctactcgggagtctgaggcaggagaatcacttgaacccaggaggctgaggttacagtgagccaagatcgcgccactgtagtccagcmtgggtaacggagtgaggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggatttccacaccaccagaacacctatcccactttggaaagcactgatctggtggtccagacattcctgcagtgtcccttccaaatgactgtccag

SEQ ID NO: 149957 - DNA, 601 bp, Human
atcccagctactcgggagtctgaggcaggagaatcacttgaacccaggaggctgaggttacagtgagccaagatcgcgccactgtagtccagcctgggtaacggagtgaggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggrtttccacaccaccagaacacctatcccactttggaaagcactgatctggtggtccagacattcctgcagtgtcccttccaaatgactgtccagcttcttcctgaacatatctaaagacaagagctctttggaacccatttgtccttagaaaactctaacaatacttttttttttatccaaaataaaacaaataaatttaaaaaccagaaaaacaaaacacaacacctgcctctctggtcctctcctctccatgtgacaagctctatgatgtgtcacatattatttgggcagcttcttttc

SEQ ID NO: 149958 - DNA, 601 bp, Human
ggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggatttccacaccaccagaacacctatcccactttggaaagcactgatctggtggtccagacattcctgcagtgtcccttccaaatgactgtccagcttcttcctgaacatwtctaaagacaagagctctttggaacccatttgtccttagaaaactctaacaatacttttttttttatccaaaataaaacaaataaatttaaaaaccagaaaaacaaaacacaacacctgcctctctggtcctctcctctccatgtgacaagctctatgatgtgtcacatattatttgggcagcttcttttcaaatctatagaccaacaacttcagtcaaatgtgggactcaatgactgttgaaggcagtgagctagaatcaccagcaaagggctttcttaattaaaaataataaatgttg

SEQ ID NO: 149959 - DNA, 601 bp, Human
acgttgtattgaaaaaaaaaaaaaacagtatctaacgcagggaggaatttctttaggcttccctttcattctctataaaatgtaagtgataagatacctgtgtcacaaggttgttgtgaggatttatgcctggcacatagtgtgtgctcaattaatggtagctgttggcggtaagagtagcagcaagagctgtcttctggcggttcccattgtataaatgaaaattctagagcaagaagacagagcttcaagtcagggacacggaactaaggctccagatttcacaagtctcatttgtctktgatccctgaagcaaccactttcctattaaggtaaattgaagaaaccataaaattaatccggtaacaacatgggagccagcgagaattcctacctcattactggaagggataggtttctgccctgcggcatggaattcgattaccttatcacagctgcataattgtaaatattttcattggttatacaactgctgtgtcttttctgagaaactcagccccaatgtgtaacaccctggattccacggggcagcaaattccacacactgcacccatgttgtgagcggagattttcgggctga

SEQ ID NO: 149960 - DNA, 601 bp, Human
gtcttttctttttctttctttctttcttttctttctttctttctttctttctttctttctttctttctttttctttctttctttctctctctttccttttctctctctctttcctttctttctttctccccttccttcctttctttttcttcctttcttctttcttttttttttttttttgccctgaattgttttcctctcacctgagtctttcaccattaaatgcagaaagaaccagaggtggggccctgtgaaattcccaagaaaagtcaacctgaggaacatggcctcacaaatgggwagtaaaggagaaaaggtgcttgacaggctttcaacgacagaaaccttccctttcgaagggagcttgcaggaagggagccaggagacctgaggatctctgggctcatgcaaccttgctaccagagcaggaatcccctctccagcccctggaaagtggccatggagctcccctaaatggtccattcttaggtggtctcaactacgaagtctgtcttctgtgaggtccacctattggtcctaattgtgttatttggcacaattaggatggcagtctttcagatggtctcaggggagcacctag

SEQ ID NO: 149961 - DNA, 601 bp, Human
tggttaattctgacttggaggtttgtgcctaaggattggaggtggcaggttggggttggaggtggggaatacttccgaagtgagacactgtcttaggctcttctaatttctagagctcacattctgagaggatgcactgtcccatcagattaattgcactacatagaggtagtgcccagcttccaatccctgccccccaccccagagttctttaattaattgatctgaaatggagcttgggagttgacatttatttgtagttctctagatgattctattgtgcacccatggttgaaaactrccactttacagtttttctagaattgttgttttctggcgccacagtcccccactgttactactttagttgatacctttattagttcagataccccctcttctaggaagccttccctggctttcccctgctaatacagggtcgcagaggtgtagatacgtttccaccttatcacagttactgcatcacaatggaatgcactgttaacatgtctatcttcctcatagaggcttcttgaaggtactgtgtctttatctggcacattctttgcattgcctagaggacagagtctgcattcttggc

SEQ ID NO: 149962 - DNA, 601 bp, Human
tggcatctggagcaaagttcatcctgcctgagaagtgtaccatttttaatggttttttgtttgtttgtttttgagatggagtctcgctctgtcgcccaggctggagtgcagtgacgcgacctcagctcactgcaacctctgcatcccgtgttcaagggattctcctgcctcaacctcctgagtagctgggactacaggggcccgccaccacgcccagctaatttttgtatttttagtagagacggggtttcaccatattggccaggctggtctcgaactcctgaccttgtgatccacccgyctcggcctcccaaagtgctgggattataggcatgagtcaccgcgcctggctagttatttttaatcacaaaagcaatgcattctctattagaaatgacacatacaaatattgatgagcataaagtaaaaagtgaaatgctactctgcaaaggtaacaaccgttaacagtgctagacctgttgctggagaagcagtgtgtggtagggaataagtgttcaggctagaaggactgagttggaagcccagcgtggccacttcccagctcagtgaccttcgatgggctactttatctctctctgcc

SEQ ID NO: 149963 - DNA, 601 bp, Human
tctgcaaaggtaacaaccgttaacagtgctagacctgttgctggagaagcagtgtgtggtagggaataagtgttcaggctagaaggactgagttggaagcccagcgtggccacttcccagctcagtgaccttcgatgggctactttatctctctctgcctcagtttctttatctacacgatggggataatagtagtatctacctcattggattgttgtgaatatgcaagttaatacacattaaacatactgcctgacacacaatcgctgctaaaacatcggcactattaatctttcacacrctttgttaaaagcttacacacaaatataccattgtttttatgaaaacggaatcatatgtattgttctgtaatatgctttatttggatagtattctcctatgcagatatgtcttatcactgaatgattagggtatctctaatattctgctctttcaaataattctgcagtaaacttcagcatgtatgtatctttgtagtctatttctgaatgattgatgactaaaagcagagctgttagagcaccaagcatgtgcatgtaaaatccagagagatgttgctaaattacctcccaaaattatt

SEQ ID NO: 149964 - DNA, 601 bp, Human
accaagccagtttcctctcataaggcattggattaagagtggccagtagctgagttttgtgattctgaggataagtaataagtcaaaaagagctgttggctaatcctttagaaggatactaaaagaagagtaagatgatcgtaagcttcctagatccaggctgttaaaatgacctccatattaccaagacttgtcagtactgttaagggaaaaaagaggggaacccctatatataaaaccacaatcttgtttcatctataatacccctggtccccctccttcatctacactgccacccccmcctacacccaccacttgatcattttatagcagatattttattacatttttgaaaacaaaggaaacataagacaggtgtactattttaagattatattaacatatttcatgtttctttaatgccccaacacacacacacatacacacacacacacacatacacacacaccaagagctgatcacttgaacaaatcattaaccaattgacttgcttcccatttctggtataagcttctgtaccagtgctttatattaattaccaaaaccctcctgcagacagagcatgatacatctttagtat

SEQ ID NO: 149965 - DNA, 601 bp, Human
tttgtgattctgaggataagtaataagtcaaaaagagctgttggctaatcctttagaaggatactaaaagaagagtaagatgatcgtaagcttcctagatccaggctgttaaaatgacctccatattaccaagacttgtcagtactgttaagggaaaaaagaggggaacccctatatataaaaccacaatcttgtttcatctataatacccctggtccccctccttcatctacactgccacccccccctacacccaccacttgatcattttatagcagatattttattacatttttgaaarcaaaggaaacataagacaggtgtactattttaagattatattaacatatttcatgtttctttaatgccccaacacacacacacatacacacacacacacacatacacacacaccaagagctgatcacttgaacaaatcattaaccaattgacttgcttcccatttctggtataagcttctgtaccagtgctttatattaattaccaaaaccctcctgcagacagagcatgatacatctttagtataggatgatgcaataaaatgtttatgctgtgaaatttggggacaaaatttttcatc

SEQ ID NO: 149966 - DNA, 601 bp, Human
gcaggagaattgcttgaacctgggaggtggaggttgcagtgagccaagattgggccattgcattctgttaagccattgcactccagcctgggcaacagggcaagactccgtctcaataaataaataaataaataaataaataaataaataaataaataaattgcaatgtgaataatgaaacatcagtgaaaataagtagttttatattattatgtacttttgaagtaaaacgtctccccccaccccccatagcaaagagatataatagccaaaaccaaaaaggaaatacagtgggatgtcrttagtaataccttttgtttgtcttaggtgtgagaggattcttgctcttatccgtgtgatacatgttttggctaaagctttgaagtcataagatatgtagtctaggtattgtaattgtgcatttcatatttcaaaaattgtaaaattcaaatgttaagtctttggctacactaaaataattgttgaaatcccttaaaatgtagatggtaaactcatcagttataactttttgttgcactaaaatatgagtttatttctttagttgtagtgaataaaaataaagttaattacaaaagtaaag

SEQ ID NO: 149967 - DNA, 601 bp, Human
tggttgtcctgtgaggtggttggtggtgagggtgggcctggggggagacaactgcaacaggaggacctctggattacatacccaagttccctctcaggaatgtggatgctaaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttayttttaattcagaaagaaagtaaatatttgctttctggaggtaactgcacttgagtatctgcaaggagagcccctcaagttctgtttttggggatcctccccttttgaaaacactaatcggacctcaaaaccagattttatctttgaggactgacttccactgcctttttttttttttttttttttttttttttgatagagtctcactctcacccaggccagagtgcagtggcgtgttctcggctcactgtaacctccgcctcccaggttcaagcaattctcttccccagctgcccaagta

SEQ ID NO: 149968 - DNA, 601 bp, Human
aaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttatttttaattcagaaagaaagtaaatatttgctttctggaggtaactgcacttgagtatctgcaaggagagcccctcaagttctgtttttggggatcctccccttttgaaarcactaatcggacctcaaaaccagattttatctttgaggactgacttccactgcctttttttttttttttttttttttttttttgatagagtctcactctcacccaggccagagtgcagtggcgtgttctcggctcactgtaacctccgcctcccaggttcaagcaattctcttccccagctgcccaagtagctggaattacaggtgcctaccaccacgcccagttaatttttacatttttagtatagacaggtttcaccatcttggccaggctggtcttgaactcctgaccttgtgatct

SEQ ID NO: 149969 - DNA, 601 bp, Human
ttgccttttgaccatcaacaaaaaaggccaaagtgaagcttgctggaaaggctttgtaagccaaccattctcagtaattttggggttgtttcattcgtctttatttggacgaggttaaaatcagttgcacatttgtactgagcattttggagtcctgttatttgaattatccattatttcctatataattggagagttagggttaatgttttcttctatctcatgtcttgaattcccagcagaggctacacaaaatttacttctacttcatataccagtttatcatggtacagattattgstcatttttattcttgaatagagctacaggccaagcaacttcttgcattgatattgatgtcttctttcacatatgtaagtaatatatgtagtgattacaagacattccttttgttcattaaagaaaacccccaggagactctttggagtaagctatgggtaacccactgaatactctttaaagaagcaaacctatatcattaagggaaagctaaagatacgtaagttttttgaagttgacatcaaggagggcagcattgcttggctggtgcaactgccaaagacaggacagattattggtc

SEQ ID NO: 149970 - DNA, 601 bp, Human
tgaattatccattatttcctatataattggagagttagggttaatgttttcttctatctcatgtcttgaattcccagcagaggctacacaaaatttacttctacttcatataccagtttatcatggtacagattattgctcatttttattcttgaatagagctacaggccaagcaacttcttgcattgatattgatgtcttctttcacatatgtaagtaatatatgtagtgattacaagacattccttttgttcattaaagaaaacccccaggagactctttggagtaagctatgggtaasccactgaatactctttaaagaagcaaacctatatcattaagggaaagctaaagatacgtaagttttttgaagttgacatcaaggagggcagcattgcttggctggtgcaactgccaaagacaggacagattattggtctgacgaaggacaatctggaattgtaaagaacgctgatagaatattgcatggacaagtttagataacaagggctggtatttttcactaacacttggtttcctctgtgtgttttgctttttcagatttatcttttctgtgttgaaatccacacaagggacataa

SEQ ID NO: 149971 - DNA, 601 bp, Human
taagttttttgaagttgacatcaaggagggcagcattgcttggctggtgcaactgccaaagacaggacagattattggtctgacgaaggacaatctggaattgtaaagaacgctgatagaatattgcatggacaagtttagataacaagggctggtatttttcactaacacttggtttcctctgtgtgttttgctttttcagatttatcttttctgtgttgaaatccacacaagggacataaaataaccctcaaaaaaatataaacacaatatccaaaccttttggaaatttaaatgttawgtattattcagtaatgtctgcccactgtagttggacaaaaccacattcaggtctatgtgtcagctttgtccctcagccctgtgatttgcttttggtggctcagggccagctctccaagggcaagctccatgaaggcagacagtgcgtctccattttgatgaaggcttgcagtcaaggtcctcagtgtgtgttagagaggcatagagctctgcaagggtaagttcatgtctataacaataattgacctccctagtggaaagacaggattttcccaaggaaaatagtttgcggtgtcatatt

SEQ ID NO: 149972 - DNA, 601 bp, Human
agctttgtccctcagccctgtgatttgcttttggtggctcagggccagctctccaagggcaagctccatgaaggcagacagtgcgtctccattttgatgaaggcttgcagtcaaggtcctcagtgtgtgttagagaggcatagagctctgcaagggtaagttcatgtctataacaataattgacctccctagtggaaagacaggattttcccaaggaaaatagtttgcggtgtcatatttgtggtctctctagagagacaattccgtaagtggttcctaagccttggaaaattctcttttrcaatagtacccacaaataatgttcaaagagctatttttgaggaaaggattcctcacatttttgcaggtgtaagtcattcctgcctcagtggagtacaaagagtgatgtgagggaagcagagctgctggcaggaattttaaaagtatactatatttgtcccacattaactgtgcttctggggtataaaggtcagggatagaactggtcctgtgggatgtttctcatcgaaaccacctctattccaaagccttggtgtcactagccaagatgtatctattctaataaaatataggtctcata

SEQ ID NO: 149973 - DNA, 601 bp, Human
ttattccaatatttattgggaggagactaaaatcagctgtaagtgtatggtgaacattttggagttagggttaatgtgtaagccattctgcatttctttcatcactgagatttttatttaattaacgcattaattatcatgaagcttactatttggtgtctgcttatctctttttttgaggaccaagcatataaatatgcgaggaatagtgttttattattctaaataccttgccattattaagagtttttttatgattatactgtctcaatgttgaaagaaaaatttttaaagatttgcrtttcaatttttttacctataggcaagactgtaccactctgggcaacaaacttaagtttcagaaatttaacttaggaacttttcaaggaaatttgagatttgtgtcaagaaacctttttattaacgattaatgtaaaatttggaatacggttcttaagttaatgtgaacctgcaaaatctaccatttttgcctccataataagtcagaccttgtacaacttaaaaatgcattctgtcccacgtttcatgctgtcccttcctcagaatagtctgggagttcagcttttataacctttggttg

SEQ ID NO: 149974 - DNA, 601 bp, Human
tatttaattaacgcattaattatcatgaagcttactatttggtgtctgcttatctctttttttgaggaccaagcatataaatatgcgaggaatagtgttttattattctaaataccttgccattattaagagtttttttatgattatactgtctcaatgttgaaagaaaaatttttaaagatttgcatttcaatttttttacctataggcaagactgtaccactctgggcaacaaacttaagtttcagaaatttaacttaggaacttttcaaggaaatttgagatttgtgtcaagaaaccyttttattaacgattaatgtaaaatttggaatacggttcttaagttaatgtgaacctgcaaaatctaccatttttgcctccataataagtcagaccttgtacaacttaaaaatgcattctgtcccacgtttcatgctgtcccttcctcagaatagtctgggagttcagcttttataacctttggttgcccttggaaggtatttatggcttggatgggctttgttcataatcactgtgttcttgtaggataacccccctggccttcttgtgacactgagctactgataacaacttctcacgt

SEQ ID NO: 149975 - DNA, 601 bp, Human
gacgaggcctggtggctcatgcctgtaatcccagtactttgggaggccaaggtgggtggatcacctgagattgggagttcgagaccagctggaccaacatggagaaaccccatctctactaaaaaaaaaatacaaaattagccaggtttggtggcccatgcttgtaatcccagctactccagaggctgaggcaggagaatcacttgaacctgggaggtggaggttgcagtgaactgagattgtgccattgcactccagcctgggcaacaaaagcaaaactccatctcaaaaaaaaaaaaaaaaaaagattctctatctctattccgtatctctatccacacacacaaaaagggacaattggcataaattcctatttttaggcttcccaaagaaaaacacaatcctatgttctgttggctgacaagactaagattaaaaagtgacataaagcgtaggactgcagcctttctatagtttattatttgtctcctgaaaaggaagatatttgtatttcttttaggaacttcactccaacagatttattctaaaacaattcctgactgtgttgaaataatgaggtacagttcactttgagaaaata

SEQ ID NO: 149976 - DNA, 601 bp, Human
tattgcaccctactgccaatttatgtggttggcttttttatctttttaaacaggcaaagagagctttgccatgcttttcctggaaagattcactgattcaatccttcagctaatatttggtggaatgcctactaaagccatggcatgcaattctgccgtaggacatgaagtcgtgtgtgcctgctgttgaaagcagtgagtgttacatgagagttttctgattgccagctagtttgcttccctgacaggcatttccagatgtgaggaaagatttattttggcactcccagctccaagtggmgtgagcgcacacacacatacacacacacacacacacacaacattcactctccttcagtgcttaggatcatcatcctctgccttcaaagttggtaaattgagtttgcgctacagcagaatagctggctgttggtaactttcaaggggagaaagggcatctctccctcccctgcagctgagtacaacagcttaaaaatagaacaatgtgtgtttggtgtgttcttttcatcctctgcatcaataacaggtgtacagttacagacacaaagagctagattcacgtcttctgaagcctccagag

SEQ ID NO: 149977 - DNA, 601 bp, Human
ttggttcttaagaacacaaacttctggagctaccagttgcagcattgactagctgtgggagaagtcactttggcattcagggcttgtttatggagtggaaataatagtagtgacagtaataaacatgtttgttgtatgtgcctcctgggggacctggaggtgagctcacggggaatcatggctgtgagtgtggtctatgtgaatctataggcattggctaatgtcagtgactactacactctgagattctgctttaatattataaacaccaacttcaaaagcccttttggcttctttgccrgagagtatcaggtgtaaggtctctctttgcacttgcatctagtgtctgcctagagaggatcatttcctcagcctcggcttggtcaaatgatggcattctcactggctgtgccctggctttgtcactaattgttaggcagtttcagagatcgtgttgcatgttacttcaccccgtttctgctgactggctgcctcctgagtgctgcttactgcagttcatagatgtttctgaaaactgcttatgggtgaccctgagtaaacaattaaaagtcactgtattttctatgttagaattaaaaaa

SEQ ID NO: 149978 - DNA, 601 bp, Human
tacaaagtcaggctaacagtattcccacaaaacatcttgtaatagcttcatgtgctatagggaatttttttgtttaaaaagtgctccctttctataatcactttttggttgtggaattcctgaaacaatttgttttggttattctgaaaaattctgaatcttccctaatacctttagtaataaaataggacctgataaaaatcacgaagtgtctttgaatctggctgaatatctagacttaatgagtgtttaaggctccatgtcaacctgcaaagatacctggtgaagcacccttatgtayttttctaaaaaaaccctgccctgttccatactttaatcaacgactcaacaacatagaagtcatctacatagtgttttcatacgacataagcccaaaaaggatggcttccactgcatatgcctgtgatcatgattcataatgatttcaataggctgcaatgctggatggaaaccaacatgatgaagttgagcaaggaataagtgtacatttctgcttttagattcaaaaggcaattgcgcaattacaggatggggaacaactgagcttggcagcagttcatgtgactaaaggcttaatgtg

SEQ ID NO: 149979 - DNA, 601 bp, Human
gcagagtgaccattgttagcctccaccttgaagggttgttaggaggataaaggaggtgaagcactcagcacagtgcctggcagtaggctctaatttgactgagttcttatggtttacaatggtgttccaaggagcccttcagagctaaaaatccttttttaaaagcaaaaataaaaacatcactgtcatcatgccacatattattaaggcatcacgtatgttaatttattgaattctcaaaaacatccatttgccaagagagtgagggattacataccttgaccagtcacaagctgataartggggggagccaggattcaagccaagcagccctggagttcatgttgatgacaaccatttccttccagttcgtaccaacacgtttctgttttcctccaattccattccaaatcaccccgctagataatttgatgtgttttatttgtttaggccagtttcacaatatttttttaagtcctgttgactgtaataaatacatcaaaggcttaatgtttatgtcctttgccagagtatcaagaaggtccttaataaatgttgaaagagtgcacgaataagtgaaaaattttaattgtaggagtaa

SEQ ID NO: 149980 - DNA, 601 bp, Human
atctctggatttaatttaaaaaatagacaaagtggtggctcatgcctgtaatctcagcactttgggaggtccaggcgggcggatcacctgaggtcaggagtgcgagaccagacaggccaacgtggcgaaaccccgtctctactaaaaatacaaaaattagccaagcgtggtggtgggcacctgtaatcccagctacttgggaggctgaggcaggagaatcacttgaacctgggaggcagaggttgcagtaagctgagatcatgccactgcactccagcctgggcaacagagcgagactccrtctcaaagaaaaagaaaagaaaagaaacaaggtgaacatgttttattcactagttgcttttttttctttaaagaaatacatctgtttgaaaaatcttaatttcagtttcaagcaacaaacaacttcagtccatttcagagtgctaacgttggaatctggttccagaatctttgcagagtgtgggtgggcacaggtgcatgtggctcctttggccataagaatctgctgcttcccagcctcatgactgggcctggagtcacactcctgcttcagctgttctttggcaaagcagggccagaa

SEQ ID NO: 149981 - DNA, 601 bp, Human
ttgggaggctgaggcaggagaatcacttgaacctgggaggcagaggttgcagtaagctgagatcatgccactgcactccagcctgggcaacagagcgagactccatctcaaagaaaaagaaaagaaaagaaacaaggtgaacatgttttattcactagttgcttttttttctttaaagaaatacatctgtttgaaaaatcttaatttcagtttcaagcaacaaacaacttcagtccatttcagagtgctaacgttggaatctggttccagaatctttgcagagtgtgggtgggcacaggtkcatgtggctcctttggccataagaatctgctgcttcccagcctcatgactgggcctggagtcacactcctgcttcagctgttctttggcaaagcagggccagaatgaactggtctttaacattcatatattgctttcaacttctatgaggctttcatttcaattccttttcttctgtgagggacaggccttccttgggaagaaaggtcaccccttgagtctgacatgctctgcagtcagtttgagaagccttttggttaattttggacaagtcaagcctggtggtggaattcggtcccat

SEQ ID NO: 149982 - DNA, 601 bp, Human
gtcatgcgggaaggtcttttcgctaacaagaaacacaatccaaagtaaagacagcttttgtggaaattgcaaactactcatccagtggtcagttgtaaatcatgattcttttggaaagaaagggagacaggctggggctctggccctcaaagaacttcctctcattaaaccaaagcaatttgctgctctccccaggctctttctgtgcgtaaattcacctacttttcccgccaccatcagtggtcctggtgctgctggtgaatgggcatcatggggagacagggctttccacgtgatagargtttctttccaaacccaggctttacaggtagatccaagggtggctttcgtcagcctgttgcccccactgcccaacacacactttgctttttgctgctattttctgcggtcctgggtttctaaatcttggcaagaggacagtcattcctttgtgctcggctgttacaatgaggtagccagagaaagggtcttggtctgaggctgtcagctgttactaatcacgactccccggcccatggtgggtcccgctcgcctctccctcttgctctgcttagcacacataaagaagatgaattactct

SEQ ID NO: 149983 - DNA, 601 bp, Human
catggtggtgagtaataagtggaagttttccagcctcctggccttcctgagcagcttagggccaccttgccgggaactcattcccagctctggaaatgaaactccgggtgccgctgggtttgcattgacactctttccccacaaggtttgtctcttgttgttccagacagaatgaacctcattattttggattaattgggggaagatcaaccaaaattagtgagtcagaattaaagagtgttttaaacaaaagcaactttagaatttgtaattcatatagtaacccaatctaagtgttagaaaaaaaaaaaaagcatgtggcctctatccagcatagcaacaaaaacactaataagaatggctggttattcaaaaaaatgattattgagcccctctatgtgcagacactatgctaggcactgaggccactgcaatgaataaaacagatggtcccgctctcttggcactaaaattctggtagcaggagacacagaatgaacaaaactgtcctttatcaaggacctactttgtaccctgtaaatatgttttctctaatcttgcaatgtagatattgttagtgtattttctacatcagaagtaa

SEQ ID NO: 149984 - DNA, 601 bp, Human
gtgaaaaccctatgagggagcttctatttttcacattccacagaggaggaaactgaggcttggagaagccacatggtaccagagccaaaagtagaatccaggtattctaacgtcagagtctgaactcttaaccactgtgccactgtctcttagattacattccgaggctatcactggcttactaactgtgatgcaaaattgtgacataatcattctttaccaacaatttggaatctaacttttaatgatttgtcttcggttccagaacccttagaatcatagcactttgcagtgtttttayaagctagtctataaaggggccagaagaaaatatttttgcacagaaaaacaatatagttctagagagagatttgaagtgactttctttgtgctccctccccacccctcactgcctttcctgggtgagttttttcaccctcctcctcactctcttcctaggatggcagtgtaccctggactcagcagtgggcagctgcctaggacacacggccccatttttcaatctgtaattatgaagtatattgtatttttagagtttgattttcttattaaaaaaacttatattcacatgaatatggta

SEQ ID NO: 149985 - DNA, 601 bp, Human
attatacaattgtcatggaattaaatgaccattaccatcaatcaaagataggacttagcgagtgagtctttggaccacataaaagttaactcaaaatgtacaaaacacacacacaaatgtgtcattgtaagtgaaagagccatcatggtacttataacaatagtacaatacagtatttctttggatttcaggggggtcttgattctgaaggcaggttgttttcataataaagatgtcatgatgtcttgaattgggctagtttagctaagcccagatcaaatgaagaaaaagaaactagtcragatcattatctttaccacttgctctggaatgtgtttctcaaatatgtatttagatgaatgcatggctgtcgtaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaag

SEQ ID NO: 149986 - DNA, 601 bp, Human
accacataaaagttaactcaaaatgtacaaaacacacacacaaatgtgtcattgtaagtgaaagagccatcatggtacttataacaatagtacaatacagtatttctttggatttcaggggggtcttgattctgaaggcaggttgttttcataataaagatgtcatgatgtcttgaattgggctagtttagctaagcccagatcaaatgaagaaaaagaaactagtcaagatcattatctttaccacttgctctggaatgtgtttctcaaatatgtatttagatgaatgcatggctgtcgyaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagcgtgggaaagtgat

SEQ ID NO: 149987 - DNA, 601 bp, Human
tgcatggctgtcgtaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagsgtgggaaagtgatgccctgctcatttggggttttgtcttccagagttcttcctccattttcctgatgccaccagtattaaggccattgtgtgtgaacagattgcacacatctgtcctgctgttgccctgatgacagtgtactgccttgttcctggtggtctcatttgttttacaagctagggtacctggaacagaggtggtcaagtaactctgtgtgggacttcgatcctcctttaagggaaggacctacatggagatgtgattaatgaatatacctcccttacctttcttggctgaaag

SEQ ID NO: 149988 - DNA, 601 bp, Human
attcaaatacgaatgaaattataaattgaaggtcatggcttcaatttccacttaagctaattacctttgtattaagatttttgagcaaacccaaccagttatctggcaatcgtagacaccattttaatcagtactttaccttctaaatatgcaaatatttagagttcacacaaactctaaatatgttcatgtgaacagggccactacctgaatattaaaccaccattagaatctgatactcgtcattgaaatacagcataaccttttaatacatttgtggaaacaccattttaaattgttaaaaaaaaaaaaaactcaattaactgtaattggattacactataattggattttagtgggattggggaggataaagaatgaagaaaagtgaagatacagctaataaaacagaagagctcatattaatatagataatttaatcttttgagagttttttgtcttttccaatagtttttcagcccaaaaagcatggaactgtgttccattagctacagcctttaggaaaaccttaaaagtcatgcctccttttttctctaggatgacaccttgcctgaggcagactttgaagatgttctgaaaa

SEQ ID NO: 149989 - DNA, 601 bp, Human; identical to SEQ ID NO: 29434

SEQ ID NO: 149990 - DNA, 601 bp, Human; identical to SEQ ID NO: 29435

SEQ ID NO: 149991 - DNA, 601 bp, Human; identical to SEQ ID NO: 29436

SEQ ID NO: 149992 - DNA, 601 bp, Human; identical to SEQ ID NO: 29437

SEQ ID NO: 149993 - DNA, 601 bp, Human; identical to SEQ ID NO: 29438

SEQ ID NO: 149994 - DNA, 601 bp, Human; identical to SEQ ID NO: 29439

SEQ ID NO: 149995 - DNA, 601 bp, Human; identical to SEQ ID NO: 29440

SEQ ID NO: 149996 - DNA, 601 bp, Human; identical to SEQ ID NO: 29441

SEQ ID NO: 149997 - DNA, 601 bp, Human; identical to SEQ ID NO: 29442

SEQ ID NO: 149998 - DNA, 601 bp, Human; identical to SEQ ID NO: 29443

SEQ ID NO: 149999 - DNA, 601 bp, Human; identical to SEQ ID NO: 29444

SEQ ID NO: 150000 - DNA, 601 bp, Human; identical to SEQ ID NO: 29445

SEQ ID NO: 150001 - DNA, 601 bp, Human; identical to SEQ ID NO: 29446

SEQ ID NO: 150002 - DNA, 601 bp, Human; identical to SEQ ID NO: 29447

SEQ ID NO: 150003 - DNA, 601 bp, Human; identical to SEQ ID NO: 29448

SEQ ID NO: 150004 - DNA, 601 bp, Human; identical to SEQ ID NO: 29449

SEQ ID NO: 150005 - DNA, 601 bp, Human
cgcttccggggctgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagmttttggtttgggtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaa

SEQ ID NO: 150006 - DNA, 601 bp, Human
tgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagcttttggtttggrtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaataagaaccaaga

SEQ ID NO: 150007 - DNA, 601 bp, Human
gaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataaggttagagccgttacagtggattttaccgttttgtgctttgaagaattttggttgggaagtgatatttatgaaacaaaaggacactaataccaccacatagtctttgttttttaacagaaatgtgtttgttcaatggtatagtaagatatcaccagcatttttttaatatagaagtgtgtagttgaattagactaaatggtctcaaaaattgaaacaagtaacaactccttaactgta

SEQ ID NO: 150008 - DNA, 601 bp, Human
tttacaaagaaaggcagtgcatggtatttgtcccagaagctatggttggctgacccctgctcagtatcagaaaaaatgtacagatgacagatattgtggttttgcaacctgtctgatccttgttttaagatttctatatttttacacatagtcatggagatgaaaatgtgaagtcttttctttcaacagcggccaataagtattttgtttcattatatctgctacttttatattgtaaaatagaagaaaactgcctacatgcatagaattactcaaggaaaataaaatgtgaagctctgcattattactccatccataagagcatgaaatagtattattttagatattttatttacctagtctttgtgtccttaaatttaaactttattgtgcattaattatgtatttgggttctctaggtctcggtgattcagaatacacctacttttgcaatggggggaagataattgataaacgacttcaagagcttggagcccggcatttctatgacactggacatgcagatgactgtgtagggtaagggcagtgttctctgtttactccaataagccctctatacatgatggaagttgatttgtaa

SEQ ID NO: 150009 - DNA, 601 bp, Human
gctgattttcttttgtgtccatctcatccttgtcagtatatgctaacggcaagagttagaaaaggtgctccagtacagttatctttattttaaacagtgtaggtatttgcagaaatcagcttgttctttaggaactttaatcgtgcatgtgcttctctctgccatgcacgtggagcctttggattgggctctttacatggagggagcctggtgagccacacttcgctgttagagaacacaggtctgtgggccttcgctgcaggctgcattgcttggcgtgctcttaccgtctgaacggccrtttgccaccatgccaatcagacgtttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttg

SEQ ID NO: 150010 - DNA, 601 bp, Human
ttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgcygaactcacccctgtgcccacttcttccgtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctct

SEQ ID NO: 150011 - DNA, 601 bp, Human
acttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgctgaactcacccctgtgcccacttcttccrtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattaaaat

SEQ ID NO: 150012 - DNA, 601 bp, Human
ttccgtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattraaatgcttgactgtatatttcagtagactatagtgcttagattttcaacctaactaccttacttgaatttttcctttttctgaaatgaagatattttcaagacattcttgcttgatgtgccaccacactaaatggggttacgaatgcacacttgagtccaatacctgggttcaaatccttgatcccccacttactgactgagatcttggttgaattagttaagctttttgttccttggtttttgcctctgtgcaatagataacagtaatctatttactgtgtaagcttcgtaggagggtc

SEQ ID NO: 150013 - DNA, 601 bp, Human
ttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattaaaatgcttgactgtatatttcagtagactatagtgcttagattttcaacctaactaccttacttgaatttttcctttttctgaaatgaagatattttcaagacattcttgcttgatgtgccaccacactaaatggggttrcgaatgcacacttgagtccaatacctgggttcaaatccttgatcccccacttactgactgagatcttggttgaattagttaagctttttgttccttggtttttgcctctgtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgta

SEQ ID NO: 150014 - DNA, 601 bp, Human
ttctcttcaaaggctttcattttctctgttgatttattggtgtaagtattaaaatgcttgactgtatatttcagtagactatagtgcttagattttcaacctaactaccttacttgaatttttcctttttctgaaatgaagatattttcaagacattcttgcttgatgtgccaccacactaaatggggttacgaatgcacacttgagtccaatacctgggttcaaatccttgatcccccacttactgactgagatcttggttgaattagttaagctttttgttccttggtttttgcctctrtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccga

SEQ ID NO: 150015 - DNA, 601 bp, Human
aatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacarcctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctggg

SEQ ID NO: 150016 - DNA, 601 bp, Human
tgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaartaaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaggtgcatttgatggatggaatgagcatttgcagcattatggtagccttggattttggttaagttctgttagcattagtatgcctatttaaaattatatcttcttaaaataaagtttaccaattctggaatattaggaggaattctattcctgtcatc

SEQ ID NO: 150017 - DNA, 601 bp, Human
tctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaaataaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaggtgcwtttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttttacctttatacatactcatgttttcagctacggtgctaatgaacacataatatatcctgcttgttaaaacttaatcatgaagtattttttgtattccgaatggtcttcat

SEQ ID NO: 150018 - DNA, 601 bp, Human
caaggacttggcattaatccatagtgatttcttggtgatattttaatctgtaggaaacagatcagtagatcagtaaattggctaggcaaaaaaaaaaaaaaaaaaggtgcatttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttytacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagagg

SEQ ID NO: 150019 - DNA, 601 bp, Human
taatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctygaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggtaaggaagtttttctttatgctatagatgctatttaatcatgg

SEQ ID NO: 150020 - DNA, 601 bp, Human
ttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctcgaggacagacctygtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggtaaggaagtttttctttatgctatagatgctatttaatcatggatgtttgctttgg

SEQ ID NO: 150021 - DNA, 601 bp, Human
taataatgtagttaaaagatttaacaaatctgaagtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcrgcaggacctgttaacgagcactgtcacttggatctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttcacttgggaggggatgtcctgacgtgcaccaaactgttagaaccctaaaaattgtgctggcactgcaggccctttaattgcata

SEQ ID NO: 150022 - DNA, 601 bp, Human
agtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcggcaggacctgttaacgagcactgtcacttggayctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttcacttgggaggggatgtcctgacgtgcaccaaactgttagaaccctaaaaattgtgctggcactgcaggccctttaattgcatagggcatgggtcttaccaaagaccgcactgtcct

SEQ ID NO: 150023 - DNA, 601 bp, Human
gctcctctccatatggtacctttctgccatgtggaagtattacctctaataaccagagggtcttctgggttgtgtggtagagcggcaggacctgttaacgagcactgtcacttggatctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttyacttgggaggggatgtcctgacgtgcaccaaactgttagaaccctaaaaattgtgctggcactgcaggccctttaattgcatagggcatgggtcttaccaaagaccgcactgtcctggccactcctcgttgctcattcagtctgatagcacgatgcccctgatagagtaggctagtgtggtgctttgcaggtgttccacatttattcagactcttataacagcaggcaggacttatgatagccctggggcataattgtaaatttatacattgttccagcgcaaagtgaactgtttctgat

SEQ ID NO: 150024 - DNA, 601 bp, Human
tctcaggatgctattttgtttctcttgttctatcttggtgtttagggaggaggatggcgtcaaattcagagacttcttcttggccctccccatgatgatagatcttaacgtcataggccaataattcggtgttgccctgtgccagctgctgagtggccactggaggtcctgggccaggacgccatttaccgcctggcccccatgtgccttgctgtcatagatgagctatgctgatgctttgggtccctgggtaacaacattcatttgaaccccctcttaacagaccctggaatgtttgcayattccccttagcccagtgtacatttcccctttgggagaaggactgcagaagccattgtcaagtacagtttctatagtgtctcacagtccctcctcctagggacctcttctctcctacagtcagtgggttgcaggtctggaaacagggcaaaggatcgtttttattggagcagcggcctacagctccttttacatgcctccttgatttcttttcattgtaaggattgatccagtgcctttgtgggctgcccattttttacatctgtgttctgccctcctcaatttaggacctcagctgtgt

SEQ ID NO: 150025 - DNA, 601 bp, Human
acaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttasttcttaattggtgatttgtcctttaagctttttgcattttttttcaagtgcgagtgaattttagcagtagccccccaagtcccaccagtcttctcttctgctgtttctctctagttctcaagcacctgatggatcttgcaaggtgatgcatttgcttccactggcactccctgctacttacggttgcattgttgctgtgtgccagtgccgtctgtctgctctctcactggtgtggtgttctcattgtcaaacaggcagatgatccagctctagactccattttagcatctttcccaggct

SEQ ID NO: 150026 - DNA, 601 bp, Human
ccaggctaccctggcactgactgtcacaggctggttcccaggagtcaaacaatgagatgtttttagggcatcctcttgacagcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggyaaggtgtgacctaagaatgctgaagtgtttctttcaggtggcagaggtagtcattgtcagcactgccatagcctttgcagaaggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtc

SEQ ID NO: 150027 - DNA, 601 bp, Human
gcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggtaaggtgtgacctaagaatgctgaagtgtttctttcaggtggcagaggtagtcattgtcagcactgccatagcctttgcagraggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtccagtacaggagctgctggccacatatagctactcaaatttaaattaatgaacatttgttaagattaataattagtttctta

SEQ ID NO: 150028 - DNA, 601 bp, Human
attataaagaactgggattttttgcagttttccaagacctactgtgtccagtacaggagctgctggccacatatagctactcaaatttaaattaatgaacatttgttaagattaataattagtttcttagtgacactacctgtatttcaccagccatatttcagcagccatatgaacagcattgccccacactagggggttcctgtgaccatctacacacatgttgcattcttaaacatctgtcacattcttcaagatctctccttcctgaaacatttgcagacattctgtttcccttgaygtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctgtggatcttgcgtagtcactaattgaaagaagggtataattgaaaattgcacttacgttttgtcacatttgtttttcaaggaggaaagccaa

SEQ ID NO: 150029 - DNA, 601 bp, Human
catctacacacatgttgcattcttaaacatctgtcacattcttcaagatctctccttcctgaaacatttgcagacattctgtttcccttgacgtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctrtggatcttgcgtagtcactaattgaaagaagggtataattgaaaattgcacttacgttttgtcacatttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgct

SEQ ID NO: 150030 - DNA, 601 bp, Human
ttattgaaaacaccataggaccttactttgtagagaacaaggaaggtctgacttccattctttaagtatgataaaaggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggtaacagccctgatgctgtgacgttggggtgttgtgggccagtggactggagctgatggtgagagtgtggctctaaggttcagggtcctgtgtgttggccgcacagatgcctggggctcagctgcgca

SEQ ID NO: 150031 - DNA, 601 bp, Human
ttaaaacaattgtgtgtttttttttttgaaattctattttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaargaagaaaggtaacagccctgatgctgtgacgttggggtgttgtgggccagtggactggagctgatggtgagagtgtggctctaaggttcagggtcctgtgtgttggccgcacagatgcctggggctcagctgcgcatcaaggtctgggaacacaggcatacgctggtattggtagtttcttaactttcatgttaattgcactgaataagaagataatggatgttctaattattggacatttgtggacatgaaaactgagtgtaaatgtagtttttgagaagcattggcctaggttatttt

SEQ ID NO: 150032 - DNA, 601 bp, Human
cttctcatagtatgtttgtttttgctcatttattatataaaataattgctttttccataattaagagaagttatttatttttcaaaatataaatatattatttacttagaatcttgaagtagtcctaaattgattttttgagaagaataatgctaatggagtactgctgtctttttagctttcatttccttaattttaaataattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactacagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaaca

SEQ ID NO: 150033 - DNA, 601 bp, Human
atctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactmcataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctcccggaagtggccattaatggataaaatttttcaaatgtgccttgccacacttgtattgtcagtgagcataaagagtgttgtaattaggccgccatctccccagtgtggttttcgtgtcgttttattaatg

SEQ ID NO: 150034 - DNA, 601 bp, Human
cttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcagcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatstcctttcccatagtggtaagtagttatgcctttaacatttgcatttttctttggtgacaccaaaatgtatattgtcctttttactcttgggccagcaagatccttttcgatgcccagtacaattaaaggcacccttctttgcaagtcagggcctgatttctcctcctttttcttagtgttttttccacttaggacctccccaaaatggtaagaccgtgttgctgaatgaggctgctcttctcaccatcctgtcctcaggctggccctctcaccctcttcagtgaagtcttcgagaaccat

SEQ ID NO: 150035 - DNA, 601 bp, Human
cttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcctccacatgcttcctgtgtccgtgtgcccagccaccttcactgagtggcagccggaggcaggggagacagaaaagttccactataaaacatttgatgagtccgggcgtggtgactcactcctgtaatcccagcactttgggaggccgaggygggcggatcatgaggtcaggagatcaagaccatcctggctaacacggtgaaaccccgtctctactaaaaatacaaaaaattagccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaatatttgatgagcactggcttataggattctccctgtggccttcattccattgca

SEQ ID NO: 150036 - DNA, 601 bp, Human
ccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaatatttgatgagcactggcttataggattctccctgtggccttcattccattgcacagcctctaccgttttcccgtctggctctctgttttgcctttcagtaataatacaagaaggtgcaccattcttttggttgaaargggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagt

SEQ ID NO: 150037 - DNA, 601 bp, Human
tgtctgtgtatctttgcagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactrtcataagaaaatttatgctgttcttgaattttaaaatctctattgcaagagcagaaaactgtttacttccatgtactctttaactagtgtgtgtattttctgaatgtataaagcatgaattttatatagtacggtctttgcttgtcctattcatggaaaagaagaccttttatgttgatattcttggtacattggcctggggaggggtggagaactgtctaggaagtatttaaggggggtgatgagagacagtctcattttatgtttaagatgtatactgcctctcaaataagtagtttt

SEQ ID NO: 150038 - DNA, 601 bp, Human
tttgttatctgtggtgtctgacatctgaacttgtgccattattgagaagacatatggctgtaaatacttttacaacacctaggagtaaaaggttatgtgattttctcaacagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaagtcctctttcttcatagtaatgaagaaatcagtgattsacttggagtgttgtcttaggagaagtttggtttctttattagagttgaaaggttcatagacctcaatagtggggattaggacttcttgggatatacttgagaggataagggatgattgctgcttgaaattgccgtttaacttgatgtttttccagtctgctgcctggaacagagagatgctttattgtgttctctatacatcatgtattcattatacatcaaaatattaggaaccttacagaaactttcttttttgagaagaaatattatagtactgatatacaagtatatgtcacttgg

SEQ ID NO: 150039 - DNA, 601 bp, Human
tatatgtcacttggtgattgtataaagatagcagatgatctccagaacattaaaaacaatgtgtgtccatcatgtatcgtaaacactaaacatgggtgcctttcacctactcctcctttcctccctccctctcttcgtccttccttccccattttaacagatttttattaactatccaatctatatgcagtagaagtgcagatatgaaggatataatttaaaactatctgaaattacctgtgcttgtgttgtgttttattacaaattatacagaatgttgacttttgcaagacctatcacmcaccctgccctactatggcggatagtacagttattcacagattaaccctgccactgatgttcagcctggctgtgtgaacagaaggacatctgccacatctaagcaggagcactaagcctgtgggcgtggtgtagcttggctctcttcttcctatctgccatgatattctctccacatagaccctcaagtgaagcagtcccacagccttcgaggaagagagccccagaacgtagaaagtgtgctgttgtcacaggatctttgtacatgtgtttttcttttctgccaggaatatgctctggc

SEQ ID NO: 150040 - DNA, 601 bp, Human
taagttccgtaaagacaggggcgttgttttgttcatttctgtatccttaatgcctgtcatggtgaatactttcagtaaatctgttaaatgaatgaagcaaagaaggctaatgtaatgttaactagtttcattcccaagtaagagcagtaatgagacacagctttgccattccttcatttaaaaggtatggtgttcaggctcgtcattacttcctacagtcgtccttgagttaaaagttaaaatgtatacagttacaccaccatgcaaggtggaggggaatcctgtcattcttaaatcttgrtatcagtatgacttttgcatatgacagtgaaactggaagtgaaacatactcagattgattcagaaatatcttttgaaattttaacaaaaagattttgataattatatgatttgtttagttataacaaaaataattctgggtaatattggacccagaatagcaaatacagcaccattatctggaatatttggagcagcccctcaatttctttttaaggtgcctgacttttatttaaaatttttcaacctcatcgtgatgctaatctttattgtcttcatatttagggtacatttctccata

SEQ ID NO: 150041 - DNA, 601 bp, Human
actatttagtgatgtttctttgatgggaattttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattgggttcctacaacataggtatgttctttttttggctaatgggaaaatgtattcctgagtaaccgtttttgtttytttagtcattttgaggataattggactttgtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaatt

SEQ ID NO: 150042 - DNA, 601 bp, Human
ttttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattgggttcctacaacataggtatgttctttttttggctaatgggaaaatgtattcctgagtaaccgtttttgtttctttagtcattttgaggataattggacttygtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaa

SEQ ID NO: 150043 - DNA, 601 bp, Human
gtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttyggacagttattttatttcgttttaattttttccttaagcaaaagcataatcacagatgtctctgtctcatcagtgtgttcaccatttcgtagacactttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggcca

SEQ ID NO: 150044 - DNA, 601 bp, Human
gtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttcggacagttattttatttcgttttaattttttccttaagcaaaagcataatcacagatgtctctstctcatcagtgtgttcaccatttcgtagacactttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattt

SEQ ID NO: 150045 - DNA, 601 bp, Human
gtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttcggacagttattttatttcgttttaattttttccttaagcaaaagcataatcacagatgtctctgtctcatcagtgtgttcaccatttcgtagacrctttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagt

SEQ ID NO: 150046 - DNA, 601 bp, Human
gtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattayctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggg

SEQ ID NO: 150047 - DNA, 601 bp, Human
actccaagaacaacacccagatggaaattttggagcaatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtrcaagacaacatccagcttcatggccagcaggtggcgagaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgt

SEQ ID NO: 150048 - DNA, 601 bp, Human
aatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcragaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgtacattcttggtaccatttacttacctgtttttagcc

SEQ ID NO: 150049 - DNA, 601 bp, Human
gcataattcttggtgataaagttgaaacgttctgtgttactgaatttgatctactttctgaggcaagatctgttacaggaacccataattgccatagaaaaattgtttaacgcttatttgcttattttgataagactcaaaaaatttctgctagttaaaaaggagttttgaagtaagaaattcactttttcatccaaacacattcctaggatttaacacattctctaagtcaggttcttttttttttcaactgtaatgtagaagacaaaatactggcatcgtgacccagaacatatggatraagataattgaaacaagtttcatgaaacaaagcaacgttttctgtttagtttttataacacattctgatcatttctcttccattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggct

SEQ ID NO: 150050 - DNA, 601 bp, Human
cattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggctggagttttagagatgcacctctaaatagtagaggcagagttcattgtacagatcacagatatctggtcattgagaacttgragaatatcttaaatgtccagactcctaaaacattattccagaaatagctcctcccaatcactggtgctttacttgtcacatttgtgaaatgcacttggaagcattaatagcagtggtcagagggctcagaaggaaaccctggggcacttgaacattgatcgtccgtcagggaagcaggaacaaagtagacagaaggaacagccactgaagaagcaaaattgtcccaaagccaagagggtgctgtttcagagagggagcctgtactgctgatgagtcaaatgagaagacagcggagcagga

SEQ ID NO: 150051 - DNA, 601 bp, Human
atttaatctgcattttgtttggcgaggacagtgtcatcggtggtcaaatacaggctggagttttagagatgcacctctaaatagtagaggcagagttcattgtacagatcacagatatctggtcattgagaacttggagaatatcttaaatgtccagactcctaaaacattattccagaaatagctcctcccaatcactggtgctttacttgtcacatttgtgaaatgcacttggaagcattaatagcagtggtcagagggctcagaaggaaaccctggggcacttgaacattgatcgtcygtcagggaagcaggaacaaagtagacagaaggaacagccactgaagaagcaaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagt

SEQ ID NO: 150052 - DNA, 601 bp, Human
aaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagtgctggctaagtgcttggggcatattcagatgtcgatagatacgaggatatrttagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaactcactcattacagcgagcatagcatcaagccattcatgaggcatctgcccccatgaccca

SEQ ID NO: 150053 - DNA, 601 bp, Human
acacctgagtgctggctaagtgcttggggcatattcagatgtcgatagatacgaggatatgttagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaaytcactcattacagcgagcatagcatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttactccctggtgagaaagctacatataaacagacgtttctaacgtcggaagtgttccagagaggactgcaagagcacccaggaggggtaccgcccccttcttgtaaattgaagag

SEQ ID NO: 150054 - DNA, 601 bp, Human
gacagaaggcaaagggggagcaggcacctcacacggcaagagagggagcaagaggcagggggaggtgccacacactcaaatagccagatctctcaggaactcagagggagaactcactcattacagcgagcatagcatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttaytccctggtgagaaagctacatataaacagacgtttctaacgtcggaagtgttccagagaggactgcaagagcacccaggaggggtaccgcccccttcttgtaaattgaagagttaagatgtagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtc

SEQ ID NO: 150055 - DNA, 601 bp, Human
agcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacrgtcactgtaggcaaaggcctggcctgggcatgagtgaggctgggagatctgtgtgagatgttctgagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaa

SEQ ID NO: 150056 - DNA, 601 bp, Human
gtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgaygtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattt

SEQ ID NO: 150057 - DNA, 601 bp, Human
gctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctrataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctgga

SEQ ID NO: 150058 - DNA, 601 bp, Human
gctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattactttttttwaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatat

SEQ ID NO: 150059 - DNA, 601 bp, Human
taaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaacttggtaagtttttgtggctgtgtaatctcttcattattatatattttataatagaaacc

SEQ ID NO: 150060 - DNA, 601 bp, Human
ctccttctgcccatagcgcgagtctgtggcggatgccatctggggataccgggtgtagcagagccgtgaggggggctctctccatcctcatgtgcccaagcccaggcagaagatggcaagggctccagaaaacggccggtgtatggaggacacccttatcccatcaggagccccagtattaattggtggtgcccccagcagagggcagcctgtgaccttgaaatcctgggcgtttcagaggaggggctcagagggttgccgatggggacaccccagcagcccccttcaaggggcaggtgcyccaggtggggctgtaaccctaaacccagggctgagcccggagggggtgactgcggctggctccgccccccatcaatctttcatggtcctcagaacccggccgcgcggccccacgtgcaccgcgtgcatggtccctcgaggacgcgcatctgcagcccccgctccccgcaaacctccaggccggagagctccggccaaggccgctgcatcacatgatacaggaggggcatgcacacgctcacgtgcacacagcctcaaacacgctcatccgtacatacaggagtgtgtgaacgcactgagg

SEQ ID NO: 150061 - DNA, 601 bp, Human
atcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtccctcgaggcacccctagatgcctcttgagcccagcaacacccaacaaagcgttggacggtgagtgtcagaataaatccttaaactttctgcatggcraactcctacacatccctcaggatccaactcaaatggctcctggatgaaggctagtttgcagaaagtgtgaattacctggctttagctgtaagaccttgggtgtgtgccctcccctctcttagtgtcctttttctagacttgtgggtctccagcccagctgggcactcaccaaggtggtcagctagctgccggccacgttctgatgacaccacccgctcatcctccatgtcacacttgtttcctaccagcagcacctgggcattgtcccatgagtaggtcttgatctgggtggacctatag

SEQ ID NO: 150062 - DNA, 601 bp, Human
ccttgctctgctgcccaggatggagtatggtggcgtgatcatagctcactgcagtctcgacctcctgggctcaagtgatcctccacccccacctctcaaattgctgggattataggtgtgagccagcgcacctggcctcctgcccttccttcctaaaattgtgtctcgttgtccttagggacctggcaagacatgccctgcagcgtccagcccagccccgtgcactggccctggaaggctctgacactcaaatccagctgtgacctccccctgctcacacaccctctgtgactccctattrccctccaaagagtcccagcctctcagcacatggttgaggccctctgtgatcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtccctcgaggcacccctagatgcctcttgagcccagcaacacccaacaaa

SEQ ID NO: 150063 - DNA, 601 bp, Human
ctttgcatttcctgctttttttttttttttttttttttgagacagggccttgctctgctgcccaggatggagtatggtggcgtgatcatagctcactgcagtctcgacctcctgggctcaagtgatcctccacccccacctctcaaattgctgggattataggtgtgagccagcgcacctggcctcctgcccttccttcctaaaattgtgtctcgttgtccttagggacctggcaagacatgccctgcagcgtccagcccagccccgtgcactggccctggaaggctctgacactcaaatmcagctgtgacctccccctgctcacacaccctctgtgactccctattgccctccaaagagtcccagcctctcagcacatggttgaggccctctgtgatcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtcc

SEQ ID NO: 150064 - DNA, 601 bp, Human
gccgggtcaggcccgggtagttgggggaaggtggggaagacagggaagaggggaaagggagtgggatggctctcagcaggcgcagtcctggtgcggtggcacctgctggtcactgagctgtgggccctgcttggcgcctgtgaccgcagggtccgccgtgtccaacgactcggacatcttctcgcagatgacatccaccaggcgctcaaaggtctgcttgacgttaatgttgtccttggcgcttgcctcaaagaactcgaaccctgtggtcagagaaggcagggatgaggaccctggccaygccctatgccaactcccagagatgcttctctgaggaaagggaacacctggagattcccagtgccaagcaacttattgaaggtactgacaaatcccacagagaagaaacttattgaaggtactgacaaatcccacagagaagcaacatggaactgggtcagctttgcatttcctgctttttttttttttttttttttttgagacagggccttgctctgctgcccaggatggagtatggtggcgtgatcatagctcactgcagtctcgacctcctgggctcaagtgatcctccacccccacc

SEQ ID NO: 150065 - DNA, 601 bp, Human
ggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggccckggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtg

SEQ ID NO: 150066 - DNA, 601 bp, Human
gggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtgcagacccacgtgtgcgcgctagaggggactgctgacggctcyggggttcgaaacctggcttcactgctttcttgtatcttgggcaaggggcgtgcctctctgtttgggtttcccagctgtccaatgggcgaattacaggacctccctccaggggagagggtaaagcgattaaaatcgtgaccggggcccggtgcggtggctcacgcctgtaatcccagcactttgggaggccaaagcatgcagatcacctgaggtcaggagttcaagaccagcctggccaacatggcgaaaccccgtctctactaaaaatacaaaaattagccggatgtggtggtgggcacc

SEQ ID NO: 150067 - DNA, 601 bp, Human
aaaccccgtctctactaagaatacaaaaattacctgggcgcagtggcacgcgcctgtaatcctagcctctcaggaggctgaggcaggagaatcgcttgaacccgggaggtggaggttgcggtgcgtggagattgcgccattgcactccagcctgggcgacagagcaagactccatctcaaaaaaatataataataataataataatagtaatggcagcaatcactcactgacactcgtatatgtcaagtcatattccaaatctttttcacttattaacttgtttaattctactgggcacartggctcatacctgtaatcccagcactttgagaggccaaggtaggaggatcacttgaggccaggggttcgagaccagcctaggcaacatagtgagaccccccccgcccccatctctacaaaaaaatttttttttaaattagtcgggcatggtggcacctgctgtagctccagctactccggaggctgaggcaggaggatcacttgagcctaagagttccagtctgcagtgagctgtgatcacaccactgcactccagcctgggcaaaagacagaaaccttttctttaaaaataaaataact

SEQ ID NO: 150068 - DNA, 601 bp, Human
tggagattgcgccattgcactccagcctgggcgacagagcaagactccatctcaaaaaaatataataataataataataatagtaatggcagcaatcactcactgacactcgtatatgtcaagtcatattccaaatctttttcacttattaacttgtttaattctactgggcacagtggctcatacctgtaatcccagcactttgagaggccaaggtaggaggatcacttgaggccaggggttcgagaccagcctaggcaacatagtgagaccccccccgcccccatctctacaaaaaaawttttttttaaattagtcgggcatggtggcacctgctgtagctccagctactccggaggctgaggcaggaggatcacttgagcctaagagttccagtctgcagtgagctgtgatcacaccactgcactccagcctgggcaaaagacagaaaccttttctttaaaaataaaataactaacttaattcttacaacaacacagtaagaaggtattattattaatcccactttagagaggaggagactgaggcatagaagggcatcagtcctaggcaccactgaaggccaggtcccccatctaac

SEQ ID NO: 150069 - DNA, 601 bp, Human
cctggggcgcatctctgccccagaccaggtgagtcccacccaggctcctggttggctctgcactccctcactagcttggtgggattgaggtcgaagagcattcctagcagagggaatggcctgtgcaaaggccaagaagtaggaaagagctgagaggaggccaggtgcggcggctcatgcctgtatcccagcactttgggaggctgaggcgggtggatcacctgaggtcaggagtttgagaccagtctggctaacatggtgaaaccctgtctctactaaaaatataaaaattagctggacstggtggcacgcacctgtagtcccggctactcaggaggctgaggcaggagaatctcttgaacccgggaggcggaggttgcgatgaagggagatcgcaccactacactccaccttggatgacagagtgagactctgtctcaaaaaaataaaataaaataaaataaagagttcagaggaggatctgcaaggaatgggaaaggtgagtctgggaggcaatggaccgccctcagtaggtgtgagcagacaagggccacattcagatctagagttccagagagttccaaagatcccctgggagatg

SEQ ID NO: 150070 - DNA, 601 bp, Human
agcacttttggaggccgagacaggcagatcacttgaggttagaagttcgaaaccaacctggccaacatggtgaaacccccctccactaaaaatacaaaaattacctaggcctggtgatgcatgcctgtaatcccagctactcgggaggctgaggcaggagaatagcttgaacccgggaggtggaggttgcagtgagcagagatcgcgccattgcactccagcctgggtgacagagagagactccatctcaaaaaaaaaaaaaacaaaaaaaaaaaaccaaaacaaggctgggcgcggtggyttacgcctataatctcagcacttttggaggctgaggcaggggtatcacctgaggtcatgagttgaagaccatcctgaccaacatggaaaaaccccgtccctactgaaaaatacaaaattagccgggtgtggtggtgcatgcctgtaatcccagctactcgggaggctgaggcaggagaatagcttaaacctgggaggcggaggttgcggtgagctgagatggcgccattgcactccagcctgggcaacaagagagaaactccgtctcaaacaaaaataaaaacaaaacaaaacaaaccca

SEQ ID NO: 150071 - DNA, 601 bp, Human
gagttagcagagggtacgggggaccaccccatctgcagtcctccctggaggtcagatccgggactgctggactgtgtaacttcagggagggactgtactctctgcctcacagtcttcatcaataaaatgaggatgacacgggtccctgcttcacagggatcccagggctcagaacacagtggggctcagggacaattctcaggttcatgcagttgatcaacaaatgcacattatagcctgaggaacatagggagaccccatctttacacaatttttttttttttgagccagagtctcactgtgttgcccaggctggagtgcagtggcgcaacctcagctcactgcaacctctggctcccaggatcaagccattctcttgcctcagcccccgagtagctgggatgacaggcatgcgccaccatgcccagctaatttttttgtattttttgtaggggtggggttttgccatgttggccaggctggtctcaaactcctgacctcaggtgatccacctgcctcagcctctgaatgtgctgggattacaggcatgagccactgtgcccggcctttctttcttttctttctttttttttttttttga

SEQ ID NO: 150072 - DNA, 601 bp, Human
gcttgttcatggagcattatttcagcccctgggagcctccttatcctggcctgccatccctctggggcatggaatgttctggacctgtccatcagtcccagttcctgcttgatccctagaagacagctcaggtaggcgctggcagagagcatgccctgggcacagggaccccaactgcaagggtttaccttcttatcacctgtcagggccacgcctgactctcctctcttcttcttccttctttccttccttcctccccagacaaatatttgttgaacatctactatgtggcaggtactgtttttttttgttttttttccggatggagtcttgctctgtcacccaggctggagtgcagtggtgccatctcggctcactgcaacctccacctcctgggttcaagcaattctcctgcctcagcctcccaagtagctgggattacaggtccacgccaccacagccggctaatttttgtatttttagtagagacggggtttcgccatgttggccaggctggtcttgaactcctgacctcaggtgatctgcatgctttggcctcgcaaagtgctgagattgcaggcatgagccaacgtgctcagcc

SEQ ID NO: 150073 - DNA, 601 bp, Human
ttttttttccggatggagtcttgctctgtcacccaggctggagtgcagtggtgccatctcggctcactgcaacctccacctcctgggttcaagcaattctcctgcctcagcctcccaagtagctgggattacaggtccacgccaccacagccggctaatttttgtatttttagtagagacggggtttcgccatgttggccaggctggtcttgaactcctgacctcaggtgatctgcatgctttggcctcgcaaagtgctgagattgcaggcatgagccaacgtgctcagcccaggtactgytgttctaaaccctggggcacagccatgaccaagcagtcccctgcttctgccttccaaggccacacactcaggtggtttccactcttccgggacttctggtcacatgccctcactgtcccttttgcaaatctcccacatgtgactgcagtccctctggaaccagaacccacctgtctgtcccacctgcccttggtcacaggtgtccttgctcctgtagggatgtctcaggtcttcggggaggggaggggcaaatatctccttcacctttgcaggactgggttacccccaccgttgccctca

SEQ ID NO: 150074 - DNA, 601 bp, Human
ctcagctcgctgcaacctccaccccctgggttcaaggaattctgcctcagcctccagagtagctgggattacaggtgcatgccaccatgcccgtctaatatttttgtatttttttttcttgagacggagtctcgctctgttgcccaggctggagtgcagtggcaccatcttggctcactgcaagctcagcctcctgggttcacgccattctcctgcctcagcctcccgagtagctgggactacaagcgcccgccaccacgcctgactaattttttgtatttttagtagagatggggtttcmccgtgttagccaggatggtctcgatctcctgacctcgtgatccgccctcctcggcctcccaaagtgctgggattacaggcgtgagccaccgcgcccagcttatatttttgtatttttattagagatgggacttcaccatgttggccagtctggtctcgaactcctgacctcaagtgatccacccgcctctgcctcccaaagtgttgggattacaggtgtgagccaccacgcctggcctggctaattttaaaacttgtttttagagacagggtctcgcttcgtgcctaggcttgtcttgaa

SEQ ID NO: 150075 - DNA, 601 bp, Human
agtagctgggactataggcatgtatcaccatgctgggctaaattttttgtattttttatagagacgagtttttgccatgttgcccaggctggtctcaaagtattgggctcaagtgatctgcctgcctctgactcccaaagtgctgggattacaggtgtgaggcactgttcctggtcataagaacatttttatcaccccagaaagaagccctgtccccatcagcagtcacttcccacttccccctctccccagctcctggcaagcacgaatccactttctgtttctatgaatttgcctgttstgggcatttcatgtaaatggaatcataaaatatgtgatcttttgtgtcttagcataatacatatatattttttgagacggggtttcactttgtcgcccaggctggagtgcagtggcgtgatcccagctcactgcaacctctgcctcccaggttcaagcaattctcctgtctcggcctcctgagtagctggggtcacaggcatatgccaccacgcttgggtaatttttgtatttttagtaaagatggggtttcaccatattgatcaggctggtcttgaactcctgacctcaggagatccac

SEQ ID NO: 150076 - DNA, 601 bp, Human
gccaccacgcttgggtaatttttgtatttttagtaaagatggggtttcaccatattgatcaggctggtcttgaactcctgacctcaggagatccacacatcttggcctttcaaagtactgggattacagcagagtacagtggagccactgcactccagtctgggtaacagagtgagactccaccaaaaacaaacaaaaccaaaaacatttgtgaacaagttttggtatggacatatgttttaatttctctaggtatatacctatgagtggaattgctggatcatatggtaattctttaactttttttttttttttttagatggagtcttgctctgtcgcccaggctggagtgcagtggtgtgatctccactcactgcaacctccgcctcctgggttcaagcgattctcccgcttcagcctcccgagtagctgggactacaggcatatgccaccacgcctggctaatttttatatttttagtagagaaggggtttcaccatgttggtcagggtggtctcaaacccctgacctcagatgatccgcctgccttggcctcccagggtgttaggattacaggcctgagccaccacgcccggcctat

SEQ ID NO: 150077 - DNA, 601 bp, Human
tcaggagatccacacatcttggcctttcaaagtactgggattacagcagagtacagtggagccactgcactccagtctgggtaacagagtgagactccaccaaaaacaaacaaaaccaaaaacatttgtgaacaagttttggtatggacatatgttttaatttctctaggtatatacctatgagtggaattgctggatcatatggtaattctttaactttttttttttttttttagatggagtcttgctctgtcgcccaggctggagtgcagtggtgtgatctccactcactgcaacctcygcctcctgggttcaagcgattctcccgcttcagcctcccgagtagctgggactacaggcatatgccaccacgcctggctaatttttatatttttagtagagaaggggtttcaccatgttggtcagggtggtctcaaacccctgacctcagatgatccgcctgccttggcctcccagggtgttaggattacaggcctgagccaccacgcccggcctatgtttaactttttgaggaactaccagactgttttccacagcggccacatcattttacattccgaccagcaacatatgaggattc

SEQ ID NO: 150078 - DNA, 601 bp, Human
gttttccacagcggccacatcattttacattccgaccagcaacatatgaggattctaacttctccacgtcctcgccaatactcattattctccatcctagtgggtgtgaagtgatacctcactgtggttttgatttgcatttccctgatgaataatgatgttgagcatctttcttttcattggccatttgtgcatcttctttggagaaatgtctattcaaaccctttgcccatccagcctgggtaacatagaaagaccctatctctataaaaataaaaatgaaaaaattagctgggcatgrtggtgcacacttgtagtcccagctccttgggaggctgaggcaaagaggatcgcttgagcctggggggccaaggctgcagtgaagcatgatcccaccactgcactccatcctaggcaacagagcaagaccctgcctcaaattaaaaaacaaacaaacaaaaaaacaccctttgcccatttttaaattgggtgatttgtctttttattgttgagttataatttacatatttttatatctttatgtattctgggtacaagcccctgatcagatgtataatttgcatgtgatattttctcccat

SEQ ID NO: 150079 - DNA, 601 bp, Human
cttttttttggtgggcggatggagtctaactctgtcacccaggctggagtgcagtggtgcgatttcagctcactgcaacctccacctcccaggttcaagggattctcccacctcagcctcgtgagtagctgtgactacaggtgcacaccactatgccaggctaatttttatatttttagtagagatggggtttcaccatgttagccagcctggtttcaactcctgacctcagcctgcctcagcctcccaaagtgctaggattacaggcatgagccaacatgcctggccagaagtttttaattttttttttttttttttgagatggagtctcgctctgttgcccaggctggagtgcaatggtgtgatctcggctcactgcaagctccacctcccgggttcatgccattctcctgcctcagcctctcgagtagctgggactactggcacccgccatcaggcctggctaattttttattatttttttatttttagtagagacagggtttcaccatgttagccaggatggtctcgatctcctgacctcgtgatccacccgccttggcctcccaaagtgctaggattacaggtgtgagccaccacg

SEQ ID NO: 150080 - DNA, 601 bp, Human
ggataaaagaggaggttcaagtctgtctctcccaacctgcagctcaggaatggacgccagccgacccgccttagctgacagcttctatgccatctcctatctctattacggtgccctgggcacgctgaccactgtgctgtgcggagccctcatcagctgcctgacaggtaggtaaacagagcatgtggcctcagaggtcatcccattcatctctctgcctcaaggctccacccagcagggaggggagaaaggacgctcccattggccaaactgccactgtgtgctgtacacatttgtaccttattattattattattattattattattatcatcatcatcatcatcatcatcatcatttttgagatagagtctcactctgtcacccaggctggagtgcagtggtgtgatctcagttcattgcaacctccacctcccagattcaagcgattctcatgtcacagcctcccgagtagctgggattacaagtgtgtgccgccatgcttggctaattttgcatttttagtagagacggagtttcgccatgtgtctcgaactcctgggctcaagtgatccgcccacctcggcctcgcaaagttctg

SEQ ID NO: 150081 - DNA, 601 bp, Human
ccaacctgcagctcaggaatggacgccagccgacccgccttagctgacagcttctatgccatctcctatctctattacggtgccctgggcacgctgaccactgtgctgtgcggagccctcatcagctgcctgacaggtaggtaaacagagcatgtggcctcagaggtcatcccattcatctctctgcctcaaggctccacccagcagggaggggagaaaggacgctcccattggccaaactgccactgtgtgctgtacacatttgtaccttattattattattattattattattattatyatcatcatcatcatcatcatcatcatttttgagatagagtctcactctgtcacccaggctggagtgcagtggtgtgatctcagttcattgcaacctccacctcccagattcaagcgattctcatgtcacagcctcccgagtagctgggattacaagtgtgtgccgccatgcttggctaattttgcatttttagtagagacggagtttcgccatgtgtctcgaactcctgggctcaagtgatccgcccacctcggcctcgcaaagttctgggattataggtgtgagccactgcacctgggc

SEQ ID NO: 150082 - DNA, 601 bp, Human
tcacccaggctggagtgcagtggtgtgatctcagttcattgcaacctccacctcccagattcaagcgattctcatgtcacagcctcccgagtagctgggattacaagtgtgtgccgccatgcttggctaattttgcatttttagtagagacggagtttcgccatgtgtctcgaactcctgggctcaagtgatccgcccacctcggcctcgcaaagttctgggattataggtgtgagccactgcacctgggctgtacctatttttttaaaaggaaaaaaaaagtttgtgaggaaaaaagaattgtgtgtgtatatatacacatacatacacacttttatgtgtatatatacataaaagaaattatgaatatatataaaaattatgactatatatatacataaaagaaagtgtatatatatatagtttcttttaaagggacggggtcgactgggcgtagtggctcatgcctgttatcccagcactttgggaggccgaggcgggtggatcacctgaggtcaggagttcaagaccagcccggccaacatggtgaaaccccgtctctactaaaaatacaaaaaaattagctgggcatggtggcagg

SEQ ID NO: 150083 - DNA, 601 bp, Human
ctaaaaagaaaaacgtgtagggtctcagcatgataaatattcaaaggataataaaaccggatgctgtgatggggagcaactttagccagggaagtcaggggtggcctcttgggagaggtgacattgattgaccctgagttaggagaagaggaaccagccacagacaggaacagctttgactgagaaggggattgggaggggaggggtttgcctgaaggtgtttaaagctccctccagctgccctagagaagtgtttatcttttctttctttcctcttttcttttcctttctcttcttttcttttttttctttctctctctttttttgttctttattattttatttttcttttttgttgtctttgttttatttgtgtgttttttttcttttttgtcttttttttttttcctttttttgagatagggactcactctattgcccaggctggagtgtagtggcatgaccatggctcactgcagccccaacctccatggtccgagaaattctcccatctttcaacctcctgagtagctgggattataggcatgcaccaccgagtctggttaatttttttatttttggtagagatggggttttgcca

SEQ ID NO: 150084 - DNA, 601 bp, Human
acgtgtagggtctcagcatgataaatattcaaaggataataaaaccggatgctgtgatggggagcaactttagccagggaagtcaggggtggcctcttgggagaggtgacattgattgaccctgagttaggagaagaggaaccagccacagacaggaacagctttgactgagaaggggattgggaggggaggggtttgcctgaaggtgtttaaagctccctccagctgccctagagaagtgtttatcttttctttctttcctcttttcttttcctttctcttcttttcttttttttctttttctctctttttttgttctttattattttatttttcttttttgttgtctttgttttatttgtgtgttttttttcttttttgtcttttttttttttcctttttttgagatagggactcactctattgcccaggctggagtgtagtggcatgaccatggctcactgcagccccaacctccatggtccgagaaattctcccatctttcaacctcctgagtagctgggattataggcatgcaccaccgagtctggttaatttttttatttttggtagagatggggttttgccatattggccaggc

SEQ ID NO: 150085 - DNA, 601 bp, Human
caactttagccagggaagtcaggggtggcctcttgggagaggtgacattgattgaccctgagttaggagaagaggaaccagccacagacaggaacagctttgactgagaaggggattgggaggggaggggtttgcctgaaggtgtttaaagctccctccagctgccctagagaagtgtttatcttttctttctttcctcttttcttttcctttctcttcttttcttttttttctttctctctctttttttgttctttattattttatttttcttttttgttgtctttgttttatttgtgtkttttttttcttttttgtcttttttttttttcctttttttgagatagggactcactctattgcccaggctggagtgtagtggcatgaccatggctcactgcagccccaacctccatggtccgagaaattctcccatctttcaacctcctgagtagctgggattataggcatgcaccaccgagtctggttaatttttttatttttggtagagatggggttttgccatattggccaggctggtcttaaactcctgggctcaagtgatctgcccaccttggcctcccaaagtgctaggattaca

SEQ ID NO: 150086 - DNA, 601 bp, Human
ccaccgagtctggttaatttttttatttttggtagagatggggttttgccatattggccaggctggtcttaaactcctgggctcaagtgatctgcccaccttggcctcccaaagtgctaggattacaggggtgagccaccgtgcccggccagaaatatttattttcttgaaggtgaacaggcagagaagcagagaaaggagggaggaactatagcaggcatctgagaaagcgttgatggcctgggctgtaggtgacatgtgagtggggaagagaagcgcatggaaattttggaggcagagsgggcaggactggcccgtgcactgagcaaggggatagtatgcaattctgtgcacgccccgtcccgccaggtcatcagtagcccatctgggagatgagctgacacggaacagggtggggacagggtctctgatggggtctctttttcccacttttccccagggtcctgaagaactccccactggaaacaagaagccccctggcttcctgcccaccaatgaggatcgtctgtttttcttggggcagaaggagctggagggggctggctcttggaccccctgtgttggacatgatggtggtcga

SEQ ID NO: 150087 - DNA, 601 bp, Human
gtagagatggggttttgccatattggccaggctggtcttaaactcctgggctcaagtgatctgcccaccttggcctcccaaagtgctaggattacaggggtgagccaccgtgcccggccagaaatatttattttcttgaaggtgaacaggcagagaagcagagaaaggagggaggaactatagcaggcatctgagaaagcgttgatggcctgggctgtaggtgacatgtgagtggggaagagaagcgcatggaaattttggaggcagagcgggcaggactggcccgtgcactgagcaaggrgatagtatgcaattctgtgcacgccccgtcccgccaggtcatcagtagcccatctgggagatgagctgacacggaacagggtggggacagggtctctgatggggtctctttttcccacttttccccagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagg

SEQ ID NO: 150088 - DNA, 601 bp, Human
ggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccaatgctgacttctgcaggcaactattccagcttccaatcttggccccacacagctctatccttccctctggcccratccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcagggagggcatggaaaggagtgc

SEQ ID NO: 150089 - DNA, 601 bp, Human
aggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccaatgctgacttctgcaggcaactattccagcttccaatcttggccccacacagctcyatccttccctctggcccaatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcaggga

SEQ ID NO: 150090 - DNA, 601 bp, Human
gcaggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccaatgctgacttctgcaggcaactattccagcttccaatcttggccccacacagcyctatccttccctctggcccaatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcagg

SEQ ID NO: 150091 - DNA, 601 bp, Human
ggaaccagcaggacaggtcctccgtggccagagcaaagagggagtggtacacaggcaggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccratgctgacttctgcaggcaactattccagcttccaatcttggccccacacagctctatccttccctctggcccaatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggca

SEQ ID NO: 150092 - DNA, 601 bp, Human
catgaacccacccccaagccacaccatccactccctatccctttgccattcaacccttccaagccgcgccccctcctatcaactccaacctctcaacacctcccctacccatccccaaacatctcccacccgctctgccaatccccgcctccttctctctgccggaccccgccccttgatccctgccccgcttcgcagcctcccagctctcggagcctcactctgcctcttagtcttgcctcgttccagcgcccacccacccactcctcaacccctcccattttcattcccgggtcgctcrgcccaacccttcactcagtttgcccctcccattcccgcagtctcctccctcactaagccccgcccctcattaagcctcgcccacttccccaagtctttcgttttggctccgccccacatcccctaccactctccggcccctccccgagccccgcccccacgttggccccgcccagcgggggagtccgccctcacctcctgttctccctgggtccaggcgatgccgccgtcaccagccacgcggagcagccccagcccgtcgtggccaccaagggccccagggaggcccacgtggaaggtc

SEQ ID NO: 150093 - DNA, 601 bp, Human
caaagcgctgcgattgcaggtgtgccccactatgcctggcccttcctgggagattaaacaagaggctgtaggtgaaggtgggcgacttgtccatctccaggaaatggccctggggtcagagagagagagagtagtggtcgccctgtgaagcagaaggaatacttcagcttcactgagcgctgactgtgcggcaggtgtggtttgaaaacttgacccctgtccagggctcctggaaggtgaggacactgaggcatagagaaggggaggggccctgagtggccacagaggccgggaatggggkacaggtccttacgtgatggggccgtggcactgctcggccacttcctccagcagcctcggcggtgccacctccttgcagaagaagtgctgggagtccgtggtcagccggaagtagccgtccacgagcgccacgaacgacagagcctcgggcagccctgggaactcggcctcctgcgagggacaagcgtcagagcccagtgaaacccgagggtgccggtcccgccctcggggtaaggctgaaggggaggggaatcctgcacccactaaaatctggttgtctgtcctggtaacagtgaccagg

SEQ ID NO: 150094 - DNA, 601 bp, Human
gtcccagctactcgggaggctgaggcaggagaatggcgtgaccctgggaagcagaggttgcattgagccgagatcgtgccactgcactccagcctgggcgacagagccagactccgtctcaaaaaaaaaaagaaaaaagaaaatcagccgtaagtcttggcctcttctgggagattgtttgtttgtttgtttgttttaatagagacagggtcttgcttggttgcccaggctggagtgcaatctcagctcactgcagcctccaactcctgggctcaagtgatcctcctgcctcagcctccgsagtcgctgggactacaggtcaaccaccacacccagctatttttttttctttttttgtagagatggggtctctcctgttgcctagacttgtctccaactcctgagttcaaacaatcctcctgccttggcccctcaaagcgctgcgattgcaggtgtgccccactatgcctggcccttcctgggagattaaacaagaggctgtaggtgaaggtgggcgacttgtccatctccaggaaatggccctggggtcagagagagagagagtagtggtcgccctgtgaagcagaaggaatacttcagc

SEQ ID NO: 150095 - DNA, 601 bp, Human
ctgtcacagacatagaaagccagggtcccagatcagccactcattccaggggaggaaggggctcacctttgggtctggggatacagcaggaagtgagggtcactgccaccccatctacgtgcagccccccatcccagcaggttgccaggagctctcgaagactgctgtggggtcggctgaggccaaccagaaggaaggttcctgtggggctgcgccggatgaggcagcccttataatcaggaccaagggggttctgcaaagaagagtggcccctgagtgggactgagcgacagacactctycttctcagtccttcttccttttttttctttttttttttttttttttggagacggagtctggctctgtcacccaggctggagtgcaatggcgtgaccttggctcactgcaacctccgcctcccaggttcaagcgattctcctgcctcagcctcccgagtagctgggactacagatgcccactaccacgcccagctaagttttatatttttagtagagacagggtttcaccattttggccaggatggtttcgatctcttgatctcttgatctgcctacctcagcctcccaaagtgctgggat

SEQ ID NO: 150096 - DNA, 601 bp, Human
aaaaaccagaaatcagaggtgaaaagtccccaagggttagctaactcatgccttagtttgaggtaccctctagaagccgaccctgagatgaagacttcagggcacatggctttttgttgttgtttttgttttgttgttgctgctgctgttgagacggagtctcactctgtcatccaggctgggtgggcagtggtgcgatctcagctcactgcaacctccacctcccaggttcaagcgattttcctgcctcggcctcccgaatagctgggactacaggtgtgtgccaccgtgcccggctaatttttttttttttttttttttgagacagagtctcgctctgtcacccaggctggagtgcagtggtgtgatctcggctcactgcaacctctgcctcctgggttcaagtaattctcctgcctcagcctcccaagtagctgggactacaggagtgtgccagcacacccagctaatttttgtatttttagtagagatggagtttcaccatgttggccacgctggtctcaaactcctgacctcaggtgatccatctgcctcagcctcccgaagtgctggtattacagacgtgagccactgtgcctgg

SEQ ID NO: 150097 - DNA, 601 bp, Human
aataaataaataaaatatcatcatgttgaaccttgaactgaggggactgttcgttacagtagctgttgaagctcacactgactgtcacagtcaccaacccctccaacctcaccagacacacagggcgtggcctgctgcaaaccacgctccttccactgggcccaatatgacatcacagccctccccacccaacccgtcccagcgggcacctgaagagatgaggctattgaggtcacgaatgacggctcggaaggagggcctctggaccggctcataggccatgcactgttgaatcagcagrgccagctctgtccacttgggggccggcagctgctgccggtcctcataaaattggagtttctgagggtgagaggagcagtcggtaatccccaacccaatagacccaccccaatctccccagactggatgtcagtctgcccttctgtcaaagtgggggttcggagaccgatgccgggtgaggggctctgaccttagcaggatccagggcactgatgggcatggtgacgccactaaacacttcccagaccgtggcgccgaagccccacttgtcagcttccaagctaagtgtctgcgcctcccg

SEQ ID NO: 150098 - DNA, 601 bp, Human
tgcagtgagccaggatcacgccactgcactccagcctaggtgacagagggagatagtgtctcaaaaatataaaataaaataaaataaaaatgcatacaggcatgcatcaccatgcctggctaattttctgtttgtttgtttgtagagatggagttttgccatgttgcccaggctggtcttgaactcctgggctcaagcgatccacctacctatagctggaactataggcatgagccactgcgcccagccaaacatttttttaaaagaatgaaatagaccagacatggtggctcacacctgwaatcccagcactttaggaggtagaggtgggcggatcacctgaggtcaagagttcgagaccagcctagccaatatggtgaaaccccatatctgccaaaaatacaaaaattagctgggcgtggtggcacacactgtaatcccagctactcaggaggctgaggcaggagaatcgcttgaactagaggttcaaggaggtagaggttgcagtgagccgaaattgtgccactgcactccagcctaggcaacagagcaagactctgtctcaaaaataaataaataaataaaatatcatcatgttgaa

SEQ ID NO: 150099 - DNA, 601 bp, Human
tgtgagcaggtcagtcccgtctccagggtctcggtttccctggctgtgggataggtggattctccagccctgggaggtgcctgggaagagctaaggctgtggggaggaggcgggggcagcacggaggggcggagatgggggcggggccagagccgtgggagggggaggggccagaactgggcggggggaagggcggaactaagagggggccagccctgaggggcggagccagcgtgttggaggggtggggttctgaagcttgggcggggcgagagctgagagaagggcggggctaaggctrggggccgctgacagcagggcagcgggagacagaggagccagtgctgttgagggggcggggctctggggagtgggaggggccaaagctgcagcggaggaagggcggggctaaggctggggagcaaagcagcgggagggggcgggggcatggctgggggcggagccagagccgtggggaataggggcggagcctaggcgcgggttccccaccagaaaatggggctctggcctggctcgcggaccacgtagtagtctttgtcaagcggcagcagcttagctaggccgaagtcagcgatcttga

SEQ ID NO: 150100 - DNA, 601 bp, Human
gaccccgaagctccagacgtctgactggcgagagaagatgttgtccgagagggattcgggggcatacctggagaggggacaaggtcttgagatgcgagggtgtagaaaggacaggaagaggggggcagccttggaatggggaactggtcagggtaggtggggactgtgagcaggtcagtcccgtctccagggtctcggtttccctggctgtgggataggtggattctccagccctgggaggtgcctgggaagagctaaggctgtggggaggaggcgggggcagcacggaggggcggagatgggggcggggccagagccgtgggagggggaggggccagaactgggcggggggaagggcggaactaagagggggccagccctgaggggcggagccagcgtgttggaggggtggggttctgaagcttgggcggggcgagagctgagagaagggcggggctaaggctgggggccgctgacagcagggcagcgggagacagaggagccagtgctgttgagggggcggggctctggggagtgggaggggccaaagctgcagcggaggaagggcggggctaaggctggggagcaaagcagcgggagg

SEQ ID NO: 150101 - DNA, 601 bp, Human
catcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgaaccgtgaaggggtcagaaaggtgaggaagcgtcctccccactggggcctatgatgctgggaccaggtgaccccatgctaaagagggacgcaggcgcagacaggttggagattggccacgaggggcgtggagggagaagaaggctgggggcyctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggacaaggtcttgagatgcgagggtgtagaaaggacaggaagaggggggcagccttggaatggggaactggtcagggtaggtggggactgtgagcaggtcagtcccgtctccagggtctcggtttccctggctgtgggataggtggattctccagc

SEQ ID NO: 150102 - DNA, 601 bp, Human
caatctacagactgggaaactgaggctagccctgcggcgctcacctcagcagggcaggcaggaggcgccggcagcctctggccctcctccagcagttccaagaggcggcagagggcggggacatcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgaaccgtgaaggggtcagaaaggtgaggaagsgtcctccccactggggcctatgatgctgggaccaggtgaccccatgctaaagagggacgcaggcgcagacaggttggagattggccacgaggggcgtggagggagaagaaggctgggggctctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggacaaggtcttgagatgcgagggtgtagaaagga

SEQ ID NO: 150103 - DNA, 601 bp, Human
gcgccagctggcttgcccgagaccccggcccaatctacagactgggaaactgaggctagccctgcggcgctcacctcagcagggcaggcaggaggcgccggcagcctctggccctcctccagcagttccaagaggcggcagagggcggggacatcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgmaccgtgaaggggtcagaaaggtgaggaagcgtcctccccactggggcctatgatgctgggaccaggtgaccccatgctaaagagggacgcaggcgcagacaggttggagattggccacgaggggcgtggagggagaagaaggctgggggctctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggaca

SEQ ID NO: 150104 - DNA, 601 bp, Human
tgtcgcccaggctggagtgcagtggcatgatcttggctcactgaaaccttcccctcccaggttcaagcaattctcctgcctcagcctcgcaagtagctgagatcacaggcacccacacatgggtaatttttgtatttttagtagagacagggtgtcaccatgttggccaggctagtctcgaactcctgacctccggtgatctgaccgcctcagccttcaaaagtgctgggtttacaggtgtgagccaccacacctggccaaaattatttttaaattagccaggcatggtgatgtacacctmtagtcccagcactttgggaggctgaggcaggagaatcgcttgagcccacgagttcaagaccagcctgggcaatatagtgaggctcccatctctaaaaaattatttttaaattagccaagtgtggtggtgtacacctgtagctcctgctactagagacactgaactaggggaatcacttgagctcaggagttggaggctgcagtgagctataattgcaccccagcctgggcaacagagtgagcccccatctataaaaaagaaagaaagaaagaaaaaaaaaaaccatgaacgtcaccacca

SEQ ID NO: 150105 - DNA, 601 bp, Human
aaaaaaaaaaaaaaaaaaaaaaaaattacaggtggcgtgtgcctgtaatcccagctactcgggagtctaaggcaggagaattgcttgaacctgggaggcggaagttgtggtgagccgagattgcgccattgcactccagcctggccaacaagagcaaaaccacgtctcaaaaaaaaaaaaacaacaaaaaaacaccacctctccctgatgccctccttcgctcatctccatccctccttccctcatttgttccgggcagtcacatctgcctccatcgcactggtgcttaaaggcacccagstcattacctccccaaggcctttttcccttccgtgtcctccactggagatttcttctcctagctttactcatgggtaggctcctcctccttccagcgtcggccccgtaagaggccctctttgaccacccccaccccaccatttccctctgttcatctctttcaaggcacttatcactaccataattttgtcttttttgttttgttttgttttgttttgttttgttttgttttgagacagggtgtcactctgttgtccaggctggagtgcagtggtacaataatggctcactgcagccttaa

SEQ ID NO: 150106 - DNA, 601 bp, Human
caagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcattcagttttaaaacacaaattaaattccatcccatctctgctccaaaaactcccatggctccctatggatcttatttatttatttatttgagataaagtttcsctcttgttgcccaggctggaatgcagtggtgcgatctcggctcactgcaaaccctgcctcctgggttcaagcgattctcctgcctcagcctcccaagtagctgggattacatgcacacaccgccacacctggctaagtctgtatttttagtagagacggggtttcaccatgttggtcaggctggtcttgaactcctgacctcatgtaatccacccacctcggcctcctaaagggctgggattacaggtgtgagccaccgcgcccagcccttatggattttacaacacacttctcctttcg

SEQ ID NO: 150107 - DNA, 601 bp, Human
gctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcattcagttttaaaacacaaattaaattccatcccatctctgctccaaaaactcccatggctccctatggatcttayttatttatttatttgagataaagtttcgctcttgttgcccaggctggaatgcagtggtgcgatctcggctcactgcaaaccctgcctcctgggttcaagcgattctcctgcctcagcctcccaagtagctgggattacatgcacacaccgccacacctggctaagtctgtatttttagtagagacggggtttcaccatgttggtcaggctggtcttgaactcctgacctcatgtaatccacccacctcggcctcctaaagggctgggattacaggtgtgagccaccgcgcccagccctta

SEQ ID NO: 150108 - DNA, 601 bp, Human
cagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcgggggacagataatggggtcgtgcctgagcagtccaaaggacacaactcccattcagygtatttgtttttgtttttttgagacggagtctagctctgttgtccaggctggagtgcaatggcatgatctcggctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcatt

SEQ ID NO: 150109 - DNA, 601 bp, Human
cataaggcctctgaggcccagagaggggcagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcgggggacagataatggggtcgtgcctgagyagtccaaaggacacaactcccattcagcgtatttgtttttgtttttttgagacggagtctagctctgttgtccaggctggagtgcaatggcatgatctcggctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctggg

SEQ ID NO: 150110 - DNA, 601 bp, Human
ggttgcactgagccgagatcgcaccactgcactccaccctgggtaacagagcgaggctctgtctcaaaaataaaaataaaaataaaaaaaataaaaagagagagacagaaaaggaaactcagggggccagggcttaaggggttgggaagatgcgagagtcttaaatttggttccttgcttctttgggccaggactcagagagccccactgacacatatgcccatctgtcttgaaccttaacaaattgcaaaggccacaggctattctacaggccacgggagcccccccaaatgcaatgtcrtgggggtgttcctgaagtagaggaccctcataaggcctctgaggcccagagaggggcagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcg

SEQ ID NO: 150111 - DNA, 601 bp, Human
gcaactcgtctgcatcctcgctggtgtttacccgaatcaacatggtgactggcatggtggcattcttctcgtcaattggtggatttggaacacagacaataaaaacgttatttttccctgttggcgtacgtggcatattgggtggaatcagagcattcagcaatatgttgcctaaattggtgtctgcccgcaccaaaagctgtgtcttctgatttgctgtaggttttaaatgcagagtacctatgactttctctttaaattcattatctttcttgtaaaatagtttacactttttggagtwaaaagcatcttcttcttttacttcagtaactactactttgggtagctcatgattctcttcttcatctccacctttgcattcaccactgtcaccttccgcttggccctccaatggtttagtgcgaaatggtgaagagactggtttactctggtaatatctttgccaaataaactggagtttccaggggagaatgaaaatccagtcagggggacagagcttaatgagcccaaaacagagctatcaactttcttgccgaaattaaatgaggcacttgtcgctcctagtgatgatgggtccgtt

SEQ ID NO: 150112 - DNA, 601 bp, Human
tgtgctggatacagtggctgatgcctgtgatcccagaactttgggaggccaagacaggaggatcacttgagctcaggagcttgagaccagcctgggcaatgtagcaagaacccatctctacaatttttttttttttaaattaaccagtggggtggtgcatgcgtgtggtcccagctactctggaggctgagatggggggatcacttgagcccaagaggtcgaggatacagtgggctatgattgaaccactgtactgtagtctgggtgacagtgagactctgtctcagaaagaaagcgagamagagagaaagggggccaggtgtggtggctcatgcctgtaatcccagcactttgggaggccgaggtgggcggataatgaggtctggggatagagaccatcctgcatggtgaaaccccgtctctactaaatacaaaaaattagccaggggtgatgtcgggagtgcctgtaatcctagctactcaggaggctgaggcaggcaggagaatcgcttgaaccagggagttggaggttgcagtgagccgaaattgcagcactgcactccagcctggcgacaaagcgagactgtctcaaaaaacaaaa

SEQ ID NO: 150113 - DNA, 601 bp, Human
ttgtttccaggccaggcacagtggttcacgcttataatcccagcactttgggaggctgagatgggagcctcacttgagcccaggaatatgagagcagcctgggcaacataatgagacctcgtctctacatttaaaaacaaaaagaaaagaaaaagaaacaggagaatctcttaagcccaagagatagaggctgcaatgggcgtgatcgtgccactgcactccagtgtgggtgagagagtgagacccagcttcaaaaacaaaagaaacaaaaccctattttctttctttctttctttctttytttttttttttttgagacggagtcttgctttgttgcccaggctggagtgcaatggcacaatcttggctcactgcaacctctgcctcccaggttcaagcagttctcctgcctcagcaccccctagtagctgagattacaggcgcgtgctaccatgctcagctaagttttatatttttagtagaaacagggtttcaccatattggctaggctggtcctggtctctaattcctgacctcaggtgatccacccgcctcggcctcccaaagtgctgggattacaggcatgagccactgagcctgg

SEQ ID NO: 150114 - DNA, 601 bp, Human
agctaatttttaaaaaatttttgtagagacagggtctcgctatgttgcctaggctggacagtacttttgtgtatctaaaattctcagttttatttccctctttggagagggttgtccccctcttctagaaagccagcttcaagaggggcacggtttgtatctctctagggtgctgcattccccagcaccaggctcagagaaggggctatgtggatatgtgaatgaatgaatgaattagtgaatgaatgaatgaatcagtgaataaataaatggctgaatgagtgaatatcttacccttgcyatcctgacactcactggggcccaggttccagcttccatccgggcagtccgggctgggtccaagatttcagtggatgcacctgtggaggggtgctggggatggaggtgtagggagatgctcgtgtggccaggccactccctgctccggccactacctttgtgtccctgagctcctgtgaacgtcttccagttctcttgcacccagacccttagacactgcccagagaccagaggcccagccctcaggccccctgcggaggggcttgctctccagccgcctccaccatgcttgacgtttgca

SEQ ID NO: 150115 - DNA, 601 bp, Human
cttgaattcaaaaagcatctggccaggcgcggtggctcacgcctgtaatcccagcactttgggagtggatcgcttgaggttaggagttcgagaccagcctggccaacatggtgaaaccccgtctctactaaaattacaaaaattagccaggtttggtggtgcacgcctgtaatcccagctacattggaaggcggaggcatgagaattgcttgaacccaggaggtggaggtttagaggttgcaatgagtggagatcgtgctgctgcactccagcctgggcgacaaagtgagactctgtctcaaaaaaaaaaaaagaaagaaaaaagcatctgatgctacagcctgtgcaagcagaccagggtcagcccgtgggcatggtatgcttctcgtggctcagggactcctgcaagggctgggttgagctgtcaggggccaggagaattgaatgtggttcagggatgtgcccaatcctgagggagctgtgggtggctccaatgttgtgctttagaaaggggggctcctggtggtccaggcaggggaacagcaagtgcaaaggcctggaggtgggaactgtggcgaggggagactgagaaggcttggct

SEQ ID NO: 150116 - DNA, 601 bp, Human
aaaattagccaggtttggtggtgcacgcctgtaatcccagctacattggaaggcggaggcatgagaattgcttgaacccaggaggtggaggtttagaggttgcaatgagtggagatcgtgctgctgcactccagcctgggcgacaaagtgagactctgtctcaaaaaaaaaaaaagaaagaaaaaagcatctgatgctacagcctgtgcaagcagaccagggtcagcccgtgggcatggtatgcttctcgtggctcagggactcctgcaagggctgggttgagctgtcaggggccaggagmattgaatgtggttcagggatgtgcccaatcctgagggagctgtgggtggctccaatgttgtgctttagaaaggggggctcctggtggtccaggcaggggaacagcaagtgcaaaggcctggaggtgggaactgtggcgaggggagactgagaaggcttggctggaggttggagtgctggtgagtcagtggagagatgcaagaggggtggctggttctcaggtgtggctgaaaacccgccccttcggagtccccacaacccctttcttgctctgcagtgactctcaaagctgcttgtgtct

SEQ ID NO: 150117 - DNA, 601 bp, Human
agtccccacaacccctttcttgctctgcagtgactctcaaagctgcttgtgtctggtcagatcactcgtaacagccccctgttacagatcctatccaaccccgcctggtacctctgtggatctgaccgggaccacccaggcctctatttcctgattgtctcagccctgggcattgtcaccacggccgggccttgtgcagagcagtctggacaggctgggatgaggaacgggctctccaggggagggaacaaaggtcctgtctgagactctgagccatcacctggcccctctgtgactcacygccaccctcagcccatgcagctatccctcattcatgcctgcctgcctgcctgcctgcctgcctgccttccttccttccttccttccttccttccttccttccttccttccttccttcagtccaactgttttctgagctccgcagaggaaacacagaagacagcctccctcaggaataaacactcagatgttcctgacctgggccaaagctctgggctgggaagaaaacagatggagggtgtgggagagagataggaggtgggatctgctggctccaggaagcccccaggctggtggggga

SEQ ID NO: 150118 - DNA, 601 bp, Human
cagggtgaggcagaggcagaggcagtaagactggaagaggaggaaggaagagctccctacccactggtccccaaagctccctggagccgccattaactttgaatgaatgagtcggccaagttcagcctgggtgctgggggaaggagcacagttttggggacccccagccctggtgatcccaaactccctggggctctggcttcctgtcatcctggaaatgggtgttggaggttaggactgggtggcctgatccagacgggcgtctctcctcccacagaaggtggcctctaaccgagtgccmcagcatgtacccagtcccacccctggaaggccctacacctggctcccagacaccccccaacttgcaatcaccctagtccccctcaaggctcccctatgcagagctagaccccggaggaggtcgtttgaggggcaggcattgagttgctttgcaaagttgtctttcagctgatgcttacggggaggacagtccccaggcgtgcaaaggttgacagagcggctgaagtttgggacctaattttggggagggggtatagttaggaggtccggagggctgttgggggcgggggttggagcttca

SEQ ID NO: 150119 - DNA, 601 bp, Human
cgcaccgcccccttctctcccggcccgggcgggcgctcgccccccgccgggcccgtggactgggcggcgggggatgcgcctgccgccgccgcccccggccccgccgcccccgggccccgcgcccgctcgctgctgcccgccccgtccgcgaccccggctccggctcccgactgggggtccgcggccgcgcgggaccctctcccctccagccttgtccgcccgctcgggccgagccccgcaggtacagggtgggatgggtgagggtgcgggaggatccaggatctgcagctcagggagcccraggagggaggcacgtctcggagggggacgcggtttggggcaggggccaagagggagggtctccgtgcggtccggagcctaggagacacaggaaaggtggggggaatgaatgcatgtacattgcccgagtgagtgaggatccacgcacccccatcctgggagggggagggtgcagggttcactttgggggagggcagagctgtgagtctccaaactgcatagatagggttggaggtcggggagctctcagggatggacagtgacccgcaatgacttgggaatgggagggaggtgacccacc

SEQ ID NO: 150120 - DNA, 601 bp, Human
ggggaggggaagggaggggtgggggtggtggcgggaagggggatcctcggagaccttcctcaacctcagcagggacacccggactctggctgcgcccgctggggacccacaacaggcccacatgtcccagaagtttctgctgtgtgctgatctggttgtggtacccggaagcccctgggtgtgcatctggggagcaggggcggtctgccttggggattgaggggcagggagcaccttctcttggtccagttctgaagaacagaaatcaatggcatgaagctcttacagactgcaaagcatktgccatgcgagatcttactctgttctggacaccaaccctcgtagtgggggggtgggggggaggcaccatgaggaatctttacaaagcaggtggccaaggagtgggcagtaacttgctccctggcaggggtacctagggccccttctcagtggctgcctcaaccaacctgtcatttgtaaaaatgctcgctggagggccctgggggcctgactgggattctgtctcttcccatgtcctgttgggtggggaatctaaggagccatcagccctgctccctgctaccctcatcctctcctcaag

SEQ ID NO: 150121 - DNA, 601 bp, Human
cctgagggtcccagggactccagtgttaggcccagattgcagtgggggaggggatgtgtacccaggaatggggaaggcccaggcactcatcagttctgtgctccaagctagtggcttctcgacggcaggaccaggccagttcccctcccagaaagcagaccctgccacctgccacgcctggatggcactaatttagtccctgcctttcctggctgggtgaccttgggcaaaaggtgctgagcttctctgagctctgtctcccgtctgtaaaatgggaacgggaatgccaccttgctcaccrgtggtgatagggattaaatgtgatcaccctgatctcaggctcaaagcatagtaagagcccggtccacagtaatgtggtgggtgccgggaaagccctccacccctccacccctccaccctcttggaagccacctgccatttctctcctcctccccaccccctccctgcccagggcaccttaggacgcggctgccaggcgaggaggaacatggcagacacacggctgaatttggcccatgcgtcgggtggctgagtcacatccccaaattgcatcttcattggtgcgtttcggaaggtcgtt

SEQ ID NO: 150122 - DNA, 601 bp, Human
ttttagtagagacaggatttcgccatgttggccaggctggcctcaaactcctgacctcaagtgatctgcccacctcagcctcccaaagtgctgggattacaggcgtgagccactgcacccagccaatgtggctcatcttgctgtgtcctggaatgacgatctgctagtctgtcacccccagtgggggtgggaagtgtcctgcctgtgcacacagctgcccccaacccttctcccaggcctggcacatgggggacccctagtgcatgctgttgtgaccatttcaaaggggataacacttggccctccacccacccctgcccagcttgttgggaaaatctcacaaaggagccgggtccggaatcttccctgcaaggagaaggtgtgtcttcaggcaggtttgtattattattattttttttttgagacggagttttgctcttgttgcccaggctggagtgcaatggcatgatctcagctcactgcaacctccgcctcccgggttcaagcgattctcctgtctcaacctcctgagtaggtgggattacaggcatgggccaccacgcccagctaattttttgtctttttagtagagacggggttt

SEQ ID NO: 150123 - DNA, 601 bp, Human
ggcgcatacctgtagtccttgctgcttgggaggctgaggtgggaggatcgcttgagcccaggagtccgaggctgcagtgagctaggattgccccactgcactccagcctgggctacagagcaggcaaggagtgcatttgagggtctgagatactgggctgggcagggcaggggagaatctgacaagttggatccagagtctcagacagcctctcaatgccttggtgagcatgatgactatgtcaccatcattgaggtccctgctctcacacatgatgccacaggacattgctctgtaatcmcacagggtgcttttcaaatagcctggcagggaaacaggctagcctgagatcatagagcccagccaagcatgtcttatgtcttacaaagccctgcagaatcgattctagatcttggagttaaagcctgcattgccacactgtttggagatcatggatcccctcctggaaaccatttggattctgtttggaatctgtttggagattatggatcccctcctgcccaggcaggagggagcctcaggatctctgtagccacagccagggtccctaatgtcccataggccacagtgcaggagccta

SEQ ID NO: 150124 - DNA, 601 bp, Human
tcttggagttaaagcctgcattgccacactgtttggagatcatggatcccctcctggaaaccatttggattctgtttggaatctgtttggagattatggatcccctcctgcccaggcaggagggagcctcaggatctctgtagccacagccagggtccctaatgtcccataggccacagtgcaggagcctacaaatgcaggaggcacggtgaggtgaggttaactcatccaagagtctgaaggttggaagaggatgagctcagatgaaaaccaccttctaagcataccattagccaccctmtcctcccaggcaagcccgttggtagatttcatcttccagcgttcagcaagtgtttcctgagtgtcatctgtttgctaggcattgttctaggtgcttggatacacataaagtcagcaggcagggctctggtaggggggcattccaggcagagggcacagcctgtgcaaggtatcagagaaggatgaacttgttggaatctggtgattgggagaccattgtggctggaggaattgggtctggggagagtaagaaggacgagataggtgggaaccagatacagagggccccttggccatagtg

SEQ ID NO: 150125 - DNA, 601 bp, Human
ggttaactcatccaagagtctgaaggttggaagaggatgagctcagatgaaaaccaccttctaagcataccattagccaccctctcctcccaggcaagcccgttggtagatttcatcttccagcgttcagcaagtgtttcctgagtgtcatctgtttgctaggcattgttctaggtgcttggatacacataaagtcagcaggcagggctctggtaggggggcattccaggcagagggcacagcctgtgcaaggtatcagagaaggatgaacttgttggaatctggtgattgggagaccatygtggctggaggaattgggtctggggagagtaagaaggacgagataggtgggaaccagatacagagggccccttggccatagtgaagagtttggtgttttatttgtttttgtttttgttttttttagagatcggctctagttatgttgtccaggctggatttaaacccccagactcaagtgatcctccagtctcagcctctgagtagctgtgattacaagtgtgcaccactgggcccagctctggagtttctttgttctttttcttttttttgagacgtagtctcactctgccacccaggc

SEQ ID NO: 150126 - DNA, 601 bp, Human; identical to SEQ ID NO: 24549

SEQ ID NO: 150127 - DNA, 601 bp, Human; identical to SEQ ID NO: 24550

SEQ ID NO: 150128 - DNA, 601 bp, Human; identical to SEQ ID NO: 24551

SEQ ID NO: 150129 - DNA, 601 bp, Human; identical to SEQ ID NO: 24552

SEQ ID NO: 150130 - DNA, 601 bp, Human; identical to SEQ ID NO: 24553

SEQ ID NO: 150131 - DNA, 601 bp, Human; identical to SEQ ID NO: 24554

SEQ ID NO: 150132 - DNA, 601 bp, Human; identical to SEQ ID NO: 24555

SEQ ID NO: 150133 - DNA, 601 bp, Human; identical to SEQ ID NO: 24556

SEQ ID NO: 150134 - DNA, 601 bp, Human; identical to SEQ ID NO: 24557

SEQ ID NO: 150135 - DNA, 601 bp, Human; identical to SEQ ID NO: 24558

SEQ ID NO: 150136 - DNA, 601 bp, Human; identical to SEQ ID NO: 24559

SEQ ID NO: 150137 - DNA, 601 bp, Human; identical to SEQ ID NO: 24560

SEQ ID NO: 150138 - DNA, 601 bp, Human; identical to SEQ ID NO: 24561

SEQ ID NO: 150139 - DNA, 601 bp, Human; identical to SEQ ID NO: 24562

SEQ ID NO: 150140 - DNA, 601 bp, Human; identical to SEQ ID NO: 24563

SEQ ID NO: 150141 - DNA, 601 bp, Human; identical to SEQ ID NO: 24564

SEQ ID NO: 150142 - DNA, 601 bp, Human; identical to SEQ ID NO: 32416

SEQ ID NO: 150143 - DNA, 601 bp, Human; identical to SEQ ID NO: 32417

SEQ ID NO: 150144 - DNA, 601 bp, Human; identical to SEQ ID NO: 32418

SEQ ID NO: 150145 - DNA, 601 bp, Human; identical to SEQ ID NO: 32419

SEQ ID NO: 150146 - DNA, 601 bp, Human; identical to SEQ ID NO: 32420

SEQ ID NO: 150147 - DNA, 601 bp, Human; identical to SEQ ID NO: 32421

SEQ ID NO: 150148 - DNA, 601 bp, Human; identical to SEQ ID NO: 32422

SEQ ID NO: 150149 - DNA, 601 bp, Human; identical to SEQ ID NO: 32423

SEQ ID NO: 150150 - DNA, 601 bp, Human; identical to SEQ ID NO: 32424

SEQ ID NO: 150151 - DNA, 601 bp, Human; identical to SEQ ID NO: 32425

SEQ ID NO: 150152 - DNA, 601 bp, Human; identical to SEQ ID NO: 32426

SEQ ID NO: 150153 - DNA, 601 bp, Human; identical to SEQ ID NO: 32427

SEQ ID NO: 150154 - DNA, 601 bp, Human; identical to SEQ ID NO: 32428

SEQ ID NO: 150155 - DNA, 601 bp, Human; identical to SEQ ID NO: 32429

SEQ ID NO: 150156 - DNA, 601 bp, Human; identical to SEQ ID NO: 32430

SEQ ID NO: 150157 - DNA, 601 bp, Human; identical to SEQ ID NO: 32431

SEQ ID NO: 150158 - DNA, 601 bp, Human; identical to SEQ ID NO: 32432

SEQ ID NO: 150159 - DNA, 601 bp, Human; identical to SEQ ID NO: 32433

SEQ ID NO: 150160 - DNA, 601 bp, Human; identical to SEQ ID NO: 32434

SEQ ID NO: 150161 - DNA, 601 bp, Human; identical to SEQ ID NO: 32435

SEQ ID NO: 150162 - DNA, 601 bp, Human; identical to SEQ ID NO: 32436

SEQ ID NO: 150163 - DNA, 601 bp, Human
gagagaaagaggggagagagagagagagagagaaagagagaaagggagggagcgaggaggcagaggggtggagcgatagaagccggcagggaggaaggggtgggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggtaggtgctgggggaatggggtcttgctctggaggggggtsggggggaggaatggaggcttctgggggttgctctggaccaggaagcctttttctttgacccttgtcccctcttgttccactttcctttggggaaagtgagcgttggggcgtcctggctggcgctggggtgtcctggctggtgttggagtgtcctggctggcgttggggtgtcctggctggtgttggggtgtcctggctgggaggctgaactcctagggctccctttggatgggagaggtttataagtgtttgcggaagaaaagctggacagaggaggagcttggggtcagcccacgactc

SEQ ID NO: 150164 - DNA, 601 bp, Human
tagaaggccaaagagcagccctgtggcagggaaagaagcaaggggacctgcagagttggagagggagcagctgagctgagacgggagggcagcgtgggggtggcgtgtcccacactagagtcggcccagcctccccctctgacctgccacctcagctctctgcccagcatgccctctccatcagcctggccatgcctgggccaggctcagccaggaaaagcagctgctggtcttttctggcctcacctcccagcctgcccaacgcccccagccttccccagcctttatcacatggacagtrggcagatgccagggtaggcaagggacaagtcccctgcatcccagtcctctgctgctggtgccacatgcccctgtgcccagctctgtcgtgggatcctctctcaagatgggcactctggacagtgctcccagagaaccaaactgtagccccacctctgccccactgactcagggcctcagtcttcccatctgggtctgagagatgctcacagcatctgccaggccttgtgatgagcagtgcagggctgggaggcacgggcctggctgactcaagtcagggccactgccagcagtgccccac

SEQ ID NO: 150165 - DNA, 601 bp, Human
agcctccccctctgacctgccacctcagctctctgcccagcatgccctctccatcagcctggccatgcctgggccaggctcagccaggaaaagcagctgctggtcttttctggcctcacctcccagcctgcccaacgcccccagccttccccagcctttatcacatggacagtgggcagatgccagggtaggcaagggacaagtcccctgcatcccagtcctctgctgctggtgccacatgcccctgtgcccagctctgtcgtgggatcctctctcaagatgggcactctggacagtgctcccagagaaccaaactgtagccccacctctgccccactgactcagggcctcagtcttcccatctgggtctgagagatgctcacagcatctgccaggccttgtgatgagcagtgcagggctgggaggcacgggcctggctgactcaagtcagggccactgccagcagtgccccacatgtgcacacaaatgtccatgggtcttgcgcagagccctgatcctcactgtgcgggactaaaggaccccgggcaggagacaggcatggccaagaggcatcatggctgtgccttgttggctgtgagcc

SEQ ID NO: 150166 - DNA, 601 bp, Human
agcttgtccttgtcaaggtggcagccatcagagcaggggtggacagcccagctctcctgctccagtgctgccagagggctggggcccagggctgtgtgtgtgtgtgtgtgtgtgtgcgcgctcataggtgtgtttgcaggcatgtgtacgtgtgtgtgtatgtgcatatgtgcacacatgcatcttcagggactcatgacaacctcggctcccccgacaaggcgagctgccttgcctgtgtctgtctgtgcccaggggtgggtggagaatccaggctccccaaagcttccccattccataccctggggcctgcacgacacaacgcccaccactgcttcctgccatctgtcccgagtgatggaaatagagccagtgacagcaagcagtgctgggtgggccagtctgcaccgcagcagccgtggacagggtggggggtggggagccccacatctgagtagcctggatgtctcatgctggccctggcctcggtgaagcccttccggaaaggaagggggtgagaatcgggggaccccctttgcctttcaggcaaggccaagaattttctatctggagggacagacactctaaacaaattccccaa

SEQ ID NO: 150167 - DNA, 601 bp, Human
gccagtctgcaccgcagcagccgtggacagggtggggggtggggagccccacatctgagtagcctggatgtctcatgctggccctggcctcggtgaagcccttccggaaaggaagggggtgagaatcgggggaccccctttgcctttcaggcaaggccaagaattttctatctggagggacagacactctaaacaaattccccaagctgcattttcagatctattgaggagctttataagaacagagtagcccagccctctctgcatcaaacaatccagctcctgggcaggcagatggtgrgagcctccccacgtgattctggcatgtggcagctgagagcggcacattgggcctccctgccaggcatgctaggctgtgggtttggacagccagaccctccctgggatcagaagggcgaggaacactgactctcccccactgggggctttgtcaccttgccttccccttaaccctgtgagggcacattgtcacccccattttgcagatgagtaaactgaggctcggagctgtcaggttctctgtcagggtcaccgagctgggaagcgagggtgcgggattcatgtaactggttggccacag

SEQ ID NO: 150168 - DNA, 601 bp, Human
cacaaagagggcccatgtacacttaacctggtttccccaatgacagcatatttcaaaactacaacacaatagcacaactggagtgtctgcaatgatgcaacccaccagtcctagtccgatttcccagttcacacgcactcatttccgtgtgcattttttgctacaatttttatcacgtgtaggttcaggcactcaacagcaccatcaagatgcaaaacagctctgtcccctcaaggcccctcctgccgccctgtgagagccacacccctctccctcctgcctgcctccccccatccttaamccctggccctctaatctgttctccatttctaaaactttgtcattttacaatgttatataaatagaatcacacagaatgtgaccttttgggttggctttttcattcagcgtaattctctggaggttcacgcaggtgtggtgtgcgccaacagtttgtttgttttacttgtccagaattccgtggtatggatgcactggagtttgtttaatcattcacccattgaagggcattgggttgcttccagtatggggccgttccaagtaaagctgccatgaacatttgtgtacatgttttcacttg

SEQ ID NO: 150169 - DNA, 601 bp, Human
gacttggaggggcacggtggggctgtcagggcctggcaaggaggcactggggctcccggcagggttggggcatctaattcatgttccatctcatcactgccccagcttctctcccagcaccaaggcactgtggggtgaggggccagggggccgcctcttaggacgccctcccttccatgctgtgagcctcccaagccagcaggagggtgcctgggctgctatttaacattccctgacagctcagtcagaccctcttccagacagacaagtgtcagatattcatgaggatgacctcctcccrcctccccagcagcctgagggcccaggccgcagcctgatgagtcccagcttcccaggctcggctgctggggtctccctgccctcctgtccctggccctcccctcccttctcttctcagaacccaccccctgcctcacaaagaggggtgcccatcatgggcctgccttgtggggctcacaggtgggattctggcccctcagccagatggaggagcctggcccggaacccccaccaccactccacccagactctctccacagggagaaaagacacactggggccccctagcccaggagggcat

SEQ ID NO: 150170 - DNA, 601 bp, Human
ccccctgcctcacaaagaggggtgcccatcatgggcctgccttgtggggctcacaggtgggattctggcccctcagccagatggaggagcctggcccggaacccccaccaccactccacccagactctctccacagggagaaaagacacactggggccccctagcccaggagggcatcacagcactcctcaacggatatttttggaaggctgctgatgtgcctgaggggcttcggaacacacccagctccagagaccgccccagggacccaggccgagaaacagcctcagcagcaaagccygtggtcaagcccatgtgaactttggaatcagaagactatatgtgtagtgtggccctggcatgtcccaaaacttctcagggaattagtttcctcatctgtgaaatggggatcgtcttaccgattgcagggggttgtcgtgacgagattactttcagctcaacatagacatccacttgggaggtgctcagcctgccctttgggctcacccagccttcccgggaggactgagccctgtgagctagaacccaggacacccatgggatctcccgcacgacctgggcctggggcttcaagacagaa

SEQ ID NO: 150171 - DNA, 601 bp, Human
gcctcagtttcttctgatgtcctctgctcaccccccacgcagagcctgcagcaaagaatttgtgatgtaatgaagcacctgctgcccctctctcccctacgaccctccttaaccaaaataaagactcctgaataagatcatgaataatggagaaagtgcgtttctgacccagcctgacaggacgtgtgtgtgcatatgtatgtgtgagcacatgtgcatatgagcatgtgtacgtgtgtgtgcctatgcatgtgtgcttgtgtgtgcatatgaacatgtgtacttgtgtgcatgtgtgtgygcgtgtgtgcatgtgagcattgtacacgtgtgtgtgcatagcgtgtgcacatagggagcttccctcagcaccccaggcacccgtccacccccagctctccccctgtttctgctccatcagcatggtcagtgcctcttcttgctgcagctctgggcaccactgagccccctcattgcttggtgagccttggagaaggggagggacgtgcaggggttgttgccaagggtgtgtcggaggaagggtggatgatgactgtgagctggaggactggtagttgggacctagctggggaaggcccaa

SEQ ID NO: 150172 - DNA, 601 bp, Human
ctcagtttcttctgatgtcctctgctcaccccccacgcagagcctgcagcaaagaatttgtgatgtaatgaagcacctgctgcccctctctcccctacgaccctccttaaccaaaataaagactcctgaataagatcatgaataatggagaaagtgcgtttctgacccagcctgacaggacgtgtgtgtgcatatgtatgtgtgagcacatgtgcatatgagcatgtgtacgtgtgtgtgcctatgcatgtgtgcttgtgtgtgcatatgaacatgtgtacttgtgtgcatgtgtgtgtgygtgtgtgcatgtgagcattgtacacgtgtgtgtgcatagcgtgtgcacatagggagcttccctcagcaccccaggcacccgtccacccccagctctccccctgtttctgctccatcagcatggtcagtgcctcttcttgctgcagctctgggcaccactgagccccctcattgcttggtgagccttggagaaggggagggacgtgcaggggttgttgccaagggtgtgtcggaggaagggtggatgatgactgtgagctggaggactggtagttgggacctagctggggaaggcccaaaa

SEQ ID NO: 150173 - DNA, 601 bp, Human
atccaatgagtaagtctgggatcactgctgacatcccctctctgcacccctgtctgcccctcttccaggggtcccatcttacaccatagccagggtgtagagtgaaaggaacctccccaggtctggcaggaatggccaggacaaggggcactaggcatgcagccccggaaggtgagccctctgttgtgttcaggctggcctcatctaggatatcagggcagctcgggaccatccaggggtcccccctctgagcaggggctcagggctgctctgcctgttcctactgcaggaagtgacaaargcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcaggtaggggccagggtgggctgtggtcaagggtgggggtggggagatctgttctgagcactgtcctttctgagggctcaaaggccagcctgggaccccagcctgggctacatcgcccctgtctctattggaggtgtgttttcattcat

SEQ ID NO: 150174 - DNA, 601 bp, Human
cctcattgatcctttctaagccttccgtgagaagccaggctggaacctgtccacagggcacatttgaagatgggaaataatgtgtgcagtgcctggtgatcaggaggccccaccctcagcccctccttggtcctgttcagtgcaccccaaggattggtgctggctctttgccttgggctgcattctggtggtgtgttaacgagagaacgggcagaaatcactgccctgggcttgccatgggtgatatttggtgtttgccgagtataacagggctgaacagacaatggcagcctcatgcggyccccacgatctcacacacacattcagacacctcacactcacacctatgcacacacaccggtgcctctaccacacacaagcttgcacactcatcatgcacacataggtaggcataccatacacacttgcatactcacatacacacaccacatgcaggcacccacacaccatgcacactcatgggatcacacatgtgagtatggtgcgtataagagtctgcctctgactttaaggaaaaggtgcagacttgcccttgacagctgcatcttgtttgctctcttggaccctctctagctgtgtg

SEQ ID NO: 150175 - DNA, 601 bp, Human
tggaggcttgggtgaggtagaacgtcggcaaggagtggacaggacccagggtcctggagacagtgggcaagggctagagcatctgtggctgggccctgggtggccaattctgggtgtgaagaccccaggatggagtcaggaggtggccagcagtggggcctctaagaggggagcccaggagactcagagcacaggcagcctggccccaccctacccaggagaggcgccccatcctcagcctagaagctccttggaccctcttccatgacccggaagctgggactctggcctgccctgcatrcctcccctgcatctaaagcctctccctgcaggatgcctctccagaggcatggccagtgccacaactggacagacctgtttctcaagtttgatgcccacaagggctgtgggacttgggtttcttcaactggaataataatgtcacccacaaataacctggggtcccagctgcagacaaccgaaacagggtgggctccaggcctcaggaagttcacagaaactccggaggaccagagaacgaggtctgaatgggacgaagccagggccccacctagcgccttgggagatgcctggcatcctg

SEQ ID NO: 150176 - DNA, 601 bp, Human
caggcctcccagcccttactcccccgatcctgcccctccacctccctgacccctgaactaatggttaacagccatccatgaatcagtgtaaacctgtgccttcggccctctcttcttcagacaatgtgggcaacacatgtaccaggaagatgtcccttctccacgtccttcccctaggtgggcctcagtgtcacctagagttggggccaacatttcttgcagctctgtctataagtcacctccgaaagtttttcctcctcagacggcttcgagaccgtagggggcgggtgggctgtggggaaagcggcaatgcagcaggtactgtgggagtcgcagcccccgcaggtacagcctccctgcgccctccagacctgccctgcctcgggccccatccacagcacctgggcatgacgacagagcactgtgtgcacatgcagataccagtggggctgggcgagaggttgatactcgattgctgttgggtgtttcggggctcatggccacctactctgtctctctgtctctgtctctctcaccatcaggcgctccacccccacagcagcccagcagtgggaagttagctgaatgccaacaggagaga

SEQ ID NO: 150177 - DNA, 601 bp, Human
aggggactgtgtgagagcaggctgttccctgtctggctgcagagaagccctggggcccgggtgaggcccctctgcagtgagatcacaccctcagctgataatcacaccagtgtcacctcctctgttggtgctgggagctcaggagtgacgcccaccccatccccacgcctcccagcccaggaagccgcaggggcccttctgcctccaggaacagtgagctccgggggcctggaggctgaggccaggcaccaggtgaaggggccagccctgtggcaggggcaggggctacctgagaaggcaracccaaggcaggaggactgagtgcactctggctgccccggggctctgggctgaggggcaggcagtccccggaaaggctgggagagccagaagcagggacagaaagcagaggagagaaggacaggcccagagcgcccaagacactggggacaagctgagaccaagaggagagacgctgcttttgagagacagagacagacagacagaccaggagtggggagtcctagaaaaagaaaggtgttgagtgtcaggctgaggagaggctggcagaggaggtcagggagcaggcttgtgggggtac

SEQ ID NO: 150178 - DNA, 601 bp, Human
gggctgagcaggaccaagaccaagtctcggccacggggctacgaagcaggcacaggggtggtgccctgcatggggggacctggcatttgctgggaagggttgatatcaggagcttcagaccctgaaaggagtgagcatcagcagcttggagtgctgagcaagtgctgtggggacgcggaggagagtaggctaaagaagtcaagtgatttccaaagagagataaaatgatgtccctaaaacaaagatgagctggtgtagacatgtgacatgtacatcccaggacctggtgccacaagctgcytatgctgccagaagatgctgcccccatgctgagaggtcacctgcagccgccggcagggctgggctgccacagcatctccagggaccaggggctcatcccccaatcttgtccctgccctgtcctgagtgccttgcacagagcctggcacataaaatacctgtcaaattcatgcatgacattttgagaagcatgcaaatgtaagattgagcatacactcacgcatccccaaacaagtagaataacaggggcttggagagcggtagagcagcacagagtctgcaggaggaaggcggaccctgc

SEQ ID NO: 150179 - DNA, 601 bp, Human
catgtgacatgtacatcccaggacctggtgccacaagctgcctatgctgccagaagatgctgcccccatgctgagaggtcacctgcagccgccggcagggctgggctgccacagcatctccagggaccaggggctcatcccccaatcttgtccctgccctgtcctgagtgccttgcacagagcctggcacataaaatacctgtcaaattcatgcatgacattttgagaagcatgcaaatgtaagattgagcatacactcacgcatccccaaacaagtagaataacaggggcttggagagcrgtagagcagcacagagtctgcaggaggaaggcggaccctgctgtgcggaggctggtggagccgggggctcagtctagccccaggtggcaagtttggtggctctgagtggggactcggagagcccagggttcctgggccttccagtttttcaaaagagaggggaatgctgtggctacatgtgctgtcccttagcggtgccttaggctcccaagccttcccttcctcaggaagttattttggggaaggagagaactttgaagacagtggaccctgggccgcttctctgtgaggtgagacact

SEQ ID NO: 150180 - DNA, 601 bp, Human
gtagagcagcacagagtctgcaggaggaaggcggaccctgctgtgcggaggctggtggagccgggggctcagtctagccccaggtggcaagtttggtggctctgagtggggactcggagagcccagggttcctgggccttccagtttttcaaaagagaggggaatgctgtggctacatgtgctgtcccttagcggtgccttaggctcccaagccttcccttcctcaggaagttattttggggaaggagagaactttgaagacagtggaccctgggccgcttctctgtgaggtgagacactrgtgggccaggcccagggggagaggaatgtacctgaggtcactgagctgctgggcatgaccctccaagctgggtgctcctccttgctcctcctggctagtgaccccaagcatccctcctgcccgcccttggcctggctccttatcttccctggaggggctagagcgatagtgcctcctccgctgggtggcccagagggccagtttattgccatgatgttgccataagcaagagtccgtatcgtctggagctccgggcgcctgtgtcatgccttttacctgcctcacaggctcttgggctca

SEQ ID NO: 150181 - DNA, 601 bp, Human
ccttcctggcaccaggtccctccccagtatgctgggcatgtggggcccacatccctgccctctggggtgcaggaggttgggagttttttgggaaggtggggagaggagacaggagcagctttcagatgctctggggtgggaggaaacgtctctgtgtgcttagagctactcaaggaaaaggcagaactgcggtggcagagagggcagtcagtgctctgggctccgtggcacaatcttccaggctggagcccgcaggcctggccacccctccaggaaagggcccctccctgcgggtgcaggwgtgctctctgcaggcattccctcctcttccaccagggggtagcaggtgccaacgcgtccgcctccctggaccatttcactccttcaagtcactggctccaccgcgttttctgttcccaccccgtcacaactttggggcttaaaggcaccaggatctggcatccccgggatgccacctgtcttccaggatgtgtcctggctcccgatgccccaagctaagccccggacaggctgggaacctctccctagcagcccctgccctggtccctagggccccgcaggccttggggtggcagtggcc

SEQ ID NO: 150182 - DNA, 601 bp, Human
cgtgagggccgggcgcggtggctcacgcctgtaatcccagcactttgggaggccgaggcaggcggatcacgaggtcaggagatcgagaccatcctggctaacacggtgaaaccccgtctctactaaaaaataccaaaaaaattagctgggcgtggtggcgggcgcctgtagtcacagctactccagaggctgaggcaggagaatggcgtgggcccaggaggcggagcttgcagtaagcgagattgcgccactgcactccagcttgggcgacagagcgagactccgtctcaaaataaatagataaataaataaataaataaataaataaataaataaataaaaataacgtgagtagttttttaaaaaacatttttttcatgcccttgctttgcaaaataaaaaaaatgacagttttggcctggcatggtggctcacgcctgtaatcccagcactttgggaggccaaggtgggcgaatcacaaggtcaggagttcgagaccagcctggccaatatggtgaaaccccgtctctactaaaaacacaaaagttagcctggcgtagtggcgggcgcctgtagtcccagctactcgggaggttgaggc

SEQ ID NO: 150183 - DNA, 601 bp, Human
acatacacacacacgtgtaaacacatatactcacatgtgcacacataaacacacaccccagtacacactcacactcacatacacatacatgcacacacacgttcacacactgcactcgggagggccaagaacagcatcacgccaggctctgggagggcagcggctcccaaattcttagcgcccaacatggcctacaggacctgtgtaactggaccggcctgccggccctgttctcaaatgggaagccctacaggacaccccctgctgcactgcggctgtgcttgtgaatggcggtgggaaygcccatggtgggggttgctcttgactcttttccttgttccccggtctccccagaggacaggcctcctctggccacctggcccaggggcagcttcagaaatgtaaattggagtctgccactctcctgcccaaaccctgatttccgttggtcctcgaataaattccaaatgcacctcggcctacagggccccgtgggacctggctctgcccacatggctgagccccttggccccagtaggcctccgcctggaactcccctcgccctgcccttcctcggcagggcactcatgcgtggggccct

SEQ ID NO: 150184 - DNA, 601 bp, Human
ctgaaaatgccaactcagggccttcgcccccgctctggtccccctctcgtcccctctgccggaggcccctctccccatttctgctgcagatcctggcctccctgccctgcctctgaccacttctaggagggactcaggacgtccctcacctccggccgcagccaccgccagctgccgcagcagaagtgagctgggagtaattgagttgcagggctggggtgagaagaggcaggagcaggaaggtctggccgcggctccccagggtgccctgaagtgatactgggcagggaggggcagggayctggggcatctcgaggtgacaggggaggctgattctgaatgggtccctggacaggcctcagcccagacctcccctgccaagggctgggggtggaggtgaagccaaatcaatatttatagcatctcctgggcaccaggtctcctggctggggctgctccccagtggcctctgagggccatcccatatggggtggagtctaggggactgcgttgtgtcccagccctgctctcagggcagggtgaccaggcgctcccaagagctccactaccaacttcacttgcctctccctcgaggcccagt

SEQ ID NO: 150185 - DNA, 601 bp, Human
tgttatagagaaaacaaaaaccaaacgaatgctcccttgctctgaggataaatccccggccacagacttggccatgcccttataactgtttgactatctgcctgcacctctagagtgtaagctccttgaggccagggccgcagctgcagcatgtagtgccacatctggcaggcacagagtcgacttgggaagtatttgtcaaatgagtaaatgcatgaacctaggcctcttctaactctgaaatcttacatccctccggattgagaaaagaatcaaaagccattctaccactactgctgcrggaaacagactgccctggaccctgactcctctcctctggtggcctcaccagggcccgccctcggtcaacctagcctcgaagaagggaatgcttgggtgtttccagagactcctcagagcacgtgctcaggatagagtcctgatgcttctagagaccgtatgggcaagtcctgtagcctctgttggttgcaattgtgacagctcgtaggagcatggtgaggattcaatgatactatgtcagtgagtgcctaggacagtgcctggcacatggtaagcagcaatgaatgacactgctgctatc

SEQ ID NO: 150186 - DNA, 601 bp, Human
ttgctctgaggataaatccccggccacagacttggccatgcccttataactgtttgactatctgcctgcacctctagagtgtaagctccttgaggccagggccgcagctgcagcatgtagtgccacatctggcaggcacagagtcgacttgggaagtatttgtcaaatgagtaaatgcatgaacctaggcctcttctaactctgaaatcttacatccctccggattgagaaaagaatcaaaagccattctaccactactgctgcgggaaacagactgccctggaccctgactcctctcctstggtggcctcaccagggcccgccctcggtcaacctagcctcgaagaagggaatgcttgggtgtttccagagactcctcagagcacgtgctcaggatagagtcctgatgcttctagagaccgtatgggcaagtcctgtagcctctgttggttgcaattgtgacagctcgtaggagcatggtgaggattcaatgatactatgtcagtgagtgcctaggacagtgcctggcacatggtaagcagcaatgaatgacactgctgctatccattattattacccaattccctcactgaacgcagag

SEQ ID NO: 150187 - DNA, 601 bp, Human
cctggttctcatgacaatatgcagggtgggcaggggttaaggaatgcttccccactttggggatgaaggaaactgaggctcaaggaggtgcgaagccaggcagctgaggtcacacagccttggatctccctaccgtcactatcctcccctcttgccagcagagagaggtgggaaagccacgttcagccaaaacccagaaatttacccagagaaactcacaaaccaacatggtgggccttgtacaaactctaagagtatgaagagaagagctacagctggccttacccagtcctgccatgctgggactggtcagctcccctgcactgaatctgggtaggggcatgaaaagacacaagatgggatgagaaatcctccacatgggagaggaaatgggaacctttcatcactggggaccaggaagcagggtgaggggctcacaggacaagctggcctcaaacgttccccttccattgcctgttcaatgttactagatacttgcagacctctggcagaacagatggggacttggatataccttgtaaggggatgggggcatgaagacagattcgttcccctgaccaagggggaatcaaacaggtca

SEQ ID NO: 150188 - DNA, 601 bp, Human
atgctggaaattgtgagtgatatgttatacaggccctggatttacttacctccctataaagagcattgagttttgttttggcgagcatttaaattcctggcaaatcacaccgttcctgtcaaagtttgcttttagcctttgttagggagggtctgtttcagctttttgccttattcatagagtatagctcttctcttaaggtgtgatcttaatcctaacaaatggcttttctgaggtctcaacagaaagcccagggtgttcaccagtgcgtgggtgggcctgaacctccatatttcctcartgctctctgacccctgggatctttgctctgctctcaacatcgcggcagttgttcctgcaagcactccagagtctctccctgctaatgcagagcctagcaattagccaaggccccaaaggatctgttcgtgcagattttgggggctactttttctctgtggctccctcctttccagacccccatcatctcaaatgttagctgccttagcagccttgaactctgagctctatttcctttatccagtgtgaccgccagtgctaggagaccttgtatgcccagcattttggagaatatactcaa

SEQ ID NO: 150189 - DNA, 601 bp, Human
ttatccagtgtgaccgccagtgctaggagaccttgtatgcccagcattttggagaatatactcaaggataaagatgaagtaaactgcggggtccattcagtgcgattctcttttctcgaggatcattgcctcgagaaatgatttgttgctgtccagtgccctcctagagttgctgtacatactctgtccaggtcctagagttgttttcagtgggcagattagtctgatgccacctactctaacatggttggaaccttcttttcctggattcaagggggcgggggagggaatgatgtttgtrtggttaaaaatacaaatttattcaaacttgtctatgttcctgctaggtctcttgagtgtgtcattgggatataagatgaatcctttctctgccataacagttgaggctatagcccttattgagtacctcaaatggaccaaggctttattctaaagtgctttatacatctaattgttgtcaccttcccactcactctgagacatatgcactactatcattcccattttacagttgcagacattgagtgatgttgaggctaagttacttgcccaaggtctgttggctttattacttccccct

SEQ ID NO: 150190 - DNA, 601 bp, Human
tgtggtaattaggtcaggccaggcacggtggctcacacctgtaatctcagcactctgggaggctgaggcgggcagatcacttgagatcaggagatcgagaccagcctggccaacacggtgaaaccccgtctctaccaaaaaaacacacaaaaattagctgggcatggtggtgcatgcctgtaatcccagctacttgggaggctgaggcgggagaatcacttgaactcaggaggcggaggtcacagtgaggtgagattgtgccaacgcactcctgcgtgggtggcagagtaagaccctgtcaaaaaaaaaaaaagattgaaaataataataataatgaagtcagaccaggtgctgtaatagtgagacccccaaaacccagtagcatcagtcttatctcttctgtttggtccaaaagcaattggcttttccaacactgtgaataagccttcaatacctggtatctccatctctctttccacctctatttccaaatcgatagctcttacttgatctcatctctttccttaaggcataaaaaaagtatatttctttctccctttctccctgggtgagagttctagattggtgggaggctctgttc

SEQ ID NO: 150191 - DNA, 601 bp, Human
tctttcttgctcctgctcctgccacgtgagatgtgcctgctcccccttcaccttccaccatgattgaggataccagcaccacgctgcctggtcagcctgtggaaccatgagatgaatatacctcttttctttataaattacccagtctcagggatttctttatagcaatgtgagaatggactaatacagagggcttggtcaatactctaaggtcaagatagctgggctcccttggtgtcatttcgtaggttgtcttggctgtgaggaaacaggctctccagaaacaaagtccctcttgcgygtcttgagatgctttcatatccatagcccactgtgcaacaggcaggtaaatatcaccaagtgactccattttacaaggaggaaaggaaggctcaaagaggcaatgtgctgtggccaagtccatgaacaggctagggttgggaccaggaactcagccctggttctcctggactcccaggcctgtgctcttgctagtgacaccagggcatcctgtgctgaaacaattgggaaaaggtgtcatgtgaaccctatcaattataataaatatttatacaaggcaggcaatagctgtccctttggg

SEQ ID NO: 150192 - DNA, 601 bp, Human
ggatgaagaggtcagctttggaggtgctgagtttgaggagccttgagagtgtgaaattccattcctgggcattcttgtctggtttctatgaaatatgggaagaataaataaattgaataatgcctgctttgcccagtagaaagcattagaactaaactagaataaggcaggcctcccccagccccactccggagagttgggactggaccagtgtgctgagctgttttcacggaatgggtccctcaaacagcatgcatccagcccagacccgcccttatgagtcaggagacctcatgaaatmcctgggcagctaggtggtcaggaacagttagcatgggacatccagggaatgtcggtcaaactgacagagtcccaggccttgggaaccaccagtacagctgtggtaacaagatggaagatgccggggcagagagccaaaatgcagggaggaagagtgtggcccaggcaggtgtgtgctagttcataggcaaaggcagtcaagacagggctggtagaatctgggttggcttcttggagacagaactggatggcagcttcaatattccagccatggttgtgacctcaggtgtggggtgcctgt

SEQ ID NO: 150193 - DNA, 601 bp, Human
gtcctcccctattttctccttccttttcgcggctttccctcctctaccagacccggcaggaagaaagccacccacaaacgaataagcatgcccttgccctgcccgtgcgtggcactccgcatccgcttagctcttccccgccgcccgaaggcgggcgtctccccctctctgcggagcaggcggcggcggctgcgagtccgtgactcgaccaaggtcacgcagcaaagtcagcgaccaagctctgttccgcagacgccagggccaaagcccacactttccctaaagccccgagtgcacgcgsgtttccagaacgggagaactttggagaccaacttctgcattttcaaagggggccagcctgggcccagtttaatctccggcggaggaccggggttgcgggaaatgcgccggggagtgagggcttcccggatcccccgccgccgactccgcgcgggccagcggcgcggggcgggccgggatcagcgcctccccgggagagcgcagccgccgccccctcctctcgggctcccggcccctccccagcccctcggcccccatcctgcgcgtgggagaaaccgccgaccgcgcggcctccaggggc

SEQ ID NO: 150194 - DNA, 601 bp, Human
ctgcacctctggccgtggggaaggggctagctcgtcctgttctcgtccctgttgccctctccgaggacatgggcatcctgcctgccccagcactctgctgaccttgccgggctccaactctcagtactgagacccagaggcctgagaatgagagagagcgagcttgcccctgcctgggagctgcccagcagcccctcgggcatggggaagtgccccaagttcctgcgaagggctgctgagtgcgggaaggggcaggaagcaaggcttccctccattctaccttcgatgtccagggctggcycttttcccaaagtccacagccacatgcccctcagaagccactgggctctgccacaccttctctcttggtgagtgtatgaggcccagagagaacgggcttgctccaagtggttcagaggggtgccaccaggagctttggattggagatgggggagaaagtggcccaggctgggccttcgctcggccggatgctggccctggcaggaggaatctgtgacagggaacttcgtgggacatacaggtgctgggattggggcagagtgtggaggggtgagcgtcctgtgctgctgtgcctcagagg

SEQ ID NO: 150195 - DNA, 601 bp, Human
ttcccaaagtccacagccacatgcccctcagaagccactgggctctgccacaccttctctcttggtgagtgtatgaggcccagagagaacgggcttgctccaagtggttcagaggggtgccaccaggagctttggattggagatgggggagaaagtggcccaggctgggccttcgctcggccggatgctggccctggcaggaggaatctgtgacagggaacttcgtgggacatacaggtgctgggattggggcagagtgtggaggggtgagcgtcctgtgctgctgtgcctcagaggaccrtgcctcctgcagggattgccatcccctgtccccttgccccattttctttccccatctggagcctggggtgggcgtggggggtggctggtgcacagggaagctgtgatctctccattgctcttccctgatcctcggggcctccagtggccaggagcaacagccagcctcacttcacttagtacctcagaccttcctaacagcgggttcacccacagtcgggggcagtgtgaggtttgcctttgtgatttctgaggaggtttctttgcaaggtggacagtatgcacaagatgacagatggtt

SEQ ID NO: 150196 - DNA, 601 bp, Human
gggggctgctgcagagagcacagaggctggaggtggggtgtgctcggtgtcatcagggtaagtgggtggagccgagtgagtgaggagtggtggcagtggaggtggggggccagtgggctctttacccagctgtacattatcattgtaatcacctgggaactttaaaaaatacccgctgtgcccaccctggggcatcgaactctaaatctctgggtgaaacccaggcactgggatttttaggagtttcttgggggactctctgtcctgggtcccccatcagtgcctttctctgggtgacttyatgggggagtcactgcagccacttctcctgagcagtgttcagtgtcatcaggggtgagcaaactctgaagccagagttgggagttgggcgcaaggccttcgaggacaggggctctgggtcagcagcagcagcagcccaggagcttggtagaaatgcatcttcaggcccctgccccaaacctgcgggctcagaaagtctgggcttgggcccagcggcttctctcttccccagctccaggtgctagggacatactcaagcctgaagactactgccctggccaggggtggacctccgcaagga

SEQ ID NO: 150197 - DNA, 601 bp, Human
ggtatcatgtgaagtcatgagtgcagggccacaccaaggctctcagtggacccaggactgcaggaattccagggcttcccatcattaaattaaattagtattgaaatgcagtatctatgtcaggaaggccatgagtgttccccttggtgaccacatgtgtacttttggaaatatcagatccagtcacaccccagcctggtgccctgccttgctggcctcgccttgctgtggctggagctggaactggctggctgttgtctgagccagctgtgtccacccctggcttctgtgtgtgtcaggyacaggccgtgcgcagtgtcacacaggggcatgaatgtgctgcagtgcaccaaggggaccttgaccagcagctttggggagtactggtggggggagcatctgaatggagtgtgttcaggagggatgggagccggggaacatggcacctctttggagttttgccacagaggggaacaggatgggtgacagctgtcaggggacataggctcgagaggtttttagagaatcttccattgcttctgcttctctcctatgtggcaagctgcaggaggcctatgaggggctttgcagaggtactggt

SEQ ID NO: 150198 - DNA, 601 bp, Human
tcaggggacataggctcgagaggtttttagagaatcttccattgcttctgcttctctcctatgtggcaagctgcaggaggcctatgaggggctttgcagaggtactggtgcagctcagagaggtttcacaggcttcacccatggggtggcgaaaaagtgcctcttgcccagtacctggtgcatttcagcttagtgaattaaagatttggagacactttgctgagcttttgcacagagaggactacatggggtatgggacaggacctggactgagacttttacacactgggaagaaagcccwgcttgtagtctgtcaggctgctgtacaacttttaaacatcaaaaagtcctcatgcttttactcctttggcaaaatgcttgttggatagaggaattcaaacttgattgcagcccccctggctatcaacggtgtattagcctgttttctgctgctataacagaataccacagaatgggtaattctattgtacagaaatgtattggtttacagttctggaagcttggaagtataagacggaggggctggcatctggcgagggccctcttgctgtgtcataacatggcggaaagcatcacatgg

SEQ ID NO: 150199 - DNA, 601 bp, Human
tcagcttagtgaattaaagatttggagacactttgctgagcttttgcacagagaggactacatggggtatgggacaggacctggactgagacttttacacactgggaagaaagccctgcttgtagtctgtcaggctgctgtacaacttttaaacatcaaaaagtcctcatgcttttactcctttggcaaaatgcttgttggatagaggaattcaaacttgattgcagcccccctggctatcaacggtgtattagcctgttttctgctgctataacagaataccacagaatgggtaattctrttgtacagaaatgtattggtttacagttctggaagcttggaagtataagacggaggggctggcatctggcgagggccctcttgctgtgtcataacatggcggaaagcatcacatggctgaagggcacagggagcaagagagagtaagaggggcaaaactactctcatggtaacaaacccacttctgcagtaagggcactagttcattcatgagggcagagccctcgtaaactaaacatttcttaaaggtcccacctcttgccaagcatgatgctgtgcacctgtagtcctagctacgtgg

SEQ ID NO: 150200 - DNA, 601 bp, Human
atgtcaccaaaagtgaggatccaacagcataagaatgacacaatggactttggggactctggggaaagggtgggagggggtgagggataaaagactataaattgggttgagcatatactgccggggtgatgggtgcaccacaatctcacaaatcaccactaaagaacttactcatgtaagcagacacgacctgttcctcaataacctatggaaataaaaaaaaattaagtgggagtcataaccattttgccatccttaatttctcttacaaaatttgtgtctttgccatcccgtttctgtrtgtgaacacttttgtctccatccaggctaacaacagacatactctaccagtgtacagtgtctgtcatcagcagtggtgtctctgtgtgaatgaatatgctttgagtcctgctcaccactttgtctccttcctgactgataatcactgttggtttggtcacatttccacctgcccagtggcaaagcctacacctttgatgacccttcatgtcgtcatcagagttctgactgtccctcagcttccaggtagcacaaaaagcccccaccatccttccctctccctgtttagctccaaaacaga

SEQ ID NO: 150201 - DNA, 601 bp, Human
tcatcagcagtggtgtctctgtgtgaatgaatatgctttgagtcctgctcaccactttgtctccttcctgactgataatcactgttggtttggtcacatttccacctgcccagtggcaaagcctacacctttgatgacccttcatgtcgtcatcagagttctgactgtccctcagcttccaggtagcacaaaaagcccccaccatccttccctctccctgtttagctccaaaacagatcaaagagaccggagcaagactcttggatcttactgccactgaaattctggagacacctttgcytaaattttgatttctaattgttcattactgatctgtagaaatgtgattgatttttgtatattgaccttttttctttggggggaaacattctgttttttaccgttaagaatgatgttaactatagattttgtgtagatgctctttaataatgtggggaagttccctttcattcccagttatttttaatgaatggatgttgaattttgtcaaatgctttttctgcatcaattgatatgattatgtgcttttttcttttttagactattaatgtggtggattatgttgttttatttttaaata

SEQ ID NO: 150202 - DNA, 601 bp, Human
aatcactgttggtttggtcacatttccacctgcccagtggcaaagcctacacctttgatgacccttcatgtcgtcatcagagttctgactgtccctcagcttccaggtagcacaaaaagcccccaccatccttccctctccctgtttagctccaaaacagatcaaagagaccggagcaagactcttggatcttactgccactgaaattctggagacacctttgcctaaattttgatttctaattgttcattactgatctgtagaaatgtgattgatttttgtatattgaccttttttcttkggggggaaacattctgttttttaccgttaagaatgatgttaactatagattttgtgtagatgctctttaataatgtggggaagttccctttcattcccagttatttttaatgaatggatgttgaattttgtcaaatgctttttctgcatcaattgatatgattatgtgcttttttcttttttagactattaatgtggtggattatgttgttttatttttaaatattgaatcagcctcatgttcctggaaaacccctcttggtgtggtgtattattctttttattcatcaaaggattcaat

SEQ ID NO: 150203 - DNA, 601 bp, Human
tccacccacctcagcctcccaaagtgttggggttacaggagtgagccacagcacccagccttaatatatctttgtattaggagtatccctcttgtaaacaggatataattggatcttgcttttccagtctgaaaagtctgcctcttaatcaaaggattcttaccatccatccatccatccatccatccacgctgctgtgtgtacatctgctccacggcacagttctccccagtgtgcagcctccatattttgcctacccatcctgcctgccataaacccctgagttgcctccaactctccygccaaaaatgctgttgctgtgagcatccttgtgcaggcccctgggcaggggaagagtctatgtgggatgcttgcctggcgtgggatgctggtttacagggtttgcctatacttaatatgactaaggattcgagatactacagtatgtctatatggtgatgggaatgatccagaagaggggaaaaggtgatgaggaaagagtgggagacttggctggcaccgcttgcctgagtaggtgagagggatcgggacccactgcacaagtggcaggtttgcctttgctgggagcaggcacagttca

SEQ ID NO: 150204 - DNA, 601 bp, Human
aagcaacctgagggtaaggatgggagaggagatactggaaacttaaggggaaggatggtatgaaatagttatcttggagatggggagcatgtgtggaccaaagaaacagcccaattgctgagcagctttcagggtgctcttgtggttagtgtgagtgggcagtgcaggctgtctttcccaccacgctctcgggagaggcctgggtatggagcaagctcagcacaggaccagtgcccagcaccatgccaggcaccacgggcacaggatgagctgtgcaggacagctgcccctgaagagctcrctgtgcagtgggagaggcagcagccagcaccagagtaccagccatgagggtgattatggatcaccaccattctgtgtggcccaggggagacagggcgacggtgcagcggggcccatgagtcctgggtctgtgggaaggtggcgctctgtaattatgcgaggatgctgctcagcaaggtgtgggcactcagtgctgtttcagccctagctttattttgcattgtaaaagtgatgcatgtcacaccaaaagaaattaggaaaatgttttttaaaatcataaataaaaaagtaaaaatcacct

SEQ ID NO: 150205 - DNA, 601 bp, Human
acagatttgctgaacgctctggccaccagggcctttctcgtgcaactcatctggcttgccaggacgtgcagagcttccaaaacgattccgtagactgttggggcctcttcagtgcccaggatcaagtcaggcccagtttggaagtggcagccaggcaggcatctggaggtgcggccgcttctctgttacctcccccgacagtaaactgctccatgtgccagtggccaagcggcatccagggccgtgtgagggcagcctgcaagcccagcaaccacatgcgactcccaccccctcgctgagsacctgctccgggctctgccgggagaccctcctgtgcactcttgtgcaccttcacctggaagtatgctgtgtcactggagccctcaccctgcctagcccctgccatggggacagccgtagaacagaggctgtggatgtgacagggttcctacactttggcattcagagcatggagttacaacttgccatggttgcactgtgtatggccaaggaatttagaaccagcgtgcactcagacatgggctggctggacttggggtcatctgtgtattacctttatgaatggagactagccagtggc

SEQ ID NO: 150206 - DNA, 601 bp, Human
caaacatttgggaatcacctattcaacaaaagtgaacttaagtaaattatggtagaactcagcttgttgtatcactgtttaaagaaaggggttaagaatactttatgatggggccaggcgctgtggctcacgcctgtaatcccaacactttgggaggccaaggtgagtgaatcatgaggtcaggagttcaagaccagcctgaccaacatggtgaaaccccgtctctactaaaaatacaaaaattagctgggcgtgttggcacgcacccaatcccagctactcagaggctgaggcaggagartcgcttgaacccgggaggcggaggttgcagtgagccgagattgcgccactgcactccagcctggtgatggagcaagactccatctaaagaaaaaaaaaaaaaactttatgatggctgggcccagtggctcatggcctgtaatcccagcactttgggaggctgaggcaggtggatcacttgaggtctggagtttgagaccagcctgtccaatgtgataaaaccctgtctctactgaaaatacaaaaattagccgggcatggtggcacatgcctgtagtcccagctactcaggaggctgagg

SEQ ID NO: 150207 - DNA, 601 bp, Human
ttatgatggggccaggcgctgtggctcacgcctgtaatcccaacactttgggaggccaaggtgagtgaatcatgaggtcaggagttcaagaccagcctgaccaacatggtgaaaccccgtctctactaaaaatacaaaaattagctgggcgtgttggcacgcacccaatcccagctactcagaggctgaggcaggagaatcgcttgaacccgggaggcggaggttgcagtgagccgagattgcgccactgcactccagcctggtgatggagcaagactccatctaaagaaaaaaaaaaaawactttatgatggctgggcccagtggctcatggcctgtaatcccagcactttgggaggctgaggcaggtggatcacttgaggtctggagtttgagaccagcctgtccaatgtgataaaaccctgtctctactgaaaatacaaaaattagccgggcatggtggcacatgcctgtagtcccagctactcaggaggctgaggcaggagaatcgcttgaacctgggagggggaggttgcagtcagccaagattgtgccactgcactccagcctgggcgacacagcaagactccatctcaaaaaaa

SEQ ID NO: 150208 - DNA, 601 bp, Human
agtgcatctgcttccaaaggccaattaagagagcctcaaaattgtgtacatgccatatattttcttttcaaaaatagttcatcttagctgttttaacccattatcactaaatacagaatgccaaggcaagctgtgccacattcgcttagcagccccaagtctgtgtgttttttaacatgctcagattgtgaggtgatgaccattgctgttttcatgtaaagaggcaataaaaggtgaaaactgttcatttcatagcaagaatgagagtgtgtagccagcaggtacataaaggaaacaaatytgtgacagtgtggtggggaagggacagaggccaaaactctggattgggacactgggatttagtctcagttgtgtaatttaggggctgagtgacctcaggccaaacatctcatgtctttttgccttagtttattcatttgccaactaaatggcttgttaagacttcttcccaacgtaacgttttatcattacacaaatgtgtaaaagaaaaaaaaattattaaccagcattgtgttaatagaagattttccacatttggtttttattaaacttcccattttgctgcacaaattctccagat

SEQ ID NO: 150209 - DNA, 601 bp, Human
ccatccaagcatcctctccatgtaaaaaggggagattcacatctgatagaaatttttatttttagttaattagatatctaaaaagagacttagatttttggacttttttaaaaggaaagagctagagaaaaagagaaacagctttctagagaagtttgcattaaaaacctattcctgtccttctaggagcacaagattcaggatttctataagtttctagaaattgttctgtattaatggggagagcatcctatgggaggcatttattccttgtggtattattttccctggcatatcatgygcctctgaaattttttacctgtaggtaataaaaattctctctctctctctctctctttttggtgaatgataggaggaagcagagaaggaagaatctagcattatttctgtggcctacatttgttaataagcagcttccccagaccagaccacagtaatctactctttctctggttatggtttggctttgtgttaaggtaggcatcagttctaggaagaacactgtcctcttaagcagctgagaagtgtggcctagtgctgctaagcgatctcatgttcatggggtcccaggccaaggcat

SEQ ID NO: 150210 - DNA, 601 bp, Human
taagtttctagaaattgttctgtattaatggggagagcatcctatgggaggcatttattccttgtggtattattttccctggcatatcatgtgcctctgaaattttttacctgtaggtaataaaaattctctctctctctctctctctttttggtgaatgataggaggaagcagagaaggaagaatctagcattatttctgtggcctacatttgttaataagcagcttccccagaccagaccacagtaatctactctttctctggttatggtttggctttgtgttaaggtaggcatcagtyctaggaagaacactgtcctcttaagcagctgagaagtgtggcctagtgctgctaagcgatctcatgttcatggggtcccaggccaaggcatttaatcacaatgtattaggagaaatttcaggaacatttatgttttagaagaaacctgaaactcagagcttggggtcctgaagattgggaattatccaatcctgacttgtaccttttgagacttctctagttttgtaaagatagcgtacgtaggcagctattcaccccaaagtgtgttttactgggcaccgtttctgagcaagaatagta

SEQ ID NO: 150211 - DNA, 601 bp, Human
aaattttttacctgtaggtaataaaaattctctctctctctctctctctttttggtgaatgataggaggaagcagagaaggaagaatctagcattatttctgtggcctacatttgttaataagcagcttccccagaccagaccacagtaatctactctttctctggttatggtttggctttgtgttaaggtaggcatcagttctaggaagaacactgtcctcttaagcagctgagaagtgtggcctagtgctgctaagcgatctcatgttcatggggtcccaggccaaggcatttaatcasaatgtattaggagaaatttcaggaacatttatgttttagaagaaacctgaaactcagagcttggggtcctgaagattgggaattatccaatcctgacttgtaccttttgagacttctctagttttgtaaagatagcgtacgtaggcagctattcaccccaaagtgtgttttactgggcaccgtttctgagcaagaatagtagctattttgcaacaggtagaactggatattgtgggtcagtgctgtgttacacaaagaaaggagttttgtttctttttcactgtaagagttctcagagca

SEQ ID NO: 150212 - DNA, 601 bp, Human
ggaagaatctagcattatttctgtggcctacatttgttaataagcagcttccccagaccagaccacagtaatctactctttctctggttatggtttggctttgtgttaaggtaggcatcagttctaggaagaacactgtcctcttaagcagctgagaagtgtggcctagtgctgctaagcgatctcatgttcatggggtcccaggccaaggcatttaatcacaatgtattaggagaaatttcaggaacatttatgttttagaagaaacctgaaactcagagcttggggtcctgaagattgrgaattatccaatcctgacttgtaccttttgagacttctctagttttgtaaagatagcgtacgtaggcagctattcaccccaaagtgtgttttactgggcaccgtttctgagcaagaatagtagctattttgcaacaggtagaactggatattgtgggtcagtgctgtgttacacaaagaaaggagttttgtttctttttcactgtaagagttctcagagcatttagtatatgtatatgcattagaaatcctcaagagggaaaaggagtatttatttggccatgctttctgggaaacatac

SEQ ID NO: 150213 - DNA, 601 bp, Human
tttcaggctcataaatgagtcacaactttaaaatgggccctttcaagttataaaagtcggcagtttgaaagcattcatcctgcatctgtgacttgcaaaacatcaatgctaagtataatgtttgccaaataaattggtcattaaagtcttttatggaaagaaaaaccagtactccctcaaattcaattttctcttctttcttatgtagatatgcttcttgttttgttttgttttgttttttgtagttttattttttgagttggagtcttgctcttgtcactcaggctggagtgcagtggcrcaatcttggctcactgcaacctctgcctcctgcgttcaagcgattctcctgcctcagcctcccaagtagctgggactacaggtgcccgccaccatgcctggctaattttttatgtatttttagtagaaatggggtttcaccatgttggccaggctggtcttgaattcttgacctcaggtgatttgcccactaggcctctcaaagtgctgggattacaggcgtgagccaccacacctggccttgtttttattttttaactctttttggtctacctcctgagagaataatgaggaatagtat

SEQ ID NO: 150214 - DNA, 601 bp, Human
tttttagtagaaatggggtttcaccatgttggccaggctggtcttgaattcttgacctcaggtgatttgcccactaggcctctcaaagtgctgggattacaggcgtgagccaccacacctggccttgtttttattttttaactctttttggtctacctcctgagagaataatgaggaatagtatttgttggcaaggggctttgagatcctggtttaaagaatgcagattgaaaataccagcactgttaaattcacgtagaaaaaacatgaaaagctcagcagctcaggaatccaacctcartgatctcatagccagttcattatggtcctcctcatcctgtcatccatgctgatgtacagatttcatggaatagaggtcctaagtgttttctgactttgaaaatccctgtaattatccatatatacatcagcagcatgcatgtgtgcactcctgggtagcattctcatgtaattcagcttcagaaccactgtgccagataaaaagaaggaacataaagtctaaatgtaaacatgctgacattcaagccattttgtctttaaggaaattaatacatttcttagacataaatagggcttggtt

SEQ ID NO: 150215 - DNA, 601 bp, Human
ttttattttttaactctttttggtctacctcctgagagaataatgaggaatagtatttgttggcaaggggctttgagatcctggtttaaagaatgcagattgaaaataccagcactgttaaattcacgtagaaaaaacatgaaaagctcagcagctcaggaatccaacctcaatgatctcatagccagttcattatggtcctcctcatcctgtcatccatgctgatgtacagatttcatggaatagaggtcctaagtgttttctgactttgaaaatccctgtaattatccatatatacatyagcagcatgcatgtgtgcactcctgggtagcattctcatgtaattcagcttcagaaccactgtgccagataaaaagaaggaacataaagtctaaatgtaaacatgctgacattcaagccattttgtctttaaggaaattaatacatttcttagacataaatagggcttggttggagaaaatgcaagtgcttcctacttcctgctggattttctgcattgtattttttttaattttatactctttattttaaaatgtttccttaatgtaagattgtattaatacaatcatagaaatgcaag

SEQ ID NO: 150216 - DNA, 601 bp, Human
gtttctccgctgcttgctgactggtagagcaatgtctagtctatggatggttcctgaggctctgcggagaggggcatcagtctgtcccaccctgatagttccaatgctgttttgtctctcattcaaaatcccatgagtcaataaatagtctgatcactgtcaaataattaaggatactaaaaaaggcccaggcatcagatatttaaaccatagtgtggtggtaaagtcaaagccattttgggtttgtggccattattcagtgactgtttggtgaataaatattagaatttaaaaactttgkgtagaattttaccatgatttttggttacagtgtaaaaagacaaaaggatctttgtcattttttaaaacaactttattgaggtataatttacgcaccgtaaactccatctatttaaagtgtacaagccaagaattttaggggctatgcaaccatcactacaatccagttttagaacagttccatcaccctccaaaactttcatcatctccgtgcccatttgcaataaatccctgctccctcttgcagtcttccaggtgaccactaatatactatctgtctccatagatttgcctttctgag

SEQ ID NO: 150217 - DNA, 601 bp, Human
gtcagtcttgccttgcctcccaaagccatgcaggaaaaaagccagctacacacacacagctgactgtgagctctttgaagaggcttaactcccttgttcagttctgtgcttcacatgcctcttcttgctgcccttttcctaccctgaagtctttcttttctagtaaccactattttctagtaacagcaaagagaggaaagagcaaaaaaagactgtttttcaatcctgcttaaaaagtctttccagttcttgcgttgctttgatggttgtagtagctgcgaaaaatgaagcccagagaatrtccgtcattttttcacttaggattaagtgttcctgacttgcctccaatgggaattttaagattctttttgttttctctcctagttgaggtagtaatttgttttgattgatccacagctttcttcatgaccaaaagcaaacatttgcaatgtgtctgaccccgttttagggatgtagctagacattgtgaaaaaccaagctcctccgtcccttttaggtgaccttgctgggttttatgaccgtccacagtcatgactttggaaggatgatgctctagccatgggctgcttgaccaaatgat

SEQ ID NO: 150218 - DNA, 601 bp, Human
taaaaagtctttccagttcttgcgttgctttgatggttgtagtagctgcgaaaaatgaagcccagagaatatccgtcattttttcacttaggattaagtgttcctgacttgcctccaatgggaattttaagattctttttgttttctctcctagttgaggtagtaatttgttttgattgatccacagctttcttcatgaccaaaagcaaacatttgcaatgtgtctgaccccgttttagggatgtagctagacattgtgaaaaaccaagctcctccgtcccttttaggtgaccttgctggkttttatgaccgtccacagtcatgactttggaaggatgatgctctagccatgggctgcttgaccaaatgatcactgtgtgactgttctttatactgtgctttgtatcacagtgacaggatattatagtacaggtcatagggatgtggcaattgattttgacatacgatattctcagtgccacaggagcaaaagatgtttgagtgactactgtctaatatctttgctttcatgtctctgctcatgatttagtcttctaaaagctttctgtgtcatataaaatatactgtttcagtttattaa

SEQ ID NO: 150219 - DNA, 601 bp, Human
gtcctgctgtgcatttaatttcttgggtatttcctgaaagccccactaataggaacagcgatctagaattgctccttttggaaatgcactctgcagatgctgctcactaaggtctgcagaacttctgctaattcccaccaactgcctctggggaaaaaaaggatcatgagttttaaacccccacgtttcacttcctcatacaagcatatcttcaagtaatcacataactgaatgtgcctgagtagactaaatttgaaagagaacgtaataatttttttcgtagctctttatccagttttartttgtattagagattttacctggtttagactttgtcttaatttgtgcttcttattgataatgttttgaagggaaaaatagcagcaaggattaagaaaatgaaaatattctttattagtgtggtacactagttaaagcaggggttggtaaaccatggcccttgggccaaatctggcccaccacttgtttttgtaaagcctatgagctaagaatagttttcacattttttaattgtttggcgaaaaagagattatgtgatagagactatatgtagtctacaaagcctaaaatatttattacc

SEQ ID NO: 150220 - DNA, 601 bp, Human
tactagctagatgcataagtaatttatttttacatatactaaataaaaactaccttattggcctgtgcagtggctcatgcctgttatcccagcaattgggaggccaaggtgggaggattgctttaggcaaggaattcaagaccagcctgggcaacatagtgagactcccgtctctgcaaaagtaaaaaaaaataagaattagccagatgtggtggcatgtgccttcaggcccaaatacttaagaggctgaggcagcaggatcacttgagcccaggagtttgaggctgcaatgagctatgatcacgaggctatactccagcctgggaaacatagtgagaccctgtctcaaaacaaagctaccttctccattcatctacagagaatgcagtaagatatgaaagaattgctctgatctcttgaggaatctggtctcctagattttaacttcattgaccttgggtaacatcagtacaacactgagtcattaagaaatctaatctgaaagctgtggaggagcaggtcttgggatggacttggaacagtagcctctaaaacatagtcattggacattggcagaatgcctttcctttgactagggaaa

SEQ ID NO: 150221 - DNA, 601 bp, Human
cccacttcttcatgctatttgatccttcagacaggctgtaggtctggctcattttggctgggcctgctgtgggccaaaggactatcattttatggcaattttcaagttaggtaaaaataatattccccttccacattatttttgatggccatatttttcatatttaagacagtttgggatatgactaaaaattgtggtggtgattctttggcaaaacaagttgatttcttgaatgctgcagatttttgtacctttccaatacagcctaatttgtcttagctacttttcgatctattttgcrcatagccttggatattcttgattttagtatatgtttcctttttatagaatggtctttgctaggaaggaataaatcctgacatatggtttttagtgaaccaacatacatgaaattttacaaaaaaaaaaagccaacatgttggttaggtgttaagacaaatttaattaattaattaattaattttattttttaaacatttttgagacagagtctcgctctgtggcccaagctggaatgcagtggcacgatcccagctcactgcaaccaccacctcttgggttcaagtgattctcctgcctc

SEQ ID NO: 150222 - DNA, 601 bp, Human
attaatctttttggtcttttttgtaagaagccaaggtatttgaaccacccttatgtttcccagctttttatatcagtagtcactggtattctaccaaaaccattctgctaattagttttttccaacatcagtgctaggcacaaagagagaatgtgagttaatcagaaagcgaacttgtgctgctacaggagatgtctcaaatcaagggggctattttagacacgtcttactgctatagattaaatttttatgttcccccaaaattcatgttgaaacctaatttccagtgtgataatatttraaactggggtctttcatagatgattgggtcatgagggtggagccctcatgaatgggattagtgttcttataaaaagagaccccagagagctccctagccccttgctctgtgaggacacagagagaaggtgattgtctgtgaaccatgaaatgggccctcacccgacactgaatcttcctgtgaattgatcttggacttctcagccttgagaactgtgagaaataaatgtctgttttatataagccagtcagcttatggtattctgatatagcagctcaaacagactaagacaattactct

SEQ ID NO: 150223 - DNA, 601 bp, Human
ggctattttagacacgtcttactgctatagattaaatttttatgttcccccaaaattcatgttgaaacctaatttccagtgtgataatatttaaaactggggtctttcatagatgattgggtcatgagggtggagccctcatgaatgggattagtgttcttataaaaagagaccccagagagctccctagccccttgctctgtgaggacacagagagaaggtgattgtctgtgaaccatgaaatgggccctcacccgacactgaatcttcctgtgaattgatcttggacttctcagccttsagaactgtgagaaataaatgtctgttttatataagccagtcagcttatggtattctgatatagcagctcaaacagactaagacaattactcttccctaaaaagagaaaaaagactgaatgtacaagtctgttatggattacaaatggctaggcattccaaaacaaagcaaaataaaaaaaacgaggatcatatattatttaagtgtcgtcttttaaatacccttcagtaagtctgaccatgtggtctcctggatttgctttgtgtacagctgtgggctgttttttttgagcaaatgtggg

SEQ ID NO: 150224 - DNA, 601 bp, Human
gatttgctttgtgtacagctgtgggctgttttttttgagcaaatgtgggcagaccatcgtcagagactcatagatgactgacactaatctgactggaacttctcagaaagcacattctgttaaagttggttgtcctattgccagacaaatgattagcacttttataataagttttatcagccttggggctattctttggccagatacagtcttagaaggtaaaagttacaattcatgttatgtggcaaataaagttaaaacatagaagtatccacatctcccagcacataagctggcacaragctggtgttcaattaatgcattgtctgttaagcattacctgaagtaaaacaagggatattttcccaaattttcatggagtactataccactgattcacagcttgactccttgagggcagggatgatagctcttattttctctgtgcctggcaccaagcactaaacctggaacagaaccagtgatcagaaaatagttgttggataagagaatcgggctaatttttgatattttgctgatttttaaggttcatttctcatcgtgtcctcagatttaattaaatgggaatatgggttcctac

SEQ ID NO: 150225 - DNA, 601 bp, Human
gtgtaaacaaactgtcatttgagagagaagcaatcactataatcaagggacaagcaaacaggtcattaagtcataatttcaaaactcaggggaagactttctagaaagaaaacttgatttgaggcttcagaataaatccaatttcaaaaggccaaaaagtgaggcaggatatcccagacagaaggaacagcataaatacaggcatggagaaagggaaggtgcagggcagtttcgagggtcagagaagtatctgtgtccaagtgaagaatttatgaagaagggttgcagttggaaattaagstaaattggaactgatgcatgggaaaatacggagtctggattttagtccataggtatgttcccaaattctttcttggtgatgtttatgccaaaggcattattatttattagaacttttattacattgacatttttcttaaatactttgacttaccataactatggataataatcctgtattacttgccctgaataaattcaaaaaaccaaacacttataacattttaatttgacactgttctttcactaatgctctgaactgaacctgcaggcttgttaaaaagggagatgagcacacatc

SEQ ID NO: 150226 - DNA, 601 bp, Human
tgtcttacaggattccctttgcgattgtagttttatcttcccaatcatttccctcagcttttagttagattctctaacggaagcatataaaattaactttctgaattgttccatgggatgaagcattacacactcacagcggaaaggaaagtttcacattttgtagactacaagaaaagtttgcttattgtggaatggggaactttttaatgatgccatctaaattgaaccaagtgggaacatgaccaccagccacccacctgcacctggagtcatctccatcctgccacagcactcaccrtgtttcctttacttgttctcttctccccctgcaccttctcctcttccaagagcaaacttgtcctgggacttccctgacttctagctcaccaagttcccaattttctactcacctggtactttaagaatcttgccatttctttgaaatattttccaattaacaataataaaaaaattttgacatgtgggtttgatgggagtattcagactgcaggggagaaagaagacaagggaggaacattcactaggaccttggaccaactgaggggagtgggactggcccctgtggggacaatcccat

SEQ ID NO: 150227 - DNA, 601 bp, Human
ctgttgttaggcccacacccaataaggattgttatgtctccttggaagattgaccttttaacattatgtaatgcccctctttatctctaatcggctcttttgctttgaagtttgctttgtctgaaattaatatagctactccaactttcttttgattagtattaccatggtatatcattctctattgccttacttttaattcatatgtgtctttattattaaagtgggtttcttgtggacaacacatggttgagaggtgacagcgtgctggcagtcctcacagccctcgctcgctctcggygcctcctctgcctgggctcccactttggtggcacttgaggagcccttcagcccaccgctgcactgtgggagcccctttctgggctggccaaggccagagccggctccctcagcttgcagggaggtgtggagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgg

SEQ ID NO: 150228 - DNA, 601 bp, Human
ttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccrgggcttcgttcttgaagtcagtgagaccaagaacccaccaattccggacgcagttgggtcttgcttttattcactctgacagcctctttttactaatgtattcagaccattgatgtttaaagtgattattagtatagttgtattattatttatcatatttttctttattttctgttcattgcccttgttctgttttttgttaatttttttgtcttctgcccttcttctgatttctgcagtaataattgagcataatatattatttcactttttatcctttttagcatatcagttatacta

SEQ ID NO: 150229 - DNA, 601 bp, Human
aaccaaaggcctactcacatatgcttttgaaattatactatgacaagttcagaaatcagcatttaaatccctggtgggtaacaccttgaattgcatggtggaagcaaacactaatctctatgaagggacataccttgactcaggttcagctgggttttttttctgacataagacataagcctccctccacccaaccacccaaggctgcaagctgcaaccaccatgaattctctgtttctggaagtgtaacagatccaaagccaagtaaagaaaaaagaaacctacatgtagacacatgaaygtaaaaggagtcagaaaaagaaaagaaaaaacttgccacaatgattgctgatcctagaacatcctaacataaaaaactagagctggaatatactgcctatttctaaactgctgaaagaagttaactcctaacctagacttctatgccttcctaaatttaatttaaaaacaaaggcaaaataaaggcattaggtaattaaaaagtgagagtatgtaccaccaggtcctcactaaaataacttctaaaggatttccctcaaaaagagggatgagatcccagaaaggatttttgacatcttaa

SEQ ID NO: 150230 - DNA, 601 bp, Human
gaagtggggtgggggtggggggggctttgaattctaagtctacaatcaagtatgtcttgttaaaagttataagtataacctgtaaagtaataaaaatagaatgtataacatctaagcaaatagaatagaaaaatgtgtagtatgaagggagcatataacaaacagggaattattaatagaaatttgaacacaatgtgatggctaaaacccacagatgttagtgatcacaataaatgatattcttttttttattctaactatataaagcttacaagagttatagctaaaacaagtatgtcartgggttgaaaataaaagattggaaaagatacaacaggcaactacttaccaaaatgagtttagtgtcactatgttaatatctgataaagatagtgttaaaagcaaaaactagtaggaataaaaaaagatcactacataatgtaaactgcaattcactgcaaagttgtaataattctaaacttgtttgtatatatttaattatatagcctcaaaatatataaaataaaacagtgagcaaactagagaaattaatacatttactattatagtgcaaggttaatacaactcagtatttaatgag

SEQ ID NO: 150231 - DNA, 601 bp, Human
acactgagaaagaaacaagactgccagtgagtagccaaaaatgcatgttttaaaacttaactgctgtattcatagaaaaaataattggtggactcagggatagctttctgcctttcattgcatactattttagtatagctcagaatcccatttctcaaacacaaattaaaaagagaaaaaagccactggagtgaggataacagaagttagtgacaacctggttggttcctggttaggaacaggataaacaaaacagtacaaaagtgacattattagaaaccacaatctagagagatttcaygtggggaagagacatccctctcagtgcatcaccattacagcagaacgaattatatatatacatatatatatataattttcatatatttactgtatatatatagagagagagtcaatatttgtaaatataagaaaagagtaacttctgttcattgaagtttggaggacagggacatttatgtagtgattttaaggaaaaacaatgcatttaaaaatggagttgatgcagaaagttacctggttataggggctgaaatcatcaggaatttacctatgtggggtgaactttggcaagtccctt

SEQ ID NO: 150232 - DNA, 601 bp, Human
tcacataatgttcattgttctcatgtagaaagaactttagaatcattaggctaaatgcttcgttgggattatgtaaggaatgccttgcttccacagtctaaatcagattgaagagttaaaagggaacaagaacacaaggatctcaaattatccattgcataaaatatttaatttcctatgaataagtggattttactaaaattatttttctgccctcaggggctctcaggaaagcagtttaatgaagggtactgattttagaagctcttaaaatttttatagtagaagtaatctgtgaagrcacgtgaaatagatgcacgggtggcaagtattgaaatctatattgtagtgggtgaacctcagatttactaagaagcagcctgaacgtgtgtttggaagtaaagagatctgggttatcactcttctctgctcataatttgtcatgtggctggtgataagaagaagtgtcaggaaaggtgggttgggacccaattattaatggcttggggtatatgctaaagcaattggacttttcattctaagcagtggggaatcaccttgttttagaaagataactcacagaacaatgagaaggatgata

SEQ ID NO: 150233 - DNA, 601 bp, Human
ggttctaaccagcacagggcatattgctttgagcaagacagagaccactccttagcacaagtagtggtaattccaggtgccatggaccatacagcaagggatacataaccccttctcaggaggaggaggggttagagtattaagaaatcactgacttcggaatgtgaaggaccaaaatacaggccaaagtggggattaagatacaagaaaaaaaagacagcatatgagaatcctggaggggtaagagcaatatatgccccatgaattgaaactacttcagctggagcttagggtgcaagtkcaggacagcaaaaattaagattggagtggcaagcagaggccaggccaaaaagaatgctcaatttgagaatgtttgaaagtggatgccccagaacgtcagggttccttgatttgagggatgagacataggtaaaggtgacttcaacttgtgtgatttgatttcaggcaccttggtatttggaaataccatcttaacagacgaaaggaatatggagggaggacagctgtgtgctgtgtaatggcactgatgagagagcaccatttgggtgtctgggtactatgctgacctgaagcttcacaa

SEQ ID NO: 150234 - DNA, 601 bp, Human
aagaggtggggcagcacctctgaacccagctcagttcctccttgcctcttgtctcagagcaagtgaacaagaccctgacttttatatcttcaaatgcaggttcatttccaacattgcctagttaaaaatatccacagggattttttttttccttacagatttaagagataagatctggtctttgatcttgagaatctcagaggggtgaaatgtacagatgctgcctcctcagatctgctaccttagattggatttagaatagagtaagcatccaaacatacacacacacacacacacacaagcgcgctcgcgtgcgcgcactcttcccttagaagagcccttaacccagaatgggggctttccctacagggtattcccacaacatcacctcacagccctcctctagcactgatctggctgaactctgcagagcagctgtggggataaactggtgtggcactgccacctagtgactgcccgccacaccgttctttgcctctgaggtgccgtgcatccgtcagctggccgctacccatcatggaaaatcatagtgggggcttctaaaaatagagtctgccaggccagtgtcaacatgctttct

SEQ ID NO: 150235 - DNA, 601 bp, Human
aacaagaccctgacttttatatcttcaaatgcaggttcatttccaacattgcctagttaaaaatatccacagggattttttttttccttacagatttaagagataagatctggtctttgatcttgagaatctcagaggggtgaaatgtacagatgctgcctcctcagatctgctaccttagattggatttagaatagagtaagcatccaaacatacacacacacacacacacacacgcgcgctcgcgtgcgcgcactcttcccttagaagagcccttaacccagaatgggggctttccctrcagggtattcccacaacatcacctcacagccctcctctagcactgatctggctgaactctgcagagcagctgtggggataaactggtgtggcactgccacctagtgactgcccgccacaccgttctttgcctctgaggtgccgtgcatccgtcagctggccgctacccatcatggaaaatcatagtgggggcttctaaaaatagagtctgccaggccagtgtcaacatgctttctctgctatcagcagagcctggcacacatcagacatggattagattaagtgtttttgaaaaagtggt

SEQ ID NO: 150236 - DNA, 601 bp, Human
atcccagcactttgggaggccaaggcgggcggattatgaggtcaggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaakctgggctttagatgtagcagcattatactgcctgttgccactgctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggttttta

SEQ ID NO: 150237 - DNA, 601 bp, Human
tatgaggtcaggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccactgctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacatttt

SEQ ID NO: 150238 - DNA, 601 bp, Human
caggagatcaagaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccacygctgcttctctttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacattttatttgaat

SEQ ID NO: 150239 - DNA, 601 bp, Human
agaccatcctgcctaacatggtgaaaccccatctctactaaaaatacaaaaaaattagccaggcatggtagcgggtgcctgtagtctcagctacttgggaggctgaggcagcagaatggcgtgaacccgggtggcggagcttgcagtgagccaagatcacgccactacactccagcctgggtgacagagcaagacactgtctcaaaaaaaaaaaaaaaagaatcaaatggaatcctgcctaaattaaagctgggctttagatgtagcagcattatactgcctgttgccactgctgcttctttttgtttacttactaatattaaaggaagtctgtattgaaatcctcaagatcctaaagccatgtttatgttttcataactcagttatagggaaaaaataggagtgcaaggaggggactatgagaacgtcaaatagattggggcagtttacattctcatacgttctataaattagttccagagagagtagtttcatacataaaactacagcatttatactttagagcaccctcacttagggaggtttttattaaagtgtttggacttactggattttacattttatttgaatttagaactgt

SEQ ID NO: 150240 - DNA, 601 bp, Human
agatagcacattaaaatcatctggggagcttttaaaaaatccctgtgccatggcttcacccccggagacctcagcttcattgtttacggatggggctttgcacaggattccttttaacacttcccaggtggctccaatatgcagctacaggtgaatatgccgctacagtgaatagctacgtgtgaatatcagcaacaagtaagagacacgttagctctttcttctgagccattggcagtaagctcttttccttttgaacttagatatgtaccttctttgaatttctttttatgcttatatrttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaacggatttggacaccaccacttgccctacagccacatgggctttctaatgttctgctgatttaccactgaatttgaaaaaagtcgtaggtgtaccctcacactgagggagtcactctgtgtcccaggtgagcttaccaca

SEQ ID NO: 150241 - DNA, 601 bp, Human
ctacagtgaatagctacgtgtgaatatcagcaacaagtaagagacacgttagctctttcttctgagccattggcagtaagctcttttccttttgaacttagatatgtaccttctttgaatttctttttatgcttatatgttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaayggatttggacaccaccacttgccctacagccacatgggctttctaatgttctgctgatttaccactgaatttgaaaaaagtcgtaggtgtaccctcacactgagggagtcactctgtgtcccaggtgagcttaccacatagaaaaccccatacacctgctttgtgggcaagccaaggaaagagagggcctgatctatgcctgctcagttcctactgccagatttttcatccctcccctgtacaaaacaagagatgcattgcctacctcttttcctcccaacacacatacacactacttaa

SEQ ID NO: 150242 - DNA, 601 bp, Human
agtgctgcatcgagctaggcgatcagcatcattttttccatagcacatgctcagttggtgtctttgtgtcacattttggtaattcttgtagcttctcaaactttttcattattgtacctcttatggtgatttatgatcagggatctttgatattacaattctatttatcttggggttccatgaatcaagcccataagagaaggcaaacttaaatgataaatgttgtgtgtgttgactgcttcaccaactagctgttcccccatctctctcacttttatctggctttcctattccctgaaaygcagtgatacttaaatgaggccaactaatgacctacaatggcttccaagtgttcacgtgacaagaaggattgcgtatctctcactttcaatcaaaaactagacatgattaagcttaatgaggaaggcatttcaaaagctgggataagctgaaagctaggcttcttataccaaacatttatccaagttgtgaatgcaaaggaaaagttgaaggaaattaaaagtgctactccagtgaacacatgaataataggaaacaaaacagccttaatgcggttatggagaaagtttgagtagtctgg

SEQ ID NO: 150243 - DNA, 601 bp, Human
aaactttttcattattgtacctcttatggtgatttatgatcagggatctttgatattacaattctatttatcttggggttccatgaatcaagcccataagagaaggcaaacttaaatgataaatgttgtgtgtgttgactgcttcaccaactagctgttcccccatctctctcacttttatctggctttcctattccctgaaacgcagtgatacttaaatgaggccaactaatgacctacaatggcttccaagtgttcacgtgacaagaaggattgcgtatctctcactttcaatcaaaarctagacatgattaagcttaatgaggaaggcatttcaaaagctgggataagctgaaagctaggcttcttataccaaacatttatccaagttgtgaatgcaaaggaaaagttgaaggaaattaaaagtgctactccagtgaacacatgaataataggaaacaaaacagccttaatgcggttatggagaaagtttgagtagtctggatagaagataaaacaagctgcaacatttcctcaagccaaagcctaatccatacaaggtcctaactctcttcagttctttgaaggctgagagaggtga

SEQ ID NO: 150244 - DNA, 601 bp, Human
tccatagaatttttgagcaatacagcactcttcaattaaggtatatacattttttaagacatcatgctatagcacacttaatagaactacagtatagtatacacataacaacatttttagaaactgggaaacaaatttgtgtgacttgctttgttgaaatatttgcatgattgcagtgatctgcatctgaacctgcaatatcccccaggtatgactgcacttacacacttaggcatactatacctatgttatcacagtctttcttcacctgatagtatatactatcttttactgcagtctrtcttcaagcggtactgtatcacttcacatagatgagttttcagctgaataatcaagcagaaccctatgaagttctctgcatgtgtctctgtacaggtctctcctttttgatttttgcccttttgaattcttaacctccctggatttccagctctgtccttcaacagagggagacctccaggcagtgccaggtttccttccctgagctgcacctgagagattctctttagtcattaaagtgggggccattgtattgctcagttgttttccatctctcaagaatcactgtcctttgttgcta

SEQ ID NO: 150245 - DNA, 601 bp, Human
acattttttaagacatcatgctatagcacacttaatagaactacagtatagtatacacataacaacatttttagaaactgggaaacaaatttgtgtgacttgctttgttgaaatatttgcatgattgcagtgatctgcatctgaacctgcaatatcccccaggtatgactgcacttacacacttaggcatactatacctatgttatcacagtctttcttcacctgatagtatatactatcttttactgcagtctatcttcaagcggtactgtatcacttcacatagatgagttttcagctkaataatcaagcagaaccctatgaagttctctgcatgtgtctctgtacaggtctctcctttttgatttttgcccttttgaattcttaacctccctggatttccagctctgtccttcaacagagggagacctccaggcagtgccaggtttccttccctgagctgcacctgagagattctctttagtcattaaagtgggggccattgtattgctcagttgttttccatctctcaagaatcactgtcctttgttgctagataaccaatgtcttgataaccattgtatcaaatattttatctgct

SEQ ID NO: 150246 - DNA, 601 bp, Human
gacaaatccaatttatgttcactgatgagcaagaattatttttatccactttttatatgtctatgtgtataatcctaaaaatctagcatgtggcccaaggcaagtcaacttgaggacatgtttccctttgtcacattaattacttcaaatattacttccctgctatgtttttgtaagcatctgtgactatacaacaatgaataaggcatagtcgttatcttcaaattctttataatttcgattctaagggtatgttagatgagtgaattccacattacctgtcttatgacccaaagtaacrtttatcaaatggtgctagagatatctacaagatgttcctgggatacagagagggaaccaggcttggagtatcatgctgaccaaaagctacagggaatctggagaaggggacccacaaacagatcctcagagtacaaacgagggttagagagaaggggggacgtgtttcccagcagaaggaaatacatctgcagagaaagagagctgtgaaggataacagcatacctcccagccattagtgtgcgggtgctgagggaggcaggagcgcaggccagaggccatcactctcttggggaagaag

SEQ ID NO: 150247 - DNA, 601 bp, Human
aacaaaataggggattattctaatagtatctaatttggttcctgattacctcatcttgaatattcacaatcatgtatgtctgagtgcaacataaacattagtatgagatgtcatttttctattctgagctatttttagggcaggtttattattttgtaagcaaaaaggataatttatcattgaatcccaagccctaaaatgccaactcctagaaagatgcatgtttctatttaaagctcttcaatacaggatgacaatctctgatgcaatgtaatgcgaacagcatatagtaaatattaaytgagtgatttaatgatgtatttcctgagagtatttggcaaataaggatggaagaaatttgtctatctaagatttgagcatttgttaaaggtaagcgtctaatgagttagcttgcctaaatgttccagtgtatgcttttcattgcagttttcagtcatttactgcccccaactctgaaaaacatttttaataaaaagtgctgcaggagcaggagattagaaagaccttcacacccatgccaaagttgaaatttccctgcaggcaacggccatgaaggtaccccctagaaatctttgtttat

SEQ ID NO: 150248 - DNA, 601 bp, Human
tttgacaaggagtctcactctgtcatccaggctggagtgcagtggcagtgcagtcttggctcactgcaacctctgcctcccaggttcaagtgattcccctccctcagcctcccaagtaggtgggactatcggcttacactaccatacctggctaacttttgcatttttagtagagatggggtttcactgtgttggcccaagctggtcccgaactcctgacctcaggagatccacctactttggtctcccaaagtggtaggattccaggtgtgagccaccacacctggctggcctagctagwtattaataatagtgttctggtcactcactgtggcagtgaaaaaacaacttgaagatttcactgggacccaggcacattttctaagtgtctagaaactaagtatctaaggacactttgctgatatagagacagtcaagaatataactgtttcagccaaagattgtccatgcattacaacatacgtcaaattagaaaatgcaagttaagctctctgagtacatagtgaacactcagtaagtatggtatgtacatacatatgcatcatggaaccagagccattagctcttaagtgtatcacat

SEQ ID NO: 150249 - DNA, 601 bp, Human
tccctttgattccaggagatcagtgattgccctttctctggggttccactcactccagcccggagcctgtttccttagtccacagtagcaggaaacagaatttcttagcttctctattctttggaagaaggcaaagggacaaatgtgataagaatgggtctcttgtatgtccaaagatagagtgtaagatctactgatattgtggagaaaagcttataccctgtaagataaatctgcattttttatttttgaagcaggaagcttggcatgggatgagggacaggaaaaaaaaaaaaagcayagcgaatgccatggtccagtgtaggttgcatatagggctaatcctggggctctggctaggagcagcctccttgccaccacagccctggcagcacagacacagatggggaattgagttgaaaggcaggactgagtgagcgaagcaggagatgatgagtaccgcgcaattatcagtatattttgcagagcaagaaatgaggaaaggaaagccctctgagtggtatctgagagatgggaaggagtgatggtcctttccaatggtgggtgaaaagtaaggaagtcttctagtgaccagagtctg

SEQ ID NO: 150250 - DNA, 601 bp, Human
tttcttagcttctctattctttggaagaaggcaaagggacaaatgtgataagaatgggtctcttgtatgtccaaagatagagtgtaagatctactgatattgtggagaaaagcttataccctgtaagataaatctgcattttttatttttgaagcaggaagcttggcatgggatgagggacaggaaaaaaaaaaaaagcatagcgaatgccatggtccagtgtaggttgcatatagggctaatcctggggctctggctaggagcagcctccttgccaccacagccctggcagcacagacasagatggggaattgagttgaaaggcaggactgagtgagcgaagcaggagatgatgagtaccgcgcaattatcagtatattttgcagagcaagaaatgaggaaaggaaagccctctgagtggtatctgagagatgggaaggagtgatggtcctttccaatggtgggtgaaaagtaaggaagtcttctagtgaccagagtctggggcctgactgtcatagaaaccagagcagggcctctctgccccatgaccacacagaatgtgcatctagagcaaattcttctagggtgacaactctgatgg

SEQ ID NO: 150251 - DNA, 601 bp, Human
taaggaagtcttctagtgaccagagtctggggcctgactgtcatagaaaccagagcagggcctctctgccccatgaccacacagaatgtgcatctagagcaaattcttctagggtgacaactctgatggccttgctgttgtatgcatacatgctgttgtataaaaccagtgtccacatcacgggcacagagggttactgtttcgtactgttaattcaaccgaagtgtgataggatacctgtttctgatataaaagctttcttccttaccagtaaaatttgacacctcaaagaatgattagkatactttgtatccctctccctcttttcgactgtaagttctttgtgtataactggtaagacaacttctattaagctctggttatgggcagggactctgtgatcagaggtacagtttctgtgttcaaggatgaaggacatccaggtagattgacctattataatatggtcccatgatctagggatgtgcccgatactcagggagcacaggggaagcactgaggggaagagaagacagaaaaggctcccacttgaacttactttgaaggatgaagaggtgttagcccatcgtcaggaaatcga

SEQ ID NO: 150252 - DNA, 601 bp, Human
tgccccttgtggggcatgcactaatttgataaactaatttgatcttggagctttggcttcagaatcaggaagtcctttaagactgtgtcctcccatctcctactagctgtgcaaatttgagtaaattgtaaaatatagcccataataactatcttgaaatgtgttgaagggtagaagatatattaattataatatttatttttctttcttttaacaaatgtttgttgagtgctaggcactggcctaggtactaggaatacatcaaaagaagatagaaacttactgccctgccttcatggarcttacaagggaagacttgcattttaaaaataataaataatggttcattacatttgtgaactagtaaagcttctgacctgttttgggcctgggggagagggatgggatctactcagagaaatcatcactagaaaattgatttttacgctgaagtgagaagggtccatacccaggaagggaagtagggagagcattccaggaagaggaaatggtgtatttgaaggcaatgaggcaagaaggagctcagtacagtggagccaggtcattgggccaggagtacacagagcaaaaggggagagcg

SEQ ID NO: 150253 - DNA, 601 bp, Human
gtgcacacctttgcagaagctgcctgggaagactgctccaagagtcacagctaagtggaaggagagcgtgcccttggcatagacaggcaacatccttctcccccctcggtagtgttcaactgggataaggcagctaactttgaaaataagaatccagggtcaattttaatgtcccagtagtaacaagatggccatttcaagtcccaattgtagaaaatatagtttgggggcataatttaacattatttgcctttaaaagaaaaataatagttttaattatagtgaactttaaaaaaaaaaacggtatgctgcattatctgtttactattggatcacttccccttttttcctcaaataatagcattttattatgtggtataatgctttgggaaatgtaatttgcatagattatttttaggaggcccataacaagtccacaagggatataaatgatgctatttataaaaactagtaattgcagagtctttcccctagtgcttcttagaaacaacttccttagtgttactttttgtcaagatggtaccctcttttattctccaatcaggtgtgactcaagggtcatgtgcacaggcttatttgc

SEQ ID NO: 150254 - DNA, 601 bp, Human
aacatggagaaaccccctctctactaaaaatacagaattagccaggtgtggtggcacatgcctataatcccagctattcaggaggctgaggcaggagaatctcttgaacgtgggaggcggaggttgcagtgagccgagattgcgccatggcactctagcctgggcaacaagagtgaaactccatcatctcaaaaaaaaaaaaagagagaggttatagtaccattaaatatatgtggacacaaaaatgttatatgtaatggaatttatggtgacttcgttccagcccttaagcttatggtaraagagtccctctattcttaggctgaggagctccattccctctccttcataaggatcagacttatttcctaattaattgacttgatcaaaattggtttacttgcatacagagaaattcactaatatttgagtaacatatttgagatgctctgtagagttggattatctcttcttctagactaagcagattcccatggagtcaggctacggggcagtcttcctgggattcacttctggcagttgattacatcttacatcagctccttagggatcaagagcatatggatgaaagtgacctaga

SEQ ID NO: 150255 - DNA, 601 bp, Human
aaattacagtgactcttggtggccttttgactagagtatggatgactggattttttggtttaattatctttaaatatcgagtaatatctgttcattcctagggatgcaggttgttattcaataaatggttctctaatagtgatttataaaccactagactttgacaacatctagcatgactccctcaacaaaactgaggacacttcagatatcagtgatttaggtttcttccatcccactagtagttctatgtaaacaaaagcaatgcgtaaagctttcgcagttcatagcaatttgaaartcactacgctaattaaattttaaaattttcttcaaggagcaaaaaaacaagtcagttcaggacagaagcctttacacagccttgccttttccttaagatttgataataatcctttccacgttaaatttgccctgtgccgaggaaatcttaatttaacatcacatggtgactccattagttgtcagttaaacaaacagtttgcatcctgaagagcaaaaacactaccctgttaagtcgctaagagggtgttccaaaacagcacgaattagctagagctcataaaaaagaagtgattggtat

SEQ ID NO: 150256 - DNA, 601 bp, Human
acgaattagctagagctcataaaaaagaagtgattggtatgaaagaatgcgaaacctaaggtctgattatactcctcttcctgtaacactctctgtttccatttgaggatttgttttcccccgccagtgtacatagaaatcctgcaaaactgatctgaagccattccttagtgttgaatgtttgagaatgtgcaaaacactcaaggatttttaaaaatgtcttacacaatttgacattgggtgtttaattttgaagaggttttaacttttgtattgcttgctttttggttctttctggtgygttcactgaatctcatcagataaagccccagtgaagagagtatatctttaagttcttacatacaatagtttctattttgtgcagagcagctggaggagatgggccttttcagtcataaggctaaattccccaccaatgtcctttcttgaggaccttcacttcccaccaagaaatttcataagtggatcgcaaaaaaatgtcttaaatatgacagctgccgtcttccgggtacaggaaagtataggtggaagttgttgtgaccttttagcacacagctcatggactccacaatttcaccca

SEQ ID NO: 150257 - DNA, 601 bp, Human
cctaaatacactgtattttcttcattttgtttttaaatgcccaagcatcttgaagtgacaggttagtgattttgcttaagttttttctaagaagataaatgaaatgagagaaaagtaaccaggatacattttctgactttggtgaaaggaatatgactcatcttgttaaatgcatacagggatcttaatttcagagagtaacatatgttagtcccaactgtttctacatcgattgtggtggtgacaagctttggagaaaatgttgtaaaatcgtacttatttccattcttattcactttaygaaacggaatcgtcctggaaatagacactgggtggacaataatattatgccattacttaaattactataaccatgaatatgttggcaggaatttaccttgaacctagaaagctttcggaagtgagccagcttcatcttgcataactctaaaaattaaaaaataaaggttactttcatcagattctcttacgatttattaatctagggaagtataagtttatggttttcttcactaaaataaacagttaaggggtttgtatttgaacaaaaaggtttctaagtggctctggaggtataact

SEQ ID NO: 150258 - DNA, 601 bp, Human
gtcctggaaatagacactgggtggacaataatattatgccattacttaaattactataaccatgaatatgttggcaggaatttaccttgaacctagaaagctttcggaagtgagccagcttcatcttgcataactctaaaaattaaaaaataaaggttactttcatcagattctcttacgatttattaatctagggaagtataagtttatggttttcttcactaaaataaacagttaaggggtttgtatttgaacaaaaaggtttctaagtggctctggaggtataacttaaaggagtagwgttaggataatggagtgaggtatatagataatagttttgataattactaaatgattggattaatttcttttccactttgcaacagaggtactcatttttaatgcatgtcttagatgacacccggtgagaaatgggccagtagcagaaaagaatggagcctgagaataaacacaaataaaaatccactttccaaggctcttgattccagtgattttccactcctgttaggattttgatttctttccagaaagatctcagcagaggccacctgccaggggagaacaatattcaactttttat

SEQ ID NO: 150259 - DNA, 601 bp, Human
aaaattcacggatgctcaagtcctttataaaatagtgtattacttgcatgtaacctaggtacatcctcctgtgtactttaatctctagattacttataatacttaatacaatataaatgctctgcaaatagttgctaaacagtattgttattgtttaaagaataattacaaaagaaaacggtctataatgttcagtacaggtgcagccatccatttttttactgaaatattttcaatccagttgaattcatgtatacggaacccatggatatagagattcaagtgtatgtgatcctaaatrtagatatagatattatgagatgaagtaaagagtaggaaaaatatcaatgctaatcaaagtttataactgaataatcatttactctgctttagttgtctcatctctaaaatcagaaggctaaatcagaatgtctaaatacttggcaacctctttctctgatcatgtgatcagtagcactttctttctgaggatactgatttcttcatagaactagatggaacaggctatttaagccctctggaaatatattaaagcagtattggctcatcattgtggcaatgtttccatgatcataatgat

SEQ ID NO: 150260 - DNA, 601 bp, Human
ctcatctctaaaatcagaaggctaaatcagaatgtctaaatacttggcaacctctttctctgatcatgtgatcagtagcactttctttctgaggatactgatttcttcatagaactagatggaacaggctatttaagccctctggaaatatattaaagcagtattggctcatcattgtggcaatgtttccatgatcataatgatcaggtcgtgtatttattttctccttttctcctcaatcgtgtccctcctgccagatttgttgcagcaactcattgagtaagcccaaagatggattctktggtctataactgaatagctaaatcacatctactttctgtgcctctgtctagcggactctgcctgtgccctgccatttacattgttatctgtttgttgagactagctgggcaatgtctatggttctgtggtcctctcagggttgagattctatctggaggtgtgacttccctttcacagacccctgaggtagttcctcacatgcccccttccctgctgggaggttggctgtgcccaggactgatgaattggctgcagcaccttgaccttgcctggaccctccaatcggtgccccagcaag

SEQ ID NO: 150261 - DNA, 601 bp, Human
tggaacaggctatttaagccctctggaaatatattaaagcagtattggctcatcattgtggcaatgtttccatgatcataatgatcaggtcgtgtatttattttctccttttctcctcaatcgtgtccctcctgccagatttgttgcagcaactcattgagtaagcccaaagatggattctttggtctataactgaatagctaaatcacatctactttctgtgcctctgtctagcggactctgcctgtgccctgccatttacattgttatctgtttgttgagactagctgggcaatgtctrtggttctgtggtcctctcagggttgagattctatctggaggtgtgacttccctttcacagacccctgaggtagttcctcacatgcccccttccctgctgggaggttggctgtgcccaggactgatgaattggctgcagcaccttgaccttgcctggaccctccaatcggtgccccagcaagtagttgctcgtagcacagaagactctcacaacttggaatgagcacaccttgatcacggagcgggaggactgtaattcttagagtaccacacagagtctctctttcaagagatcagaaca

SEQ ID NO: 150262 - DNA, 601 bp, Human
cagaagactctcacaacttggaatgagcacaccttgatcacggagcgggaggactgtaattcttagagtaccacacagagtctctctttcaagagatcagaacaatggtctgtaattcaaaaaggaacactgttggttttttcaaaatgaagatgacccgtgcctttcctagtgtcatgttagtaaatctgtaaaatggtataatggttaccccttaccttcagtacttcatctatctctgttgcccaggttaagatcactgtgatcttcctgttacgcttcctcttgtgtgtgtggaacmctgatgaagcagtgtatatgctgagataatttattgtttttattcctggtgcattgcagttgatcaccttgaaggcctgctgatctcatcttaagattagaggtttattctgtatggaaaaatccttatttctaccccatatacatttatgctaatctactcatttgttatttgttcctattataattataggtatataactgacttgctctgttttttaaaaagtctccaaaaattcaccaagttgcttttaggccatttatttcttagaatggaaatgttttttccaaatatgctttt

SEQ ID NO: 150263 - DNA, 601 bp, Human
aaggaacactgttggttttttcaaaatgaagatgacccgtgcctttcctagtgtcatgttagtaaatctgtaaaatggtataatggttaccccttaccttcagtacttcatctatctctgttgcccaggttaagatcactgtgatcttcctgttacgcttcctcttgtgtgtgtggaaccctgatgaagcagtgtatatgctgagataatttattgtttttattcctggtgcattgcagttgatcaccttgaaggcctgctgatctcatcttaagattagaggtttattctgtatggaaaratccttatttctaccccatatacatttatgctaatctactcatttgttatttgttcctattataattataggtatataactgacttgctctgttttttaaaaagtctccaaaaattcaccaagttgcttttaggccatttatttcttagaatggaaatgttttttccaaatatgcttttgttcttaaaatatgtaaactaaatttttaatcccagtttaaggcacattgcttacatgtgttgatcacacattttctgtaatacttattgaagacaatgtttttaatcctgagaaactttt

SEQ ID NO: 150264 - DNA, 601 bp, Human
aaatggtataatggttaccccttaccttcagtacttcatctatctctgttgcccaggttaagatcactgtgatcttcctgttacgcttcctcttgtgtgtgtggaaccctgatgaagcagtgtatatgctgagataatttattgtttttattcctggtgcattgcagttgatcaccttgaaggcctgctgatctcatcttaagattagaggtttattctgtatggaaaaatccttatttctaccccatatacatttatgctaatctactcatttgttatttgttcctattataattatagrtatataactgacttgctctgttttttaaaaagtctccaaaaattcaccaagttgcttttaggccatttatttcttagaatggaaatgttttttccaaatatgcttttgttcttaaaatatgtaaactaaatttttaatcccagtttaaggcacattgcttacatgtgttgatcacacattttctgtaatacttattgaagacaatgtttttaatcctgagaaacttttgcatttgatgcaaaacattttctaatgtgtctgagacagaaagtagttagtaatgctttgggtttctcttct

SEQ ID NO: 150265 - DNA, 601 bp, Human
ataacaaaatacattgtcaacttggtaactttacccataaatgaatcaatagatatttcaagcatagttccaacttccagtagtgttttcactcactcttgattttggttgtatatttaaaagtaatcttgtttaatttggttgatacttcctaacaggccagtcattttaatgcaaatatatatttatatagattatacttaggaaatgaaaacatgaattgctattgcctgctcatgctaagtcttacctatcagacagtcctgtgatacttcattgcagttagtaggtccacgtttayagtagatggtcagagcctcccaggttcagatgctacattttcagcctacatttaccactttggaatgtcttctactctccatgacttactctcattttcttcaaactcctaaatttgttctcaaaacttgtgaacatccctgtatgagagtgtgcagggaaaaaggtcaatgaggagctgaataaaggcttgggtttcttttactttttaaagatctactagagataaaaatatgtgcatatgagattagactacatctaatccataaattggagcagatgttttgtgtatttcatcatg

SEQ ID NO: 150266 - DNA, 601 bp, Human
cagatgttttgtgtatttcatcatgtgcatgtttggtcctttcagggctctatgctgggacaatttgtgtttaagagtcacaagttttataatattcaaaagaacacttgcattaagacccttgtaatccatattattttaccatgaagattatacatttcctcaggaattaagttaatgccacacttaagatattagggagaaaaataccttaaaataccatgtcgcccatatgtttgcctgtaaatcttaacagaaaaaaaaaaagtgacagaatcacaaataagaaagccaagttagyatgtttgggcagacttctccatgtttcataagcagattttaatttcatcttaagaaggaagcatatagtttctctaaatattactttggaatattgatattccatatcttaattattaaaacattttaagagttagaaaagacaaagagttagaaaagacaaagactttgagtacaaaatttacagtatcacactgccatctaccacctttgataaaaatttttttatgaagttcaccgaggtcaaccagtttcatttgggagacattccaagttggttttatagtgtagttgctgtatt

SEQ ID NO: 150267 - DNA, 601 bp, Human
ctttttcattaagtactgttctggtttcaaattttacattttatataatacttaccatgctttaataattctgttatttcattactacttttttttttaaattatactttaagttttagggtacatgtgcacattgtgcaggttagttacatatgtatacatgtgccatgctggtgcgctgcacccactaactcgtcatctagcattaggtatatctcccaatgctatccctccccccaccccaccacagtccccagagtgtgatattccccttcctgtgtccatgtccaacaatgatagrctggattaagaaaatgtggcacatatacaccatggaatactatgcagccataaaaaatgatgagttcattactactttttaaaagtagaactactttgcagtatttcttgagactggagtctcttgagaccggagtctcttataggtctgagaaatatactctagtaggcttgctgacagatccatttttttttttttttggagatggagttttgctcttgttgcccaggctgcagtacagtggcgcaacctccacctcctggattcaagtgattctcctgcctcagccccccaaatagc

SEQ ID NO: 150268 - DNA, 601 bp, Human
acaattaaaagacacagaatggcaagctggataaagagccaagacccatcagtgtgctgtcttcaagagaccctctcatgtgcagacacacacataggctcaaaataaagggatggaggaaaatttaccaaccaaatgaaaactataaaaaaaaaaaaaagaaaaacaaaacaggggtggaaatcctagttcctgacaaaagagacttcaaaccaacaaagattaaaaaaagatgaagagcattacataatggtaaagggttcaattcaacaaaagagttaactattctaaatatatatgyacccaatacaggaacacccagattcataaagcaagtacttagggacctacaaagagacattgacttccacacaataataggagactttaatacctcactgtcagtattagataattgagacagaaaattgtaacagagatattcagaacctgaactcagctttggatcgagtggacctgatagcaacagaatacacattgttctgatcgctatgtggcacttaatgtaaaattggtgacataatcagaagtataacactcctcagcaaatgcaaaagaactgaaatcataacaaacagtc

SEQ ID NO: 150269 - DNA, 601 bp, Human
ataaacactttgataagggggatattaccactgaccctacagaaatacagacgaccatcagagaatgctattaaacacctctatgcatataaactagaaaatctagaagaaatggataaattcccggacacataataccctcctacgaccgaaccaagaagaaattgaattcctgaatagaccaataatgagttctgaaattgaggcaggaataaattgcctaccaaccaaaaacccaggaacagatacattcacaactgaattttaccagaggcacgaagaagagctggtgccatttctrcagaaactatcccaaaaaatcacaaaggagggactgctccctaactcattctatgaggcaagcatcatcctgataccaaaatccggcagagatacaacaaaaaaagaaaacttctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaacta

SEQ ID NO: 150270 - DNA, 601 bp, Human
acttctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttagatgctctcaataaactaggtactgaaggaacatamctcaaaataataagagccgtctatgacaaatccacagccagtatcataatgggcaaaagccagaagcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaa

SEQ ID NO: 150271 - DNA, 601 bp, Human
tctagtcaatatctcaatatccttggtgaacattgatgaaaaaatcctcaataaaatactggcaaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttagatgctctcaataaactaggtactgaaggaacatacctyaaaataataagagccgtctatgacaaatccacagccagtatcataatgggcaaaagccagaagcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaaatc

SEQ ID NO: 150272 - DNA, 601 bp, Human
aaactaaattcagcagcacatcaaaagccttatccaccatgatcaagttggcttcatccctgggatgcaagattggttcaacatatgcaaatcaataaatgtgattcatcacaataacagaactaaggacaaaaaccacacagttctctcaatagatgcagaaaaggccatcaaaaaaattcaacatccctgcatgttagatgctctcaataaactaggtactgaaggaacatacctcaaaataataagagccgtctatgacaaatccacagccagtatcataatgggcaaaagccagaarcattccccttgaaaaccagcacaagataaggatgccctctctcaccactcctattcaacatagtatgggaagttctgggtaatcaggcaagagaaagaaagagtattcaaataggaagagaggaagtcaaattacctttgcagatgacatgatcctttatctagaaaaccccaacatctcagcccaaagcttcttaagctgataagcaacttcagcaaagcctcaggatacaaaatcagtgtgcaaaaattgctagcattcctatacaccaccaacaggcaagcagagagccaaatcatg

SEQ ID NO: 150273 - DNA, 601 bp, Human
gctgcactattcactatagcaaagacatggaatcaacctaaatgcccatcagtaatagactggataaagaaaatgtggtacatatataccacagaatagtatacagccataaaaaggaacaagatcatctcctttgcagggacatggatagagctggaatccattatcctcatcaaactaatgcaggaacagaaaatcaaacactacatgttctgacttataagtgacagctgaatgatgagaatacatggacacatggtgggagggaacagcacacactgaaaccttctggaggaggggstagggggagtgagagcatcaggaagaatagctaatggacgctgggtttaatagctgggtgatggaatgatctgtgcagcaaaccaccatggcatgtgtttacctatataacatatctgcacatcctgcaaatgtaccccagaatttaaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctgg

SEQ ID NO: 150274 - DNA, 601 bp, Human
ctatataacatatctgcacatcctgcaaatgtaccccagaatttaaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctggcctgtatacttgtgaaagttgtttttaaggaatctgggtaagtactaccactaacaataatgtagtagtagtgtttctttctttcttttttttttttttttttgagagacggagtcgctttgtcacccaggctggagcacagcagcgtgatctcggctcactgcaacctccacctcctgggttcaagcgattctcctgcctcagcttcccaagtagctgggactacaggcatgctcaaccacgcccatctaattttgtatttttagtagagatggggttccactagatgttggccacgctggtcaaaaactcctgacctcaagtgagccactcatctcggcctcccaaagtgctgggattacaaacatgagccacagcacccagccagtagtagtatatattt

SEQ ID NO: 150275 - DNA, 601 bp, Human
taaaataaaatttgaaggaaaaaaaaaaagtctagcagcctcaagtgctttggtgatctgtaaagtactattatacttaaaaatattttgtatcttactacccatggttttattattttataattaaccgtgagtcgcaatataatatctcctggcctgtatacttgtgaaagttgtttttaaggaatctgggtaagtactaccactaacaataatgtagtagtagtgtttctttctttcttttttttttttttttttgagagacggagtcgctttgtcacccaggctggagcacagcagygtgatctcggctcactgcaacctccacctcctgggttcaagcgattctcctgcctcagcttcccaagtagctgggactacaggcatgctcaaccacgcccatctaattttgtatttttagtagagatggggttccactagatgttggccacgctggtcaaaaactcctgacctcaagtgagccactcatctcggcctcccaaagtgctgggattacaaacatgagccacagcacccagccagtagtagtatatattttagagcctttgctgtttcaaattattataaaaattattgatat

SEQ ID NO: 150276 - DNA, 601 bp, Human
cctaaatttatataaataaaaaaaatgaatgcatagacctatttctccccatttttcctggaagtttacatatcactttcttttgccaactccccattgttcaaatgtggaaaacaatgaggtgcctttgaccctgtcttctcactgtcctctgttccttttcaaccctagatggaaaggaagaccctactattagaaacacatctcagtaataggcagagagtgggatttttattctgggacatattgttttgtggctgccatgttgaaaagtagcagttaaatatgatgccttaggagktttgttcctgtatttgacaacctattagggaattagaaaggggatgggatgtttcaaaataaattcctgtatttagaagtttttaaaagcagctgcagggatttcattttcagatgaggaatcattttcatttaagcccatcagctaaaatgagtgcttagtgaatagaaagcctgtaacataaggcctcgagggcattacccccactccactgaactctgagattaagattctgtattccccttcaaccactttcttcatatacccaagagaaggaatcatttaaaatgcatcggtcac

SEQ ID NO: 150277 - DNA, 601 bp, Human
taaatggaacaacttcttatagtaagtaatccaaaagcccaagtgaaagctgtgggtcatcagatcccatagtgtgagcaaggaagaagacagaatctgcccttgctggccctttatcagctcccaggatttgttgaagactttcatcaagaaagcaagtgactagattaagtatccatgcctttcatcagctgctgtaggtcttggcagtgttactgcagtgctttcacccttctcatttgtcccatccatttgaaatacagtgtacttaaatttccaacaaaatcataacgtagactcygtcagttaattaaagtatactaacaagcatacaaattgctaagtcattctgggaggctatcagtgctggatgtacttatacattcagcactggaaacatgcccttccagtagtgcacagccagaaataccaagcaggcttgcaaaggacaagattaaccttggcctcatggtattttgtctttctgcagggaaaggaagatcatggagacaacaattgcaatacacggtggagaactcaacaccccttgattaaaaaaaaaaaatagttgaataaaaaagaagtttcctgaaggagtaag

SEQ ID NO: 150278 - DNA, 601 bp, Human
ctactggctgcatgcacccagcagatcctttatttgtgaattttagtagtctgattgctgctatggaaatgtgatccaaaatcatgatattttcctgtgataagtgaagttcacaaggaagaaatcaacatatgtttctttttcttttttggggggaaaagtgtaatacacatctgcatgttaccttttattctggcagctgcagcttaagcaggctttttctatcagctctcctacattacaggcagtataagaaacaaacaacaagacaagatgattcaagttccgatagctaaaggarttccaatcaaataaggctactgtatgtcagctttccagattagtagaaaataaaatgggcaaaattctactgtcagacatagtatagtaatccaagagaagtaaattaggccccgttgtttataagatgaagtacccacttaagctaagaaactgccactggcccttctagcctgacttacagaattcaggactttctctgtactcattacttgctggaggcatctggtccagagcccaaacttcagtcatttctgtgccactaatactataacttacttaaatttgaacatgaaacttt

SEQ ID NO: 150279 - DNA, 601 bp, Human
gaattcaggactttctctgtactcattacttgctggaggcatctggtccagagcccaaacttcagtcatttctgtgccactaatactataacttacttaaatttgaacatgaaactttatacaaattcctttatacaaatgttaatccatttttatacaaatggattaaaaaatattacgaagaaaggtaaaggtaatcgtcaattgatagttgaaacaccgatattgaattctagccataggctgttgcctgcagaaagctctgagctgagattctgctttttcttttttttttttttttaaaaaaagaaaaaaaaaaaaaaagcaggtgttaggagataaagacagagtaggaccagactatgatgtttttcttgcagtaatgaagaattagaagagaactaaaaggattaactgttttccatcttaagtatcacttaaaggcatctagaatacctctgttggtatgaatccagcagtgcagaaacatttctctaatctaacacacttcatttcatatgtgaggaaactaaaggtccagttagagtaaggatggaatccactgttgtacactgctctttctttagtacacttctgcgta

SEQ ID NO: 150280 - DNA, 601 bp, Human
tttacccaaatgctttgaaagaggcaactctcagttgcatcttacaaactgttttttttttgtttgataaatcagacatgactttgctaaagcctcaagtataatccataaaaattacaagtatttgtcctagtctcattaaataatgcatctaaattacattcattttaatgtatagcagtaacacatactagatgttgaagacagtaagtatttaatgacttaccctaggagagcatatatcatgcatataaactggacagcacacatataaaaagtatgaggacatcctcgattaacrtgtataaatgtggctgttacttggacatatgaaaaaaagatagggcaagctccatcactcctaggttaaatgatttttaatgggtatttttatgaaaaaatgaacagaccacattgaaatatgatgtggagatgtaattttacttcaagagtaccactgtgaggcaagatgctgtttctttattaatgtacttattatgaccacgggactgtacataccataaaggctcagtattttcttaaatgaatggatgctgttcacatattctcaagactatgtagtaaaattaagtgtatgcac

SEQ ID NO: 150281 - DNA, 601 bp, Human
cactctgtctctggtcaaactgaaacaaggtgcgctatattctgaataataactcccttatcagttcatttaccatctttaaaagattgttaagcagaagaagagcatatgatagaagggaaatgcagtaggagggacggcttaaataaagggatctcagacttgggaaagtctgcactaaactaagattaaaaccttttcctccctctttgccagccttttccctgtctagctctgagctgatcagtcctctctctttgtctcttggctactcaggaaatatacctagaaatcagagttwtggataccctgtgatcaagacaatcaatttcaaggttcactaggaatccagaaacattttcctgttttaaccacttagctttgattaagccatagccaggaggtcagagccatggccaacaaggtagactggtaacttcagtatctcccttaactaatattctctcaatgggttatctgtaaaaattccatttgacccaatggagagaggcctgtaatttggaacaaaggataacaaacaatctttaggaatttattgctttaaattacaaaattatcaaaccagttaatcctaaacttc

SEQ ID NO: 150282 - DNA, 601 bp, Human
tgtttatctgtacgcgagacaaggattttgggtgctacgtggacatgatatcaagtaatataatcacagtgtgagaaatgtgttctttttaagtattgttgcgttcagaaaggctcatttgtgaaattttaaggtttttaatacctcggacactttatataagagggcgggcccattctcaggaacttttgacgggctgctctgtctaatgtaacagttacccaagtcgttttgtttctattcctgtggtttttttccatccaaggtagtggataaagtttatttttaaataagttaaagkgaggtaatttaaagaaataacattaagcaaataatagcataggtgtaccagcaatgatgacgactaccacggaccgaaagaatgtatttttgaaaatacttgttatctgttgagtgtagttgtccaggttcttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttccc

SEQ ID NO: 150283 - DNA, 601 bp, Human
cagcaatgatgacgactaccacggaccgaaagaatgtatttttgaaaatacttgttatctgttgagtgtagttgtccaggttcttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttcccattgacctgtgccagtctgattggttgagggagggggatcaatcagaawgaggagtaggcccgcggccagtctgattggttgctcgaggggaccactccgaggtactttgatttttcaactgccacgcagaaaaaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggtaagcaag

SEQ ID NO: 150284 - DNA, 601 bp, Human
aagaatgtatttttgaaaatacttgttatctgttgagtgtagttgtccaggttcttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttcccattgacctgtgccagtctgattggttgagggagggggatcaatcagaatgaggagtaggcccgcggccagtctgattrgttgctcgaggggaccactccgaggtactttgatttttcaactgccacgcagaaaaaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggtaagcaagatggctggcaccttgatcctcgagggaat

SEQ ID NO: 150285 - DNA, 601 bp, Human
cttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttcccattgacctgtgccagtctgattggttgagggagggggatcaatcagaatgaggagtaggcccgcggccagtctgattggttgctcgaggggaccactccgaggtactttgatttttcaactgccacgcagaaaaaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggtaagcaagatggctggcaccttgatcctcgagggaatggggggtgtcatcctggtcgggccacgtaatcttgttagagccgcagggggtt

SEQ ID NO: 150286 - DNA, 601 bp, Human
attaatagtttgaggctattataaatagatgttttttagagaacatatttttgcttttttgtagaacgcatctgggaatggaattgcagggccatagagaatgcatatattcagctttagtagatactagcagttttctaaagtgtttgtatgtgtaattgtttaagcagtcaataatcattgagcacctactatgttgagagtaccatgctaggtgctggggaatacactggttaacaaaacaaagcccctgccctcagaagtttatgttctgttggaggggagatgggcacacagttaygcattagtgttattcctaggaatttttaaaattacaatagaagcatctgtacttaatgaaaaaggaaacctagggttttggtacttgtttgattatagtatttgaaattatttacccaacactatggcagtgtccacttaaagcacatatatttagtgtttatgtttttaactgttcaggctgttgaaaatcctacagctacagagattcaagatgtatgttcagcagttggacttaacgtatttcttgaggtatgacgtggttcttcactattttccatactcatctaattgatgtaat

SEQ ID NO: 150287 - DNA, 601 bp, Human
ttttttgtagaacgcatctgggaatggaattgcagggccatagagaatgcatatattcagctttagtagatactagcagttttctaaagtgtttgtatgtgtaattgtttaagcagtcaataatcattgagcacctactatgttgagagtaccatgctaggtgctggggaatacactggttaacaaaacaaagcccctgccctcagaagtttatgttctgttggaggggagatgggcacacagttacgcattagtgttattcctaggaatttttaaaattacaatagaagcatctgtactwaatgaaaaaggaaacctagggttttggtacttgtttgattatagtatttgaaattatttacccaacactatggcagtgtccacttaaagcacatatatttagtgtttatgtttttaactgttcaggctgttgaaaatcctacagctacagagattcaagatgtatgttcagcagttggacttaacgtatttcttgaggtatgacgtggttcttcactattttccatactcatctaattgatgtaataactttcttaagtcctgtttttcttttgtttcgtttatgttagaaaaataaaat

SEQ ID NO: 150288 - DNA, 601 bp, Human
tactagcagttttctaaagtgtttgtatgtgtaattgtttaagcagtcaataatcattgagcacctactatgttgagagtaccatgctaggtgctggggaatacactggttaacaaaacaaagcccctgccctcagaagtttatgttctgttggaggggagatgggcacacagttacgcattagtgttattcctaggaatttttaaaattacaatagaagcatctgtacttaatgaaaaaggaaacctagggttttggtacttgtttgattatagtatttgaaattatttacccaacactrtggcagtgtccacttaaagcacatatatttagtgtttatgtttttaactgttcaggctgttgaaaatcctacagctacagagattcaagatgtatgttcagcagttggacttaacgtatttcttgaggtatgacgtggttcttcactattttccatactcatctaattgatgtaataactttcttaagtcctgtttttcttttgtttcgtttatgttagaaaaataaaatgtactctagagaatggaatcgtgatgtccaatacagaggcagagtccgggtccagctcaaacaggaagat

SEQ ID NO: 150289 - DNA, 601 bp, Human
aaacctctggaagtctgtcattgctcccaggttaagaatataaaattattaaatcgttggatgttaattgccatttcagatcctagaggtccttgaggtctgttaatatctataatatctaatgattctatcattaataaatctgaaaagcaatattgactgaaaaaagcaagagatatacatagtgtggtaccacttaggtaaatttaaatacaaaatattactatttattgatagatgcatatgtaatgttgcttattggcatttttttgaaatgctctgtaaggaaacactcattctyaagagagtagtcacctaatggtgagcggggtagagagtagagacacgggttgatggtcatagaagactgttgcatcatctctggtgttttattttatgaaaaacaatagcaaaacgacatcagtataacagaatgttctgaatattaggaagataagtttttgtttgcatgttgtttatttttctgaattttcatctctgaaaattttaattttttaaaacagagctattaattttttctttcagtttaataaccccctcagtttaattaaactgtcattaaatttacttaaaaataatg

SEQ ID NO: 150290 - DNA, 601 bp, Human
tagaggtccttgaggtctgttaatatctataatatctaatgattctatcattaataaatctgaaaagcaatattgactgaaaaaagcaagagatatacatagtgtggtaccacttaggtaaatttaaatacaaaatattactatttattgatagatgcatatgtaatgttgcttattggcatttttttgaaatgctctgtaaggaaacactcattcttaagagagtagtcacctaatggtgagcggggtagagagtagagacacgggttgatggtcatagaagactgttgcatcatctctrgtgttttattttatgaaaaacaatagcaaaacgacatcagtataacagaatgttctgaatattaggaagataagtttttgtttgcatgttgtttatttttctgaattttcatctctgaaaattttaattttttaaaacagagctattaattttttctttcagtttaataaccccctcagtttaattaaactgtcattaaatttacttaaaaataatgaaatcgtcagacaaactgacagcttgtttgattttttttttttttgagatggagtctcgctctggctggagtacagtggcgcg

SEQ ID NO: 150291 - DNA, 601 bp, Human
cataaaaatatttaaccataaatttactaagatgaaaaattatgaaagaataattatcaagaaaaaaatttaaaaataaaatgaaaaatatcaggataaaaaattttatcaatacattactactgtaggaaatacataaatatgcacacatatacaagaaaaatattggaagaaaatttatgcaatgcaatatcatcacacagatttaaaataaaaaacaattttttttttttttttgagacggagtctcgctctcttgcccaggccggagtgcagtggcatgatctcggctcactgcaasctctgcctcccgggttcatgccattctcctgcctcagcctaccgagtagctgggactacaggcgcctgccactacacccggctaatttttttatatttttagtagagacagggtttcactgtgttagccaggatggtctcgatctcctgaccttgtgatccgcccgcctccgcctcccaaagtgctgggattacaggcgtgagccaccgcgcccggcaaaaaaaattatttttaaagtagccccaaaaattagtgctgcctaatttatgatccaagggttatctccacactccagttttt

SEQ ID NO: 150292 - DNA, 601 bp, Human
agttgttctttctgcctgaaataaccttccactatctaagctgggcacaacatgcctgtagtcccagctactcgagaagctgaggtaggaggattgttgaggccaatcgactgttaggagttcaagactgttaggcgtgggcaacatagcaagaccccatctcttaaaaaaaaaatcctgggccaggagcagtgactcacgcctgtaatcccagcactttgggatgtcgaggagggtggatcatttgaggtcaggagttcgagaccagcctggccaacatggtgagaccctgtctctattaaaaatacaaaaattagtcgggtgtggtggtgggtgcctgtaatcccagctactcgggggctgaggcaggagaatcgcttgaacccaggaggtagaggttgcagtgagctaagattgtgcttctgcactccagcctgggtgacagtgagactccgtctcaaaaaataaatatataaataaatcctggattcacctcatgtgtcacacatgttccctaacaccaatcctcccatgaacgtcttactgtcactatcagaacacttatctacaaaatcacaactatttatcattttttcagagt

SEQ ID NO: 150293 - DNA, 601 bp, Human
cttattgatattttaacactaattacataccggccttttaatgcattaaaaagtctgattccatctgcagggccacagatttggatcacatcatctctagttaatttcaataaatctgcccctggaataaatataagaaaatggatgataaaggcaaagattctctttgttaatgactattaaaatgggctgtattataaggacacctcattaccagaatgttacaatccataattttcttcatggcatataaggcccttcatgacctggctcctagctcctctcccgtctcaattccccycaattaacctccccacttaaccctatgctttcatcatactgatgatgtctaatgagcaagttgttctttctgcctgaaataaccttccactatctaagctgggcacaacatgcctgtagtcccagctactcgagaagctgaggtaggaggattgttgaggccaatcgactgttaggagttcaagactgttaggcgtgggcaacatagcaagaccccatctcttaaaaaaaaaatcctgggccaggagcagtgactcacgcctgtaatcccagcactttgggatgtcgaggagggtggatc

SEQ ID NO: 150294 - DNA, 601 bp, Human
actacctcttgatctgatcatcttactccttccaatttctaaacaccctttagataatatgcttgaaaaaatgaaagatcaattatttttccacaagtcatcaacccctgatttcacttccttccttaaaattttccaagattcaacatcccttatgatgtagacaaaaacaaatatgaccaggcacggtggctcacatctgtaatcccagcactttaggaaggcgagtcagaaggattgcttgagctcaggagtttgagaccagccaggggaacacggcaaaaccccgcctctacaaaargtacaaaattaggcgggcgtggtggtgcgtgcctgtagtcccagctgctcagggatctaggcaggaggatggcttgagcccaggaaatcgaggctgcagtgagccatgattgcattgctgcactccaggctgggtgacagagcaagaccctgtctgaagaaaaaaaccccaaaacaaaagcaaaccaaaaataaatactgcacactctgttttactatgtagtcactgatttagttctgttgccattgacctaaatgcttttttcatcagttactactacctatttaaaattgtaaatcc

SEQ ID NO: 150295 - DNA, 601 bp, Human
ttcacttaaaaatgtcattatatatgcccagaaatgacatcttttacaactatttaaactttaacaaaaaattttaagtcaacctaaaaatgtgcatgggaatatgtggtttttaaaatattttaggaccaggcgcagtggctcacatctggaatcccaccactttgggaggccgaggcgggtggatcacttgaggccaggagtttgagaccaacctggccaacatggcaaaaccccatctctactaaaaatacaaaaattagccaggcgtggtggcgcacgcctgtaattcccactattygggaagctgagacaggagaatcacttgaatccaggaggaggaggtcgcagtgacctgagattgggccactgcactccggcctgggcaacagagagagactgtttcaaaaaaaaaaaaaattaggaggaaagcaagcaaaaaagtatgaaaccctctgatctagaaaacagaacactctgccccaggagaactgctcttgctccatgcgctgacaaattaatcatcatctggtaattcaactgtactgaaaaatctacctcatcactgatgagcacatgaattcctgttggcccctgcttg

SEQ ID NO: 150296 - DNA, 601 bp, Human
taaggttacatgggatgcaattagaataatgatgtaaccatttcacttaaaaatgtcattatatatgcccagaaatgacatcttttacaactatttaaactttaacaaaaaattttaagtcaacctaaaaatgtgcatgggaatatgtggtttttaaaatattttaggaccaggcgcagtggctcacatctggaatcccaccactttgggaggccgaggcgggtggatcacttgaggccaggagtttgagaccaacctggccaacatggcaaaaccccatctctactaaaaatacaaaaattagccaggcgtggtggcgcacgcctgtaattcccactatttgggaagctgagacaggagaatcacttgaatccaggaggaggaggtcgcagtgacctgagattgggccactgcactccggcctgggcaacagagagagactgtttcaaaaaaaaaaaaaattaggaggaaagcaagcaaaaaagtatgaaaccctctgatctagaaaacagaacactctgccccaggagaactgctcttgctccatgcgctgacaaattaatcatcatctggtaattcaactgtactgaaaaatctacct

SEQ ID NO: 150297 - DNA, 601 bp, Human
ccttgtgatccacccgtctcagcctcccaaagtgctgggtttacaggcatgagccattgcgcctgggcagccttcttaatctttaataattacttattaaaacatgtagcatatttacattattttaatcaattgtataattatgataattccattataataatttttaaatttttatttaaaaactttatttcaaacaaatatagtaggataatcaataaaagatgtttgtgcataaaaatatgttatggtaagatggccaggcgtggtggttcacatctgtaatcccagcacttcgggrggctgaggcgggttgatcacttgaggccaggagttcgagaccagactggccacatggtgaaacccagcctctactaaaaatacaaaaattagccaggcatggtggtgggtgcctgtaataccagctacttgggaggctgaggcaggagaattgcttgaacctaggaggcggggttgcagtgagccgagatcacaccaccacacaacagcctgggcgacagagtgagactctgtctcaaaaaaaaaaagttacagtaagataaaattcaccgggggaagtaaatgaaaataagagttcaag

SEQ ID NO: 150298 - DNA, 601 bp, Human
cgtgccaccacacccggctaattttgtattttagtagagacagggtttctctatgttggtcaaactcctgacctcaggtgatctgcttgcctcggcctcccaaagtgctgggattacaggtgtgagccactgtgcctggccttctttttttctttttttggatgaagtctcgctctgtcgcctaggctggagtgcggtggcgcaatcttggctcaccgcaacctctgcctctcgggttcaagcagttctctgcctcagcctcccaagtagctgggattataggcacctgccatcatgcccrgctaatttttgtatttttagtagagatggggtttcaccatcttggacacgatggtcttgaacttctgaccttgtgatccacccgtctcagcctcccaaagtgctgggtttacaggcatgagccattgcgcctgggcagccttcttaatctttaataattacttattaaaacatgtagcatatttacattattttaatcaattgtataattatgataattccattataataatttttaaatttttatttaaaaactttatttcaaacaaatatagtaggataatcaataaaagatgtttgt

SEQ ID NO: 150299 - DNA, 601 bp, Human
agaggattcaaaatgattttttggtaatatcactatgtaatttctggtatataattctgaagtataatctaatgacattgtcattacaaaattccatccattcctatcaatttatgggaatcaagtccctcagcatttatatctagaggaaaaaaacagaatggaattgatgctgaaatcctgtgtcattctagcaatcaataggcagtattcagctacaaaggaaataattatgtgcaagggtacgggtagggaacgaaacaatttcatcgaactcattcatagatatacctgtaataattttttcttaatttttttttttttttctgagacagagttttgctcttgttgcccaggctggagcgcaatgcccccatctcggctcacgcaacctccgcctcctgggttcaagggattctcctgcctcagcctcctgagtaggtgggattataggcacgtgccaccacacccggctaattttgtattttagtagagacagggtttctctatgttggtcaaactcctgacctcaggtgatctgcttgcctcggcctcccaaagtgctgggattacaggtgtgagccactgtgcctggccttct

SEQ ID NO: 150300 - DNA, 601 bp, Human
tatgtgcatacaggagaactgacttccgtgtcttcaactcccatatgtgctctttcctaaaacctctttaattttccttccccactttcccttctcaaactcccttctcccagggataaactcccttctcccaagataaaggcatgagtttcaccctcccaggatcctaataaggtggcccatgatgtgaaagcttcaggtggcaaagtggaatggcgaaggtgaacgctaataactgagcaatagacccttttatgagccacatggtttctaactctttcctttcaccagaattaaagartaacctaatcacaaattgtcgtaagacagaggattcaaaatgattttttggtaatatcactatgtaatttctggtatataattctgaagtataatctaatgacattgtcattacaaaattccatccattcctatcaatttatgggaatcaagtccctcagcatttatatctagaggaaaaaaacagaatggaattgatgctgaaatcctgtgtcattctagcaatcaataggcagtattcagctacaaaggaaataattatgtgcaagggtacgggtagggaacgaaacaatttcatcga

SEQ ID NO: 150301 - DNA, 601 bp, Human
cctgggttaaccccaagactctccaaggagcacacggacacaaatatgtgcatacaggagaactgacttccgtgtcttcaactcccatatgtgctctttcctaaaacctctttaattttccttccccactttcccttctcaaactcccttctcccagggataaactcccttctcccaagataaaggcatgagtttcaccctcccaggatcctaataaggtggcccatgatgtgaaagcttcaggtggcaaagtggaatggcgaaggtgaacgctaataactgagcaatagacccttttatragccacatggtttctaactctttcctttcaccagaattaaagaataacctaatcacaaattgtcgtaagacagaggattcaaaatgattttttggtaatatcactatgtaatttctggtatataattctgaagtataatctaatgacattgtcattacaaaattccatccattcctatcaatttatgggaatcaagtccctcagcatttatatctagaggaaaaaaacagaatggaattgatgctgaaatcctgtgtcattctagcaatcaataggcagtattcagctacaaaggaaata

SEQ ID NO: 150302 - DNA, 601 bp, Human
acaacatgcctcaatttcctcatctgtaatggaagatggaagagaatggcaaaaagctgggccaggcacagtggctcatgtctgtaatcccagcactttgggaggccaaggtgggtggatcgcttgaggtcaggagttcgagaccagcctggccaacaaggtgaaacccatctctactaaaaatacaaaaattagccagacatggtggcacgtgcctgtaatcccagctacttgggaggcagagggaggagaatcacttgaacttgggaagcgaaggttgtagtgagccgagatcatgccmctgcactccagcctgggcaacagatcgagactctgtttcaaaaaaaaaaaaaaaaaaaaaaagccaacttaaaaaaaggaacaatctctaatattgtcactttctttacccaaatatggttacttttcctatctctcctcaaagaagtatgtactttgcctagtagtagtaaagctgttaaactgcttagagaaagatgtttgtcttactattacctttcattgtgtccagaataaaacatgcttcttcctgaaagttctgtatcatctgaaaaatgcaagaaaatttgtgattatttaa

SEQ ID NO: 150303 - DNA, 601 bp, Human
agttctaagtactttgttgtttattaactaatttcataccaacaaccctgtaagactgatattatcaatccccattttaagtacgtggaacaaaagaagaaagaggcaaacaacatgctcaaagatttacaaagccaagaaatcatgcgaactggtggggcttcgggttccagaagtcaatgtaaacatagcttctccatttttcaccaacagtcactaaaattgaggccagcaagtttttagaagcctatctccccttgcaaactctccttccatataatttttgcttttgcaagagatrtcacatttaagcggtagctttaaaagtggggacacatgaaacgcacagctgggagagccatccagcccacttacatatgtgcaatatccccctgtagaaaaaccctgctcattggagcctggaatccagagggtccctgagagctacacaaacagccttaaaaccaatctacccacaattactgagccgcgtatgcaggctattcacacagaaggcgctccctgaagtcggttaggttataatgagtcttttgttgaagcggggcggcgggaggccccggagagcagcccggccccctgc

SEQ ID NO: 150304 - DNA, 601 bp, Human
aactgagtaggccaagcaagactgtcaatgaaatactgtccaatgaaaaaataaacagccgaaggtttcaggtttcatttacccaacacaggtatcacaataaatgacctagtataatgatagtttccaaccgtatttaataaaacaaacacgcagcagaaatcctctagtcacatataactacactataccctcagatcaaagttaatgatgtcaatggaaagtataggccggcgggttcactggtgataagtcatgagactctgagcaaagaataagtaataaggttagaattctttasaagtgttaaggggaaagaaggtaacaacaacaaaaactcctccacatcaagagttctaagtactttgttgtttattaactaatttcataccaacaaccctgtaagactgatattatcaatccccattttaagtacgtggaacaaaagaagaaagaggcaaacaacatgctcaaagatttacaaagccaagaaatcatgcgaactggtggggcttcgggttccagaagtcaatgtaaacatagcttctccatttttcaccaacagtcactaaaattgaggccagcaagtttttagaagcct

SEQ ID NO: 150305 - DNA, 601 bp, Human
atagccgcttctttgaagggaagaattagaagacaaagcagtcttccactggtgtatcccagatagcaccacgagaatatgagaaggctttttaaggccataggaagggcagatatctgtcagcagacatttgtacgtatgtgcatggtgaggaggcagagaataaagatgtctttgattcaacaacactcacccaaattcttagcaatgaaagtcaaacaagaaagatctggcagggcgcggtggctcacaccaccccagcacttcggaaggccgatacaggtggatcacttgaggtcargagttccagaccagcctggccaacatggtgaaaccccgtcactactaaaaatacaaaaaaaattcgccaggcatcaagaggctgaggcaggagaatcgcttgaacccgggaggcagaggttgcagtgagccgagatcgcgctattacattccagcctgggcaacaagagcgaaactccgtatcaaaaaacgaaagaaagaaagaaaaagatcctactttgtagatataattctctaaccttcactgagtcataactgaaccaaagctgcctactagctttgtagagtaatccaagggacc

SEQ ID NO: 150306 - DNA, 601 bp, Human
tcctgtagtcccaactactcaggaggctaaggtgggaggatcccttgagcccaggaagtcaaagctgcagcgaaccatgattgcaccactacgctccaggctggatgacaaagcgagaccctgtctagaagaaaaagagggggattataattgatataactaatctagaggtgattttaagtacatgggacgatgtacataagttaaatgcaaatactacaccattttatagggacttaagcatcatcccaggattttggtatgcatgtgagtgaggtcctggaaccaatcccctacagayaccaaaccatactttgcatgccctagtaataatctcaaaattggagacatcctatttaacttacaaaaccacaatttcgggccaggcgcggtggctcacacccataatgccagcactttgggaggcagaggcaggtggatcatttgaggtcaggagttcaagaccagccttgccaacatggcaaaaccccatctctactaaaaatacaataattagccaggcagtagtggcacgtgcctgtaatcccagctacttgggaggctgaggcaggagaatcgcttgagcctgggaggcagaggt

SEQ ID NO: 150307 - DNA, 601 bp, Human
gtttcaaacaactgcagatcaaaaagatttgggggaaaaaacggttgcttgtgcctgtactgaacatatacaccatttttttcttggtattattccctaaacaatacagaacaattatttacatagcaattacattgtattaagtattatagacccagtgcagttgctcacacctgtaatcccagcactttgggaggctgaggcagcccagaaatttgagaccagcctgggcgacatagtgagacattgtctctacaaaaaatttaagaattagccatgtgtgatggccacactcctgtartcccaactactcaggaggctaaggtgggaggatcccttgagcccaggaagtcaaagctgcagcgaaccatgattgcaccactacgctccaggctggatgacaaagcgagaccctgtctagaagaaaaagagggggattataattgatataactaatctagaggtgattttaagtacatgggacgatgtacataagttaaatgcaaatactacaccattttatagggacttaagcatcatcccaggattttggtatgcatgtgagtgaggtcctggaaccaatcccctacagataccaaac

SEQ ID NO: 150308 - DNA, 601 bp, Human
ctcaagtgatcctcccacctcagcctcccaagttcccaagtagctgagactacaggcacgtaccaccacagctggcttttttttttttttgtaaaggtggggtcttgctatgttactcaggctggtctcaaactcctgggctcaagtgaggtattattttttacactggagtaagtttatcctgttttcctcttattaaaatgaatttgatataaaatgatacacagaaaaaaaaagtcaggttgaagactgattatgtgtacttcatggtaaacagtgaaaagcccctgtggtaagtatwcattttagaaaaaggcctcaaaactctaatcccctctactcaagtgggtaatattagaatgtcttcaaccaaaagccacacaaacacactcagtttataaagtacaaacagagctgctattatacaatgcgcttaacatgaaccagtctctctctctctctctggcataatggccactgagatacagtcaggcctctgtaaccctgggttccacatttgtggtttcaaacaactgcagatcaaaaagatttgggggaaaaaacggttgcttgtgcctgtactgaacatatacaccatttt

SEQ ID NO: 150309 - DNA, 601 bp, Human
tgtgggtgcctgtaatcccagctattgggaggctgaggcaggagaaacgcttgaacctgggaagtggaggttgcagtgagccgagatcatgccactgcactccagcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctagcattttggaaggccraggcgagcagagttcaatgccagcctgggcaacagggcaaaaccccatccctacaaaaaatatacaaaaattagctgggtgtggtagtgcgtgctacttgggagactgaggtgggcagactgcttgagcctgggaggttgtggctgcagtgagccatgatcagggcaccccagcctgggctacagagcaagaccctgtctgtcataaacaaataaataaataaataaatagtttgggtttgaaataattcgttttcatataaaattcccctatagagaataaaggtactcaaaaccattt

SEQ ID NO: 150310 - DNA, 601 bp, Human
ttagccgggcgtggttgtgggtgcctgtaatcccagctattgggaggctgaggcaggagaaacgcttgaacctgggaagtggaggttgcagtgagccgagatcatgccactgcactccagcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctakcattttggaaggccgaggcgagcagagttcaatgccagcctgggcaacagggcaaaaccccatccctacaaaaaatatacaaaaattagctgggtgtggtagtgcgtgctacttgggagactgaggtgggcagactgcttgagcctgggaggttgtggctgcagtgagccatgatcagggcaccccagcctgggctacagagcaagaccctgtctgtcataaacaaataaataaataaataaatagtttgggtttgaaataattcgttttcatataaaattcccctatagagaataaagg

SEQ ID NO: 150311 - DNA, 601 bp, Human
ctggaagaacaatttggatagcccaaacctgttttaaaaactgcccctggctgggtggggtggttcacacctgtaatcccagcactttgggaagccaaggtgggtggatcacttgaggtcaggaggtcgagaccagcctggccaacatgacaaaaccccgtctctactaaaaatacaaaaattagccgggcgtggttgtgggtgcctgtaatcccagctattgggaggctgaggcaggagaaacgcttgaacctgggaagtggaggttgcagtgagccgagatcatgccactgcactccakcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctagcattttggaaggccgaggcgagcagagttcaatgccagcctgggcaacagggcaaaaccccatccctacaaaaaatatacaaaaattagctgggtgtggtagtgcgtgctacttgggag

SEQ ID NO: 150312 - DNA, 601 bp, Human
taagaactctggaagaacaatttggatagcccaaacctgttttaaaaactgcccctggctgggtggggtggttcacacctgtaatcccagcactttgggaagccaaggtgggtggatcacttgaggtcaggaggtcgagaccagcctggccaacatgacaaaaccccgtctctactaaaaatacaaaaattagccgggcgtggttgtgggtgcctgtaatcccagctattgggaggctgaggcaggagaaacgcttgaacctgggaagtggaggttgcagtgagccgagatcatgccactkcactccagcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctagcattttggaaggccgaggcgagcagagttcaatgccagcctgggcaacagggcaaaaccccatccctacaaaaaatatacaaaaattagctgggtgtggtagtgcgtgcta

SEQ ID NO: 150313 - DNA, 601 bp, Human
agtttgaaattatatgaaaattaagttaccccccaaaacacatactagctataataaattctaacatctaattaacagtaattctgtatattctcttagcatttataagaactctggaagaacaatttggatagcccaaacctgttttaaaaactgcccctggctgggtggggtggttcacacctgtaatcccagcactttgggaagccaaggtgggtggatcacttgaggtcaggaggtcgagaccagcctggccaacatgacaaaaccccgtctctactaaaaatacaaaaattagccrggcgtggttgtgggtgcctgtaatcccagctattgggaggctgaggcaggagaaacgcttgaacctgggaagtggaggttgcagtgagccgagatcatgccactgcactccagcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctagcatttt

SEQ ID NO: 150314 - DNA, 601 bp, Human
gcaagtttgaaattatatgaaaattaagttaccccccaaaacacatactagctataataaattctaacatctaattaacagtaattctgtatattctcttagcatttataagaactctggaagaacaatttggatagcccaaacctgttttaaaaactgcccctggctgggtggggtggttcacacctgtaatcccagcactttgggaagccaaggtgggtggatcacttgaggtcaggaggtcgagaccagcctggccaacatgacaaaaccccgtctctactaaaaatacaaaaattakccgggcgtggttgtgggtgcctgtaatcccagctattgggaggctgaggcaggagaaacgcttgaacctgggaagtggaggttgcagtgagccgagatcatgccactgcactccagcctgggcaaccaagcaagaccccatctcaaaaaaaaaacaaaaaacacaaaacagaaaactgcccctaagaaagtttgaaatactgagtattaatatatacaacttcaacttttttttttttaatctacggttaaaacaaaagtttgggccgagtgcggtggctcaagcctgtaatcctagcat

SEQ ID NO: 150315 - DNA, 601 bp, Human
gacgatctatcatgtatagataggatacaatctctaaaatattacatgttgtcaagtcaaaagaccaatttgttgagcagcatgctatcatgtatgtagcaaaaagaaaaaagagaaaacacacacgtacacgtacaatctccaaaggacacaccaaaaactggtaataaaggccatccctgagagaaggaaggagtaggagagcccaaatgaggtcatgtgaagggaaaacctctcactgaatatacactgtataccttttgcacataaaaagaagttttaccagatacatgtattattwgccttataaaaaatgtcaaggtcatatagattcactcagcttctcaacaaacattttagggatgttcagttgaactctctgataaagcttctgcaatagataatcagaagtctacagctgtctaattggcaggtatttattgccttcagcctaacttactactagtttgtcttagtgccacctaaatgtaaaatattaaaaatcccctctcaggaaagcattcctgactccctaatttggcttaagtggcttctccgtgttccctcaaggcacccactgcttaccactgtcattttcttg

SEQ ID NO: 150316 - DNA, 601 bp, Human
cagggggagactccatctcaaaaaaaaaaaaaaaagttagccgggtgtggtggtgaacacctgtaatcccagctactggggaggctgaggcaggagaattgcttgaacctgggaggcggaggttgcaataagccgagatcgcgccactgcactccagcctgggtgacaagagcaaaactctgtctcaaaaaaaaaaaaaaaaaaaaaaaattagttgggtgtggtggtgggcgtctgtagtcccgggaggctaaggtgggaggatcacctgagtctgggaggtcaaggctgcagtgagtgytgatcaggccactgcattccagcctgggtgacaaagcaagaccctgtctcaaaaaaaaagtgttgtaagactgttttacaagataaaaatgctaacaaaattttattttctgtctaaaatttcaaaagtctacatattctttgatctagcaattttactcctaaaaatgtattctttaaaaaaaaaaagcaaaaagtactcatcaaggaaatatgtacaaggatatttcccacagcattgtttgtagtatgaaaagactgtaaacaaccttgatattagtagaggactggttgaataaac

SEQ ID NO: 150317 - DNA, 601 bp, Human
gttacagctcttttagaatgtgtctagcaggctttctggctttcactgtgaaacccttcacggatggcagggggtggtggacaaattgaacaggaggtattttagtgagacagcaaataccatttttttttttttttgagtctttgagtcggagtcttgctctgtcgcccaggctggagtgcagtggtgcaatctcagctcactgcaacctctgcctcctgggttcaagtgattctcctgcctcagcctcccgagtagctgggattacaggtgcccgccaccacgcccagccaattttttrtatttttagtagagacagggtttcaccgtgttagccaggatggtctcgatctgctgacctcgtgatccgcccgcctcagcctcccatagtgctgggattataggcatgagccaacgcacctggccaggcaaatacttttttaataagcatctacacagaggctgctaggcaagtatccattctctgcctttgcctccaaattatcccaagtgtctaaagccagacacatttccccctattttatgagttgttttttttttttttttttttagtttttttagacggagtctcactctgttg

SEQ ID NO: 150318 - DNA, 601 bp, Human
gtcttagtcaagattttgctggcaagacttcaaaaccaaattgaagtgttacagctcttttagaatgtgtctagcaggctttctggctttcactgtgaaacccttcacggatggcagggggtggtggacaaattgaacaggaggtattttagtgagacagcaaataccatttttttttttttttgagtctttgagtcggagtcttgctctgtcgcccaggctggagtgcagtggtgcaatctcagctcactgcaacctctgcctcctgggttcaagtgattctcctgcctcagcctcccgrgtagctgggattacaggtgcccgccaccacgcccagccaattttttgtatttttagtagagacagggtttcaccgtgttagccaggatggtctcgatctgctgacctcgtgatccgcccgcctcagcctcccatagtgctgggattataggcatgagccaacgcacctggccaggcaaatacttttttaataagcatctacacagaggctgctaggcaagtatccattctctgcctttgcctccaaattatcccaagtgtctaaagccagacacatttccccctattttatgagttgttt

SEQ ID NO: 150319 - DNA, 601 bp, Human
ctctgtatgactgaatccttactatgaaaagagtaatttttctactgaattaggtaaccttgaaaataattacagttttcagaatatgactgacagatatttaacaaaaaaagaaaagtcttagtcaagattttgctggcaagacttcaaaaccaaattgaagtgttacagctcttttagaatgtgtctagcaggctttctggctttcactgtgaaacccttcacggatggcagggggtggtggacaaattgaacaggaggtattttagtgagacagcaaataccatttttttttttttttgagtctttgagtcggagtcttgctctgtcgcccaggctggagtgcagtggtgcaatctcagctcactgcaacctctgcctcctgggttcaagtgattctcctgcctcagcctcccgagtagctgggattacaggtgcccgccaccacgcccagccaattttttgtatttttagtagagacagggtttcaccgtgttagccaggatggtctcgatctgctgacctcgtgatccgcccgcctcagcctcccatagtgctgggattataggcatgagccaacgcacctggccaggcaaatact

SEQ ID NO: 150320 - DNA, 601 bp, Human; identical to SEQ ID NO: 19658

SEQ ID NO: 150321 - DNA, 601 bp, Human; identical to SEQ ID NO: 19659

SEQ ID NO: 150322 - DNA, 601 bp, Human; identical to SEQ ID NO: 19660

SEQ ID NO: 150323 - DNA, 601 bp, Human; identical to SEQ ID NO: 19661

SEQ ID NO: 150324 - DNA, 601 bp, Human; identical to SEQ ID NO: 19662

SEQ ID NO: 150325 - DNA, 601 bp, Human; identical to SEQ ID NO: 19663

SEQ ID NO: 150326 - DNA, 601 bp, Human; identical to SEQ ID NO: 19664

SEQ ID NO: 150327 - DNA, 601 bp, Human; identical to SEQ ID NO: 19665

SEQ ID NO: 150328 - DNA, 601 bp, Human; identical to SEQ ID NO: 19666

SEQ ID NO: 150329 - DNA, 601 bp, Human; identical to SEQ ID NO: 19667

SEQ ID NO: 150330 - DNA, 601 bp, Human; identical to SEQ ID NO: 19668

SEQ ID NO: 150331 - DNA, 601 bp, Human; identical to SEQ ID NO: 19669

SEQ ID NO: 150332 - DNA, 601 bp, Human; identical to SEQ ID NO: 19670

SEQ ID NO: 150333 - DNA, 601 bp, Human; identical to SEQ ID NO: 19671

SEQ ID NO: 150334 - DNA, 601 bp, Human; identical to SEQ ID NO: 19672

SEQ ID NO: 150335 - DNA, 601 bp, Human; identical to SEQ ID NO: 19673

SEQ ID NO: 150336 - DNA, 601 bp, Human; identical to SEQ ID NO: 19674

SEQ ID NO: 150337 - DNA, 601 bp, Human; identical to SEQ ID NO: 19675

SEQ ID NO: 150338 - DNA, 601 bp, Human; identical to SEQ ID NO: 19676

SEQ ID NO: 150339 - DNA, 601 bp, Human; identical to SEQ ID NO: 19677

SEQ ID NO: 150340 - DNA, 601 bp, Human; identical to SEQ ID NO: 19678

SEQ ID NO: 150341 - DNA, 601 bp, Human
attgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagatt

SEQ ID NO: 150342 - DNA, 601 bp, Human
cagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggttt

SEQ ID NO: 150343 - DNA, 601 bp, Human
atctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatasctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgc

SEQ ID NO: 150344 - DNA, 601 bp, Human
ttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgtttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggat

SEQ ID NO: 150345 - DNA, 601 bp, Human
tgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgcctygacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctc

SEQ ID NO: 150346 - DNA, 601 bp, Human
ctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtraaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttga

SEQ ID NO: 150347 - DNA, 601 bp, Human
taagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcartggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgat

SEQ ID NO: 150348 - DNA, 601 bp, Human
ggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatakgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggttttttttttttttttggtcgttcacaattactgtttcctcaaactgccatgcttcttctagaactgatagtgctttgtttcctttgtgatgagaagcctttcccttcagggtgag

SEQ ID NO: 150349 - DNA, 601 bp, Human
tttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggttttttttttttttttggtcgttcacaattactgtttcctcaaactgccatgcttcttctagaactgatagtgctttgtttcytttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagcctgagaatgtgaatcattcttagaatcattttctacataaagtcctgaattggtgtttttagaatccagtgaagcagtcattcttttaacagtcaccagcattccagaaaagtcatgaaaaattcaggcaca

SEQ ID NO: 150350 - DNA, 601 bp, Human
cagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggytttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggc

SEQ ID NO: 150351 - DNA, 601 bp, Human
tgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccaytggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaa

SEQ ID NO: 150352 - DNA, 601 bp, Human
tgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattkgggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagc

SEQ ID NO: 150353 - DNA, 601 bp, Human
gaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagcygagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacaga

SEQ ID NO: 150354 - DNA, 601 bp, Human
gagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagwctaaattattttttttctgggttaagacagaacataaattgtgtgtgtgtgtgtgtgtgtgtgtgtgtgtgtgtgtctgtgtgtgtagggaggatgggcagccaggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaact

SEQ ID NO: 150355 - DNA, 601 bp, Human
atcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgsgttaagacagaacataaattgtgtgtgtgtgtgtgtgtgtgtgtgtgtgtgtgtgtctgtgtgtgtagggaggatgggcagccaggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacc

SEQ ID NO: 150356 - DNA, 601 bp, Human
ctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagccmggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataa

SEQ ID NO: 150357 - DNA, 601 bp, Human
gggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcawctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgatt

SEQ ID NO: 150358 - DNA, 601 bp, Human
gggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcagrtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcc

SEQ ID NO: 150359 - DNA, 601 bp, Human
tctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacarccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagcca

SEQ ID NO: 150360 - DNA, 601 bp, Human
cagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccartaactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaat

SEQ ID NO: 150361 - DNA, 601 bp, Human
aactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttatagggccaactatttsctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttc

SEQ ID NO: 150362 - DNA, 601 bp, Human
tcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaayggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattg

SEQ ID NO: 150363 - DNA, 601 bp, Human
aaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtrcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcag

SEQ ID NO: 150364 - DNA, 601 bp, Human
ttcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagyaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgccta

SEQ ID NO: 150365 - DNA, 601 bp, Human
acagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcarcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggc

SEQ ID NO: 150366 - DNA, 601 bp, Human
gcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcstaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacaca

SEQ ID NO: 150367 - DNA, 601 bp, Human
gtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacacacacacaygagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccc

SEQ ID NO: 150368 - DNA, 601 bp, Human
gttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgcmttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcaca

SEQ ID NO: 150369 - DNA, 601 bp, Human
aagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaatarttctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacaggagtttgacttttttagatgtatatagcatataataaatattaagttcaaccttacgaaattggtgatatttgactatgttttacctatgagaatggcattttcgtatagtttgatc

SEQ ID NO: 150370 - DNA, 601 bp, Human
gttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctakgctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtg

SEQ ID NO: 150371 - DNA, 601 bp, Human
ttattcaacagaatctatcagaagggatttcaaaagctgcagtctgtggtgttgtgataagtgaagaaaagcatttcccctatttcagacagcctttgatagcatatgtatttaggaaaatatatacagattcatcaactgtgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctytgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgt

SEQ ID NO: 150372 - DNA, 601 bp, Human
cttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcstttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggaga

SEQ ID NO: 150373 - DNA, 601 bp, Human
gaaaatccatgttcttattatatatcagttgtacattatagattttgtacaaagtaaggttagactttttttttttttttcttaatatccttttgcaagagggaagggaaatattctagagctgtactttccagtatggaagcccctgtctgcgtgtggctactgagcacttgaaatgtgactaatgtggcttgagatgtgctgtaagtgtaatgtacacacacagtgtttcaaacttagtgtgcaagatatcttaattcatttatatattgattatgagttaagataatattttggatayactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcct

SEQ ID NO: 150374 - DNA, 601 bp, Human
aaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttscactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatct

SEQ ID NO: 150375 - DNA, 601 bp, Human
tggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataa

SEQ ID NO: 150376 - DNA, 601 bp, Human
ataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgacccckccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattg

SEQ ID NO: 150377 - DNA, 601 bp, Human
ttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttrgtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctg

SEQ ID NO: 150378 - DNA, 601 bp, Human
cattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttamatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgta

SEQ ID NO: 150379 - DNA, 601 bp, Human
aaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgyatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaatta

SEQ ID NO: 150380 - DNA, 601 bp, Human
ttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaartattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaata

SEQ ID NO: 150381 - DNA, 601 bp, Human
taactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactscaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggta

SEQ ID NO: 150382 - DNA, 601 bp, Human
gctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcrgaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagtt

SEQ ID NO: 150383 - DNA, 601 bp, Human
acacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggatygtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttc

SEQ ID NO: 150384 - DNA, 601 bp, Human
ttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagkgcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataac

SEQ ID NO: 150385 - DNA, 601 bp, Human
ctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcrcacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatatt

SEQ ID NO: 150386 - DNA, 601 bp, Human
tttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccawgctctgtttggggaagacttactatgcctgaagtattgtcagtcagtgttagatgctcatagatgggatcattaatgagggaggggagaagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaattt

SEQ ID NO: 150387 - DNA, 601 bp, Human
cttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttmaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctct

SEQ ID NO: 150388 - DNA, 601 bp, Human
ctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtawgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaa

SEQ ID NO: 150389 - DNA, 601 bp, Human
tggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatrtaagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggatctggggcaaagta

SEQ ID NO: 150390 - DNA, 601 bp, Human
gtgaaaactcccatgataaactcttttttgaaatggccttagttcattcatcacagattataactgttgaaaataaatagttgtgcttaacaaaaaacacacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagaygataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtt

SEQ ID NO: 150391 - DNA, 601 bp, Human
tgttttaaaaagttttctccaatctagaggtcaaataaatagtgctttttttcttcctaatttcattttttaccattcactttttaaaaaactgattaaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcmttgttttacacataaggacactgagtcgtccaggatcacagggcagcctggcattccatgtagtccaggctgtccacctccagaggctgtcttctttgcacactgcgccatcctgccttcccaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacagttgacgttccttctcatcttttt

SEQ ID NO: 150392 - DNA, 601 bp, Human
ccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctrtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaa

SEQ ID NO: 150393 - DNA, 601 bp, Human
tgttagaaaaataattttcaatttgcaagtgctattttttcccagttatactttattataaactagctttaatgtcttatggccatagaatatggactgtatactcttttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtwtcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaatttttttttttttgttacttaatgtgtgatcaatgttgatgaagcttctactggtgtttgaaaaggtggggtttgtagaatatagagtttggtatctgctaattccgtattttacaactactgtttttatcttcgtacagt

SEQ ID NO: 150394 - DNA, 601 bp, Human
ttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgayaccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagc

SEQ ID NO: 150395 - DNA, 601 bp, Human
tataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcrtttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtact

SEQ ID NO: 150396 - DNA, 601 bp, Human
cacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtctttyctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgccta

SEQ ID NO: 150397 - DNA, 601 bp, Human
tcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgctgggctctctcccagcatggcttcattaaggagactgcctctgcagcagtcacagtgcatgggcagagagacttctgcagagggggactcacacaagtgccatgagggtgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcaga

SEQ ID NO: 150398 - DNA, 601 bp, Human
ctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggtgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagyacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactca

SEQ ID NO: 150399 - DNA, 601 bp, Human
ctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacayataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactag

SEQ ID NO: 150400 - DNA, 601 bp, Human
ggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacrggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggca

SEQ ID NO: 150401 - DNA, 601 bp, Human
tggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattstgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattat

SEQ ID NO: 150402 - DNA, 601 bp, Human
tttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttcygtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgact

SEQ ID NO: 150403 - DNA, 601 bp, Human
tgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaargtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgt

SEQ ID NO: 150404 - DNA, 601 bp, Human
gtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacstgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatcca

SEQ ID NO: 150405 - DNA, 601 bp, Human
gtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcaytcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataatt

SEQ ID NO: 150406 - DNA, 601 bp, Human
tgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcrtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaag

SEQ ID NO: 150407 - DNA, 601 bp, Human
tattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtrctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatct

SEQ ID NO: 150408 - DNA, 601 bp, Human
aataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccrattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttt

SEQ ID NO: 150409 - DNA, 601 bp, Human
gctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcaga

SEQ ID NO: 150410 - DNA, 601 bp, Human
tcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaaktcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttc

SEQ ID NO: 150411 - DNA, 601 bp, Human
cctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctragtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttt

SEQ ID NO: 150412 - DNA, 601 bp, Human
attaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtgrctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgtt

SEQ ID NO: 150413 - DNA, 601 bp, Human
agtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcatagktttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttca

SEQ ID NO: 150414 - DNA, 601 bp, Human
ttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttatyactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttc

SEQ ID NO: 150415 - DNA, 601 bp, Human
gttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacagrcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggt

SEQ ID NO: 150416 - DNA, 601 bp, Human
agggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacrtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggca

SEQ ID NO: 150417 - DNA, 601 bp, Human
agccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggyggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttat

SEQ ID NO: 150418 - DNA, 601 bp, Human
ggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatatggtagctt

SEQ ID NO: 150419 - DNA, 601 bp, Human
tatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatatggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtatagga

SEQ ID NO: 150420 - DNA, 601 bp, Human
actgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatatggtagcttcaggtattgctgtatccagggatccaggggacttaaattatgttgtctgggcactgtatctttgggctctgcttgwtttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttca

SEQ ID NO: 150421 - DNA, 601 bp, Human
actgagtgttccagagatatggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaartggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgt

SEQ ID NO: 150422 - DNA, 601 bp, Human
catgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaatkagagttctgattgttccacatttttgccagtgtttgctgtgtgagtcttttttcttagaaccatgctagtgggtatatagtgatatttcactgttattttaacatgcatttctatgaggactaatgatgctgagtatgttttgttgtgcttattggccagtggtataccctattttcaagtttctaagtcttttacccattctttttatttgaattgttgctatatatatatagatagatagatagatagatagatagatagatagatagatactttaagttctgggatacatgtgcaga

SEQ ID NO: 150423 - DNA, 601 bp, Human
tgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaatgagagttctgattgttccacatttttgycagtgtttgctgtgtgagtcttttttcttagaaccatgctagtgggtatatagtgatatttcactgttattttaacatgcatttctatgaggactaatgatgctgagtatgttttgttgtgcttattggccagtggtataccctattttcaagtttctaagtcttttacccattctttttatttgaattgttgctatatatatatagatagatagatagatagatagatagatagatagatagatactttaagttctgggatacatgtgcagaacatgcaggtttgttacataggtttac

SEQ ID NO: 150424 - DNA, 601 bp, Human
gcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaatgagagttctgattgttccacatttttgccagtgtttgctgtgtgagtcttttttcttagaaccatgctagtgggtatatagtgatatttcactgttattttaacatgcatttctatgaggactaatgatgctgagtawgttttgttgtgcttattggccagtggtataccctattttcaagtttctaagtcttttacccattctttttatttgaattgttgctatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgt

SEQ ID NO: 150425 - DNA, 601 bp, Human
gcagcttatgtgaactttgaaagagttttccaaagtggtggtgctattttatattccaccaacaacgaatgagagttctgattgttccacatttttgccagtgtttgctgtgtgagtcttttttcttagaaccatgctagtgggtatatagtgatatttcactgttattttaacatgcatttctatgaggactaatgatgctgagtatgttttgttgtgcttattggccagtggtataccctattttcaagtttctaagtcttttacccattctttttatttgaattgttgctatatatakatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagttt

SEQ ID NO: 150426 - DNA, 601 bp, Human
tggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatawcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatc

SEQ ID NO: 150427 - DNA, 601 bp, Human
ttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattygtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagattttta

SEQ ID NO: 150428 - DNA, 601 bp, Human
tgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgartttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattattt

SEQ ID NO: 150429 - DNA, 601 bp, Human
aaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattytgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtct

SEQ ID NO: 150430 - DNA, 601 bp, Human
tcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataakgaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttg

SEQ ID NO: 150431 - DNA, 601 bp, Human
tatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcaytctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtctt

SEQ ID NO: 150432 - DNA, 601 bp, Human
atgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcayactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattac

SEQ ID NO: 150433 - DNA, 601 bp, Human
ctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtrttaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgcccctta

SEQ ID NO: 150434 - DNA, 601 bp, Human
ctctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatakaataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgat

SEQ ID NO: 150435 - DNA, 601 bp, Human
tataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttycccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcat

SEQ ID NO: 150436 - DNA, 601 bp, Human
gtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatrtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttattta

SEQ ID NO: 150437 - DNA, 601 bp, Human
tcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcytcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctc

SEQ ID NO: 150438 - DNA, 601 bp, Human
tctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgkaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagat

SEQ ID NO: 150439 - DNA, 601 bp, Human
atccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctstgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaatacc

SEQ ID NO: 150440 - DNA, 601 bp, Human
gtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcasaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattt

SEQ ID NO: 150441 - DNA, 601 bp, Human
cctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattktgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaa

SEQ ID NO: 150442 - DNA, 601 bp, Human
ctcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacrgatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattt

SEQ ID NO: 150443 - DNA, 601 bp, Human
tgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagtttyaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaat

SEQ ID NO: 150444 - DNA, 601 bp, Human
aaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccamcttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtggaatgagatctttttaccttcaatgagtccttagaatcacaaagattttctttgtgagcctctcactgtggcag

SEQ ID NO: 150445 - DNA, 601 bp, Human
aataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtgraatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggt

SEQ ID NO: 150446 - DNA, 601 bp, Human
gcgcagtggcccatgcctgtaatcctagcactttgggaggccgaggcaggcggattttctgagctcaggagtttgagaccagcctgggcaacatggtaaaaccccatttctatggcggagtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctrctggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgccca

SEQ ID NO: 150447 - DNA, 601 bp, Human
tttgggaggccgaggcaggcggattttctgagctcaggagtttgagaccagcctgggcaacatggtaaaaccccatttctatggcggagtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcsttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgat

SEQ ID NO: 150448 - DNA, 601 bp, Human
actaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcmctggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgt

SEQ ID NO: 150449 - DNA, 601 bp, Human
attgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaartgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataa

SEQ ID NO: 150450 - DNA, 601 bp, Human
agaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtcattggtaccccacttattatatgccaagttggtacatgaccatatttctccaaagataatccaytggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgta

SEQ ID NO: 150451 - DNA, 601 bp, Human
attggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgwaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctgtagtt

SEQ ID NO: 150452 - DNA, 601 bp, Human
gatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtt

SEQ ID NO: 150453 - DNA, 601 bp, Human
aaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccasagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatag

SEQ ID NO: 150454 - DNA, 601 bp, Human
ttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtytacactctctattcacttttgttggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacg

SEQ ID NO: 150455 - DNA, 601 bp, Human
ggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaragttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagtt

SEQ ID NO: 150456 - DNA, 601 bp, Human
tggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaraaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatagcatatttggagattaattctaatcatggcatgaaaaaaatgaattagattgggacaatgtttgtaatagtcagcttaaaagtattaatagataatgtggcttatgtagaagggaagaagaaatggtaatgaggtc

SEQ ID NO: 150457 - DNA, 601 bp, Human
agttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctrtcaacaatagatcgaatgtgtatatagttacaaactggaaagcaagaatacatcatagcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagaca

SEQ ID NO: 150458 - DNA, 601 bp, Human
ctgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatrgcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaa

SEQ ID NO: 150459 - DNA, 601 bp, Human
ttgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttyaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaattcagtgac

SEQ ID NO: 150460 - DNA, 601 bp, Human
tagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggwtgcctggtctgtagagccttcaagaaacgtaactgaattaggaaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaattcagtgaccaaaaaatttaacagggataaagacaatttcattattcacatctgtcaaaaactcttgttctggttctcttgaacaagaacatgaaactaaattaaacaaaacatct

SEQ ID NO: 150461 - DNA, 601 bp, Human
atgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaattcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgat

SEQ ID NO: 150462 - DNA, 601 bp, Human
tctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatatagtatattaatgaaagagaaaaatatttttaagctttcatattgaggmgttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattt

SEQ ID NO: 150463 - DNA, 601 bp, Human
ttgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtraggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttcttt

SEQ ID NO: 150464 - DNA, 601 bp, Human
agagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagctwctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgtt

SEQ ID NO: 150465 - DNA, 601 bp, Human
gacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccscaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatc

SEQ ID NO: 150466 - DNA, 601 bp, Human
cataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatwtttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttacgatagatcattgagctaggaaagtccgctcaaggaaattgctgttggtggtggcatgggcaagaatactgtgatattctttg

SEQ ID NO: 150467 - DNA, 601 bp, Human
tttaactctttctgttaatagatctattgccagccttgatcacattgatgaaagggcttccactgtgtccatattttgcaatcaatttggagactaaatctgccagaaataaagtaggcaggaacaaggaaacttacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggayattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataa

SEQ ID NO: 150468 - DNA, 601 bp, Human
gatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttrttgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagac

SEQ ID NO: 150469 - DNA, 601 bp, Human
gagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatgggsctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgtgtttc

SEQ ID NO: 150470 - DNA, 601 bp, Human
atgggcctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgkgtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatgataataaccctgtgacagatgtccctgcctcacacatttgttggcggagtttaatacagttatgtgtatgaacttcatagtatgggacctagcgcttag

SEQ ID NO: 150471 - DNA, 601 bp, Human
ttctcctgcctcagcctcctgagtagctgggactacaggcacccgccaccacactgggccaattttttttgttgttgttgtatttttagtagagactgtgtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatgrtaataaccctgtgacagatgtccctgcctcacacatttgttggcggagtttaatacagttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagag

SEQ ID NO: 150472 - DNA, 601 bp, Human
gccaattttttttgttgttgttgtatttttagtagagactgtgtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatgataataaccctgtgacagatgtccctgcctcacacatttgttggcggagtttaatacrgttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactac

SEQ ID NO: 150473 - DNA, 601 bp, Human
cttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggamaaggacgtgcatttcagctttgtttatcatgtgaacaaatattttaaaatacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacat

SEQ ID NO: 150474 - DNA, 601 bp, Human
gctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggacaaggacgtgcatttcagctttgtttatcatgtgaacaaatattttaaaakacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaatagctaaaaattggaggtggagagagtga

SEQ ID NO: 150475 - DNA, 601 bp, Human
atttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaatagctaaaaattggaggtggagagagtgaaaattatgagaaaaagtcatgtaatcattaggcaattaaataatttatccatagtgatgaacmcttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgtta

SEQ ID NO: 150476 - DNA, 601 bp, Human
aaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccasattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaa

SEQ ID NO: 150477 - DNA, 601 bp, Human
aatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtrccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagca

SEQ ID NO: 150478 - DNA, 601 bp, Human
agtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccacgtataatggataaaggattataataatttctagttaagatatttggaaatacataactgtatgtaactgaagaaaaactttgaaaagaagacgaggtkgtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaattgatggttacgtgagattacttcagtagcttattgttttcagtttcttgcaaacttagttctctgtccactttccacttcttttcctcccagtgtccatcatgtcttct

SEQ ID NO: 150479 - DNA, 601 bp, Human
atggggaggaaaaacaggtgctcatatatatagaattatgatgaggtattttgatatattaaaatatgaaggcagaattgtcatggaaagtaccacgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtatamagtactgtgaaaatgttaaagtaaactaaatatctggagtatgagtgatttttaaaaaatgatttctattggggtgggagtaattgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagatttttttt

SEQ ID NO: 150480 - DNA, 601 bp, Human
tccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcattcatttggataaacaccaggaaaggaagttttgaggaagaaactackgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctc

SEQ ID NO: 150481 - DNA, 601 bp, Human
ctgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcattcatttggataaacaccaggaaaggaagttttgaggaagaaactactgtggacaataaccaagtgtttccagtaactgggacataagataatctgtcttccaaaatatctccagtattccaaaatgaagacctattatgtagsaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactg

SEQ ID NO: 150482 - DNA, 601 bp, Human
tcactaaccagctcatatttttggaacttcagtttcatttgctctctatatttggcgggtattaataggtaatccccgaggtcacatccagttaacatttggttttcttgtctaagtattaatcatttataaagcattcatttggataaacaccaggaaaggaagttttgaggaagaaactactgtggacaataaccaagtgtttccagtaactgggacataagataatctgtcttccaaaatatctccagtattccaaaatgaagacctattatgtagcaaattttctttttaccacctsttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcacct

SEQ ID NO: 150483 - DNA, 601 bp, Human
tgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgawtacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagatttgggggtcag

SEQ ID NO: 150484 - DNA, 601 bp, Human
atagtcttcttctctgttggatcgtccctctaataaggacccttgtaaatacattgggcccacctagacagccccgaatgagcttcccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgycgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaa

SEQ ID NO: 150485 - DNA, 601 bp, Human
tatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaackccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgatttt

SEQ ID NO: 150486 - DNA, 601 bp, Human
tttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcaytttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattc

SEQ ID NO: 150487 - DNA, 601 bp, Human
aatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgktttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtg

SEQ ID NO: 150488 - DNA, 601 bp, Human
tcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagktttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggatttt

SEQ ID NO: 150489 - DNA, 601 bp, Human
ttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagycttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttac

SEQ ID NO: 150490 - DNA, 601 bp, Human
gtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaaytgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttttgttaacatgtaaattcatgtttccatattcagaatactgtataaagcttaatgtttttctttaggttatattccactaatgaggctacttagagaagatgaatgcattcttgtttgaaatgatttttttaatatgttgtcattga

SEQ ID NO: 150491 - DNA, 601 bp, Human
caataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttytgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataa

SEQ ID NO: 150492 - DNA, 601 bp, Human
taattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaatyatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaat

SEQ ID NO: 150493 - DNA, 601 bp, Human
agataaatttgttctgtgatgcacataaaaaacatgctgtgaatctctaattatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgrgtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctttgggaacatgggtttcagtagtaaatcactcatttctggggttctgctttg

SEQ ID NO: 150494 - DNA, 601 bp, Human
tagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctytgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccc

SEQ ID NO: 150495 - DNA, 601 bp, Human
tgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttrggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactgg

SEQ ID NO: 150496 - DNA, 601 bp, Human
atctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcarttaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgca

SEQ ID NO: 150497 - DNA, 601 bp, Human
atttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcstctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatacagtttactaataaaaccatcat

SEQ ID NO: 150498 - DNA, 601 bp, Human
gttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatayagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaat

SEQ ID NO: 150499 - DNA, 601 bp, Human
ggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgagrcagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagaaggggtttcaccatgttggttgggctggtctcaaactcctgaccccgtgatccaccttctagctactcttaaatatgcatcatcttttagatagaaaggtaaactataataaaaattttggtcagattttacagga

SEQ ID NO: 150500 - DNA, 601 bp, Human
aataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgaggcagaatttcgctcttgttgcccaggctggagtgcaatggcgcgatctcggcgcaccgcaacctctgtctcccgggttcaagtgattctcctgcctcagcctcctgtaactgggattacaggcmtgtgccaccacgcctggctaattttgtatttttagtagagaaggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatg

SEQ ID NO: 150501 - DNA, 601 bp, Human
agacttttaaaatctggaatgtcatttaaacggcatttctggagatacagccataaactaggaactctaagaattgtttctgcttgacagaagctattgctagctacttttattattattattattatttttgaggcagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagarggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttatta

SEQ ID NO: 150502 - DNA, 601 bp, Human
tctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtraagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggc

SEQ ID NO: 150503 - DNA, 601 bp, Human
tggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcrccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttg

SEQ ID NO: 150504 - DNA, 601 bp, Human
aaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagcygtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagt

SEQ ID NO: 150505 - DNA, 601 bp, Human
cattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttrgtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttgg

SEQ ID NO: 150506 - DNA, 601 bp, Human
tataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacatttcaatccctacatatacatgttcctctgtatatcttctcttaattgttgccatattggtcttgagctcattaactggtaactttatttttaacacctgaaaacartacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgatt

SEQ ID NO: 150507 - DNA, 601 bp, Human
aaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatktaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttat

SEQ ID NO: 150508 - DNA, 601 bp, Human
ccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctygaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggat

SEQ ID NO: 150509 - DNA, 601 bp, Human
agtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtrttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagat

SEQ ID NO: 150510 - DNA, 601 bp, Human
gggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagca

SEQ ID NO: 150511 - DNA, 601 bp, Human
cacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtgattagaagatagaatataatacaaacagaagctcctgtatcctcttgtgttttatttaat

SEQ ID NO: 150512 - DNA, 601 bp, Human
attgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttrgagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaa

SEQ ID NO: 150513 - DNA, 601 bp, Human
actagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcytgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggctta

SEQ ID NO: 150514 - DNA, 601 bp, Human
atgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcktctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaactttta

SEQ ID NO: 150515 - DNA, 601 bp, Human
gagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgatyattctctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgt

SEQ ID NO: 150516 - DNA, 601 bp, Human
tgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgattattcyctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgac

SEQ ID NO: 150517 - DNA, 601 bp, Human
agtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaagkagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtg

SEQ ID NO: 150518 - DNA, 601 bp, Human
gtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggwgttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtgg

SEQ ID NO: 150519 - DNA, 601 bp, Human
tctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggakttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtgga

SEQ ID NO: 150520 - DNA, 601 bp, Human
atcttggcttgctgcaacctctgcctcctaggttcaagtgattctcctgccttagcctctgaagtagctgggattacaggtgcccaccaccacacctggctaatttttgtggggttttttttaagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactgrtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagat

SEQ ID NO: 150521 - DNA, 601 bp, Human
ttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgayggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacatgcaccacacggtcttacaactgtagaaaagtatagtattgtgtttgtgtcgattttcagcatagtttatcatgctatacaaatgctacat

SEQ ID NO: 150522 - DNA, 601 bp, Human
tcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacatgcaccacacrgtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcag

SEQ ID NO: 150523 - DNA, 601 bp, Human
atcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctcttttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagagg

SEQ ID NO: 150524 - DNA, 601 bp, Human
gtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttgratttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaacc

SEQ ID NO: 150525 - DNA, 601 bp, Human
acccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctrtctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctc

SEQ ID NO: 150526 - DNA, 601 bp, Human
tcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttayataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagat

SEQ ID NO: 150527 - DNA, 601 bp, Human
tttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcrggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctc

SEQ ID NO: 150528 - DNA, 601 bp, Human
tatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgt

SEQ ID NO: 150529 - DNA, 601 bp, Human
ctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcrccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaaca

SEQ ID NO: 150530 - DNA, 601 bp, Human
agaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatmtaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaa

SEQ ID NO: 150531 - DNA, 601 bp, Human
ttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagycatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagt

SEQ ID NO: 150532 - DNA, 601 bp, Human
catacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtrgtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggt

SEQ ID NO: 150533 - DNA, 601 bp, Human
acataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatscttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtctttagg

SEQ ID NO: 150534 - DNA, 601 bp, Human
tgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggctccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatataattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattcca

SEQ ID NO: 150535 - DNA, 601 bp, Human
gacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatataattttttaaaaaacactatgttgagaaaacataaaacatctttgtgccgtacatgactcttgagccactcatttttaaacactgccttaaattctcaaagctgtgccctaaatagaggactagacagtaagactcaagcygtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagt

SEQ ID NO: 150536 - DNA, 601 bp, Human
ctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttktttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagaga

SEQ ID NO: 150537 - DNA, 601 bp, Human
attctcctttctgcacctgaccattgcaagtcctttctgctcttttcagccagtgatcgtacctttcactttatagagagaacagccattagacagggctctctgttccagttatctaacatctactcccacccttcccatctttcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttmctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggc

SEQ ID NO: 150538 - DNA, 601 bp, Human
aacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggttttttttttkgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgctta

SEQ ID NO: 150539 - DNA, 601 bp, Human
attgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgyatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttat

SEQ ID NO: 150540 - DNA, 601 bp, Human
cttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatktctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaa

SEQ ID NO: 150541 - DNA, 601 bp, Human
aacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttrtggcagcagaaaatggactaaaaacaggcattgacggctttaggatttgtttctttgacggtttatccttacccctttcctgctactggttggttaatgaggcactgagctaggaaccctgtaagtgttcaaatgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgag

SEQ ID NO: 150542 - DNA, 601 bp, Human
ctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagsagaaaatggactaaaaacaggcattgacggctttaggatttgtttctttgacggtttatccttacccctttcctgctactggttggttaatgaggcactgagctaggaaccctgtaagtgttcaaatgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatat

SEQ ID NO: 150543 - DNA, 601 bp, Human
ataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaartgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgag

SEQ ID NO: 150544 - DNA, 601 bp, Human
gaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaayggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttgga

SEQ ID NO: 150545 - DNA, 601 bp, Human
tcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaaytttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaataaaaccaaattattcatatatttttatattaaaccctctcagataattctgttaatatgatgagaactggaaatatagacctcttaaacatttttgttttttcttgata

SEQ ID NO: 150546 - DNA, 601 bp, Human
atttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacataygagttagatgtgtgctgtttattttcttttattgcttacaactaaacttggtagtttatggagtattttctaagactgttatttataaaatgtaataaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagt

SEQ ID NO: 150547 - DNA, 601 bp, Human
gctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatrggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcc

SEQ ID NO: 150548 - DNA, 601 bp, Human
ttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacaccyttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaa

SEQ ID NO: 150549 - DNA, 601 bp, Human
ggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcwtggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagca

SEQ ID NO: 150550 - DNA, 601 bp, Human
tgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctraattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcactta

SEQ ID NO: 150551 - DNA, 601 bp, Human
cttgaaaggaaacaaacctccaatctcctgcctctgtcactgaaagggccatgactcagagaaggcagctgggctgatttaggtacacaggcaggtctgcctcaccaggcagctcagctgacccagctttcctccaaaacctcataaataatgctgtagaccagactcaagtgattcagttccaaccctacaaattagcatgtgtgtggggtccaaaaagataagaaaaatgtggtaggagccctgaacctacttagatagattagcttctacatttcttttaccctaccctgcttggagytggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagactgggactcaatgacataatgatccctccttgtagtgagcctgtgtgctctctcttaactctgttggaacaggaaaaagtggttgaggacta

SEQ ID NO: 150552 - DNA, 601 bp, Human
aaacctcataaataatgctgtagaccagactcaagtgattcagttccaaccctacaaattagcatgtgtgtggggtccaaaaagataagaaaaatgtggtaggagccctgaacctacttagatagattagcttctacatttcttttaccctaccctgcttggagctggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagactgggactcaatgacataatgatccctccttgtagtgagcctgtgtgctctctcttaactctgttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcag

SEQ ID NO: 150553 - DNA, 601 bp, Human
ggtccaaaaagataagaaaaatgtggtaggagccctgaacctacttagatagattagcttctacatttcttttaccctaccctgcttggagctggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagastgggactcaatgacataatgatccctccttgtagtgagcctgtgtgctctctcttaactctgttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcagaatatgttgctcatgaccattactggtttcctgttcccttccaagcgtagtctgtatgttcaagcatgtatat

SEQ ID NO: 150554 - DNA, 601 bp, Human
gttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcagaatatgttgctcatgaccattactggtttcctgttcccttccaagcgtagtctgtatgttcaagcatgtatatatgtatatttaattcacccttttttctgtaaaagagaacttatatatgtatatttaataacrtatatgtatatttaatccacccttttttcctcaaaagagaacttcaacatactgttttattccttctcatactaattttcacagaatatgtagttgtgctgctaatcttcaaagttgatctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttga

SEQ ID NO: 150555 - DNA, 601 bp, Human
gcagcctgctgttaacagacctcgccaccctctgcaaagtagggtaatgaaccttgtgccaccattgactttcatgtctgcataatcactcattatttacagcaaacaaagaagaggcaaagaaaattggactttctcagcaatattaatactttccttaaaaattgaggggaaaaattatgcatacaccgtaacctttggcctgtgagctgctttggttagccagcagtcagacacgccttgcacaaatttcagatatctgaatgtacctttgaaacctaagatgtcacaggcaagcaastgacatgttggtgggggtgggggaaggggcagttatgttggcacagtagtggttaaccagaatgcgctgcccatttcccttcttttagctgtttcataggattagtgttgaatgcctggttgttggatgcctagacgaattttcaaacatgaaaaactaaatgccaaaacagcagcattttggataaactatacatcatgcctagtaaacttcaataaacgtatgcccactagtttgcctgcaattaggtgtcaattatggtgctatttctattacaaaccctgtatttctaagattaaa

SEQ ID NO: 150556 - DNA, 601 bp, Human
tctgaactttgagcctgtgaaaaaagaagggatgctgcctcaggccaccccagcctagatactcactctgagtgccatgaggtagtagaggacactgatgacagtcatggggaggaggtagaataggaaggaggtgacctggatgatgaaattgtagatccacatgggcttgatgaccgtacaggtggccgaacctgggaccagggacccattggggaagtagtggaacttgatgccatggatgctggtgttgggcagggagaagagcacggagaagccccagacgatgccgaggatcctragggcccggcgccgggtgctctgcagtttggcgcggaacgggtgtaggatggccacgtagcgctccacgctgacggtggtgatgctgaggatggaggcgaagcacacggtctcaaagagggccgtcttgaagtagcagcccacgggcccgaacaagaaagggtagttgcgccacatctcatagacctccaggggcattccaaggagcaggaccaggaggtcagagaccgccaggctgaagaggtagtagttggtgggcgtcttcatagcctggtgctgcagaatcaccaggcacaccagg

SEQ ID NO: 150557 - DNA, 601 bp, Human
gacacagaatagggcctacttttcctgagtttcagtatagagatttttaaattcttctagaagtgactttgtaagcgttagtttctttcctggtgtcctctggtaccctggataacagctcatccttcctgaaaacaggctgtcaaaagttgcattacatacacaaagcaaaccagggtggtttttaaacttttgtctgagctgtcacttacctcctgatacaaggtagccatggacttttgataataaaacacaatgaaactgattgtaacagattggaagaggaactgtgcatttcctwctcaaagttaaatatttttcccaaattgacccaaaataggtgactgtttggcattggatgaggtaatattaagtgggtgggtatttctcataagactttctttggagttgtatagaagtcttttccccgcagtgagatgtgcaggacgttcttaagacatggctgtgagctagtgcggggtgggacatgtctctgggaatacaggtgctagccctccaggaggggactggcacagctctctgcctaattagatttactcttgtgcccagatgtccgtgacacttagaatttgttcttcct

SEQ ID NO: 150558 - DNA, 601 bp, Human
agtaatagtgcaaccacttttcgtatacagttatgtggaaacttggctgtgtagcatgttaataggtgttccatgaaaaatgtaaaattctgaagttcaagaaaagttagaaaggcttctcaattcattcattcactcattcataattattagaaatctgttaaagtgaaatccttctgctctgtggtggataattagtagaaaaccaaaacaggaattcttcttgcctcatcagtatttattgtggatcttctcagagacttaaatatgctgatgggcattatgaattttcaagggggayagtgtatcaactttccacttagctcccctctaccttccacactcacatcacctactcatatcttagccaaaagggagatagtgtttatttgagtaaacaatattttcccccaacccttttcagtggattaccttgtaccatcttgacaaacacaaattgggaaatgttgttttaatattacagtaatattaattactgaaaagtcttatgtgtttctgagttaagatgtttaaagtatattcatccttgttggacgatatggagatccttgatgtaacatttgaaactttcagctatcaa

SEQ ID NO: 150559 - DNA, 601 bp, Human
aaaatgtattataaatctcctttccctcatcagtaactcctctcatatagtagtgctgtatcatatatttttataacattcttttgggagactgtggctcagtaagtgaatttttaaaaagatcttatttattcaaaagtatactgtttgaaacaaagttatacaatgtcatatgtgaaatggctacttggagatgcttgccagatgttcttaacctggaactaaaagatcccatggagtctatgagtatcaggggttggttcgtgacctcctgagatggattgtaaaatcttttgtgtaygcatatttgttcatttttttttttttttggaatggagagtctacagctttcatcatattttaaaagaaatccataatacaaataggttaaaaacctgcttatttcacagagggggaaagtgaagctcaaaggctgagaaagtgaatgtaatttaccaagcaccacacagagtgtatgtcagtggatgaaactgagagtgttgttttgagggttcaaaaccaaaaatgaaacaaaacacacaggtcctagaagcttgaagaagcaaaggaagacaggtcacctagcgttgacatagaccat

SEQ ID NO: 150560 - DNA, 601 bp, Human
tccaggaataagctatacattaggcctgctgagtacaaaaaagagggtgacagaaaatacatagtatacacaatattcagtatagatgtcattgtttctgctttgtacacatctggagcttaacttgtaaaaggtgatcttatctttcctttccggtgatgtcttctataatctaatgagcccatagaatcagccggtgaccaggagaggtggggggacagaagaggtctgagcctaaggctaacactgagttagctgtcactgactgagaaagaagaaactaggtggtcattctttgctycattttagtagaaagaacactgaacttgaagttagatgacttgggtgggttatttgttagctaagtgccttagggcaaatcatttcttcttgtggaagggttttatttttgactatacaatgttaatcataatatccacctaatgaccttgtgatgattatagaaagatatacagcaattacagcttaaagagctctttaatgtctattattgcatttgctccttaccatcagtccatggtttgtgtacaggaggctttttttttttttttttttgccattttacagttgaggaaacttt

SEQ ID NO: 150561 - DNA, 601 bp, Human
ggggagatggtatctgaacaggatcatgtcattattgaggctataacttgaaaatcttaagataattgccttgacgcatccagagaattgtagtcaattagtcaagtctcatttgaccttgtagtgctttctcatttatttaaacatttctgttttccgcagattaaccaaaaggataaactaagaggtatacatatttttgagctttggttgcaaatggttgaacaggaaagtgctaatgtccaggaataagctatacattaggcctgctgagtacaaaaaagagggtgacagaaaatayatagtatacacaatattcagtatagatgtcattgtttctgctttgtacacatctggagcttaacttgtaaaaggtgatcttatctttcctttccggtgatgtcttctataatctaatgagcccatagaatcagccggtgaccaggagaggtggggggacagaagaggtctgagcctaaggctaacactgagttagctgtcactgactgagaaagaagaaactaggtggtcattctttgctccattttagtagaaagaacactgaacttgaagttagatgacttgggtgggttatttgtta

SEQ ID NO: 150562 - DNA, 601 bp, Human
ggagaatatttctatgcattaatactattagttcattcaaaaaataaatattgatttaactcttattatgtgccatgaacttcaaagcacattgggaggtagtgaattagactttgttctccaagatcttggaatggtactgcagagacaagatttatggctaagttaaataattaacaatacaacaataccaagcagtatctgttaagaacaaatatgagataacaaatcatgctatagcaattcacataataacagaaacacaaggactgtgataatcataaaagatttagtggggggygattgaactctagccaggcctcaaaatgggtaagagatagttgaggaagacaggagagggtgttgcaggtacagggtatatagcacgcataagtattcaggggcaggaatggccatattgtgcaggaataatgtgcagaactctctaattaccaatttgataagtatatggtctatgaataaaaataataaaagttggaggattaaaaggcaagttgggggtattttctgtagggtttaagagatttagatttaatctagtggctaatataaaaggggggagatggtatctgaacaggat

SEQ ID NO: 150563 - DNA, 601 bp, Human
gaggagagtcagctctgaaagaattcaggttttgttaaagtggaagctttgatagtttgttcttgacatctgttcactagagagggctgttgggaggtgagagttgtgcatggatgactgacatgggaattggggacctatatcttcggtcagctccacaaagtggcattctgtcaggaagatgttccgctgggcaggtggcaactgtgggtcatgctgggagtgccactgtttgtggaaagaagagatcacattctggaatgctgcctggaagcggcgagacagtaggttatagataatkgggttgacagctgagctcaggtagaagaagacacctggaatgcaggggatttaaaaagatgtgctgagaagaacttaagtgaccggcatgaaggaagaagcataaatatttacaaaggcctagaatccctgtgattgcctcttttataagtgataatacatacaagcatctaattgagaatacaaaatgctctgaatagatcttccacctgtgcacttagccatcaaacacaaagattaaagagtcttggagtaagttaggctgacatgggatctctctgagatgttcagcaactttctt

SEQ ID NO: 150564 - DNA, 601 bp, Human
gtgtgtgcatatccacacgcctgcaagcagggctggtttgtgcacagcgcaagcattggacacagccatgccctcctggagctccctgctgcctgcggagacaggcagacaatgcacgatgacatgtgtgatgggtgtggggagaggagcaggtgtgacttgaacctcttcagcccaggggcccaggaagggaaatgacaccctggaggaagcctgcagggaggcctggcttctgccagctggaggggtgggcaggcactaggcgtgggtgaaggctctgcagggaagagcctcattccarcagctgcactcggggtggctggagagggggcgtgtagggcagcgaggctggagtggtcagcggggtctggggtctcaaagaacatcatctgaaatgtgacaggaagtctctggaggcttttagatgtgtgtcttctggaggtttctggctgctgagtggggcaagactgtggggacaggagaggacatgggtaggtggggagtaggctggggccatcgtgcaggtgggaggggaagtggcctggaccacggaggggtggtggggtacagccccgcccagatctcagagccccccaccctt

SEQ ID NO: 150565 - DNA, 601 bp, Human
tggctgctgagtggggcaagactgtggggacaggagaggacatgggtaggtggggagtaggctggggccatcgtgcaggtgggaggggaagtggcctggaccacggaggggtggtggggtacagccccgcccagatctcagagccccccacccttcctgtccttgggcccatggggagacttggccaagccagtttctatccaggaggtctaactggccaccccacagctttgggcagacccgcaagcccatctcagtacccacactactgcggaagggcctgctttgccactcacagccygtttgagccccagctccagcagccatgggggatccctcaccttcccacagttcagtgggaacaacgacccctcactgcaggaccattcgggtcagttgaactgacttgtgcatattgctcccagcaggcatgggctctgtgccctttcctgtgttcttggagacacttggggccttgccagtacagtgtggccaacgggccagaatatccgctgggagccctttggaaatgcagaatcccaggctccacccagccctgccccgtcagaatctgcattgtaggaagatttgttcctggtgg

SEQ ID NO: 150566 - DNA, 601 bp, Human
cgtttgagccccagctccagcagccatgggggatccctcaccttcccacagttcagtgggaacaacgacccctcactgcaggaccattcgggtcagttgaactgacttgtgcatattgctcccagcaggcatgggctctgtgccctttcctgtgttcttggagacacttggggccttgccagtacagtgtggccaacgggccagaatatccgctgggagccctttggaaatgcagaatcccaggctccacccagccctgccccgtcagaatctgcattgtaggaagatttgttcctggtgrccggtgtgcacattcccatgtgggccgtgctggcccagggctccctgtggtgtgcctctgtgtagatttcacctggctctggaaggccctgagaatagctctgaagatgatcttaggtggcttttttttttttttgagacagagtctcgctctgtcgcccaggctggagtgcagtggcgcgatctgggctcactgcaagctccgcctcccgggttcgcgctattctcctgcctcagcctcccgagtagctgggactacaggcgcccgccaccacgcccagctaatttttttgtatttttt

SEQ ID NO: 150567 - DNA, 601 bp, Human
ctgaatgctccttaactgtggccgccatgcagtggttgccacatccaagaagaacgcgtgcgtgtcgctggtcttttctttcctctataaggtggtgcaggtgagtctcgctcggaggggccgtgggcttgggtggaggttgtcttggctctgcttgtggacctccccatacctggccaccctacagagagctgtggcatccccagggagcactggggctggaagcccaggaagtgggaaaggggagtcccaactccccacgcctgtggaattctatagctcacgttgctcccctaccgtggggaagaaaggaaagtgaacaggaaaaggtagggctcagagcaggggtgccctgaccctggaagggacaagcaggggtcagcgagctttggaaggatgtggggtgaccagctggatggggctggaataaccagcagagctgcagagctgagcccacctcagaatctcccagggggctctcaaggcacagatgcctgacgcccaccttggagagagctgacacgccaggcccaggctgccagtgagacacagatagcagccagggtgaaggcgccaggacaggtgtatgtgtggtgcagct

SEQ ID NO: 150568 - DNA, 601 bp, Human
ccctggaagggacaagcaggggtcagcgagctttggaaggatgtggggtgaccagctggatggggctggaataaccagcagagctgcagagctgagcccacctcagaatctcccagggggctctcaaggcacagatgcctgacgcccaccttggagagagctgacacgccaggcccaggctgccagtgagacacagatagcagccagggtgaaggcgccaggacaggtgtatgtgtggtgcagctagggaggccagcgtgcgtgtggcagagtatgaggctgaggtcagctgggaagaggrcggattatacaggagtgtggatttcattccacttctgatgaaaggtagtggagggctttaagcaggagactgacaagacgtggtttgatctaaagcagcctctctggctgctgagcagaaggaggacttgaggccagtgaggaggctgctgctggcttcccggagaggatgggcctggccgaggtgggctgtggggctcacgaaagtggggaacaggacccaggaggcctgtgctgggcctgggaaagctttcatccctcactgatgctgcctgtgcagaatgttggggaacaggggcaa

SEQ ID NO: 150569 - DNA, 601 bp, Human
cacctcagaatctcccagggggctctcaaggcacagatgcctgacgcccaccttggagagagctgacacgccaggcccaggctgccagtgagacacagatagcagccagggtgaaggcgccaggacaggtgtatgtgtggtgcagctagggaggccagcgtgcgtgtggcagagtatgaggctgaggtcagctgggaagagggcggattatacaggagtgtggatttcattccacttctgatgaaaggtagtggagggctttaagcaggagactgacaagacgtggtttgatctaaagcarcctctctggctgctgagcagaaggaggacttgaggccagtgaggaggctgctgctggcttcccggagaggatgggcctggccgaggtgggctgtggggctcacgaaagtggggaacaggacccaggaggcctgtgctgggcctgggaaagctttcatccctcactgatgctgcctgtgcagaatgttggggaacaggggcaagcctgggcggtgagggcttggggaaggagccgagggtcacctgggaaggccccacgtgcaggccaagggctgccttcactggaccggtgatgctgtca

SEQ ID NO: 150570 - DNA, 601 bp, Human
agtggggaacaggacccaggaggcctgtgctgggcctgggaaagctttcatccctcactgatgctgcctgtgcagaatgttggggaacaggggcaagcctgggcggtgagggcttggggaaggagccgagggtcacctgggaaggccccacgtgcaggccaagggctgccttcactggaccggtgatgctgtcacaggcagggctgggcctggctgtgctgcctgtggtttccaagcagaggccgggtgatcacagtcctgaagcgcgcaggggtcagcagatcagagaatgggggatgcrggaaggggaaggtcctcacccaagggttgggctgtgcctttctgttttagtaacgctccttccttcagcatttgtgcctgcaaaagtgcttctaacagcccctcttctttggcgtcccttccttaaccttctgagctttccattgaaatggggaagatgcatcaagctttccactgaaatggggaagatggcagctcatcaggtccttgcctgagtcactccagactcagaaagggatgacagttacagtcgctcaggaggggctgcctgtctgcgggtgtctgggcagggaagagaatg

SEQ ID NO: 150571 - DNA, 601 bp, Human
aatgtgagtttgtcttatcttttttttttgagacggaatctcattctgtcgcccaggctagagtgtggtgacacgatctcggctcactgcaacctccgcctcccaggttcaggcgattctcctgcctcagcctcccgtgtagccgggattataggcacccgccaccacgctcggctaaagcttgttttctttattagcatttatgctgactgagaatccatacatgcacattatttttaaaaattagaagcagggtatgaggttagaaagtgaagggctcttatcagtcaccatgcacagaaaaaaaaaaaagaaactaaagggctcctataatcagaaagattaggatttattcaccgtcaccctctcgggcctcattctgtagacagacagaaacaagtatattgatttttctataaacctgagatcataagatgtggttctcctgcagcttgtttttttggtggtggttgttgtttgggttttgattttgcgttcagtgttactgttttgtatatttttttcttttggttttttaattatgaggaaagttgacgttttgaaaatgaattttagcgcttgtacagatttgtgtacccat

SEQ ID NO: 150572 - DNA, 601 bp, Human
ggctcctataatcagaaagattaggatttattcaccgtcaccctctcgggcctcattctgtagacagacagaaacaagtatattgatttttctataaacctgagatcataagatgtggttctcctgcagcttgtttttttggtggtggttgttgtttgggttttgattttgcgttcagtgttactgttttgtatatttttttcttttggttttttaattatgaggaaagttgacgttttgaaaatgaattttagcgcttgtacagatttgtgtacccatcaccacacccaggacacagaayctcaaaacctcctcatgttgcccctttgtagctccatgctcccctcttccccatttcctggccaccattgaactgttctccatcactggagtcttcatcgtgttgtgattgtcacacgagtggcatcatatgtcaccgcagctgtctttctgagattgtcgtatgaatggcgtcatacagtcatgagctctcgagtctggctgctttaactcattctaattctttgcgattcatccaaatccaattgttttgcatatcaaaagtctgttcccttttatatttatttatatttattttctg

SEQ ID NO: 150573 - DNA, 601 bp, Human
tcaccctctcgggcctcattctgtagacagacagaaacaagtatattgatttttctataaacctgagatcataagatgtggttctcctgcagcttgtttttttggtggtggttgttgtttgggttttgattttgcgttcagtgttactgttttgtatatttttttcttttggttttttaattatgaggaaagttgacgttttgaaaatgaattttagcgcttgtacagatttgtgtacccatcaccacacccaggacacagaacctcaaaacctcctcatgttgcccctttgtagctccaygctcccctcttccccatttcctggccaccattgaactgttctccatcactggagtcttcatcgtgttgtgattgtcacacgagtggcatcatatgtcaccgcagctgtctttctgagattgtcgtatgaatggcgtcatacagtcatgagctctcgagtctggctgctttaactcattctaattctttgcgattcatccaaatccaattgttttgcatatcaaaagtctgttcccttttatatttatttatatttattttctgttctgaaccacagaaggacatttgggtggttttccaa

SEQ ID NO: 150574 - DNA, 601 bp, Human
acagaacctcaaaacctcctcatgttgcccctttgtagctccatgctcccctcttccccatttcctggccaccattgaactgttctccatcactggagtcttcatcgtgttgtgattgtcacacgagtggcatcatatgtcaccgcagctgtctttctgagattgtcgtatgaatggcgtcatacagtcatgagctctcgagtctggctgctttaactcattctaattctttgcgattcatccaaatccaattgttttgcatatcaaaagtctgttcccttttatatttatttatatttaytttctgttctgaaccacagaaggacatttgggtggttttccaatctttggcaattgtcaatagagttgctagaaacatgtcgtgtccaggtttatgtgtggacataagttttcatctctctagggtaaatacccaggagtgggatggctgggtcacacggtaagtgtatgtttacctttataagaaactgccaaaccattgctgttttgcattctcgccagcaacagatgagggttgtgatgaccccacatcctttgtcagtagttttatttttgtcatcctaataggtatgtagtagta

SEQ ID NO: 150575 - DNA, 601 bp, Human
atccatttcttctagattttctagttagtgtgcatagaagtgttaataatagtctctaagggttatttgtagttctgtggggtcaatggtaatatcccctttgtcatttctaattgtgtttatttgggttttctctcttttcttaatagtctagctagcagcctatctatcttattcattcttttaaaacaccagctcctggcttacttgatgttttgaatggtgtttttgtgtctcagtcttctagagttcagctgtgactttggttatttcttgtcttctgctagctttggagttggargcttttgcttcgtgagttcttttagttgtgatgttaggttgttaatttgagatctttctaactttttgatgtgggcatgtagtgctgtaaatttctcttaacactgccttagccgtgtcccagagattctggtctgttgtatctttgttcttatttgtttcaaataatttcttgacttctgccttaatttcattatttacccaaaagtaatttgggagcaggttgtttaatttccatgtaattgtatgggtttgagtgattttcttagttttgaattctatttttattgatttgtggtct

SEQ ID NO: 150576 - DNA, 601 bp, Human
gcttttggttcttttgcatctgctgaggattattttatgtccaattgtgtggtggtttttagagtatgtaccatgtacagatgagatatattctctcgtttttgggtggagagttctgtagatatctatcaggtccagttgatccagtgctgagttaaggtcctggatatctttgataattttctgccccagtgatctgtctaatactgtcagtggggtgttgaaatctcccactgttattgtgtgggagtctaagtctctttgtaggtctctaagaacttgctttatgaatctgagtgcygctgttggctgcatatttatttaggttagttagatcttgttgaattgaataccttaccattatgcaatgcacttctttgtctttttttgatctttgttggcttaaagtctgttttgtctgaaattaagactgcaactctgcttttgtctgttttctatttgcttggtagatttttctccatttcttcattttgagtctgtgggtgttattgcatctgagatgggtcttttttttttcttttgagacagagtcttgctgtgttgcccaggctggagtgcagtggcgcaatctcggctcact

SEQ ID NO: 150577 - DNA, 601 bp, Human
aggtccagttgatccagtgctgagttaaggtcctggatatctttgataattttctgccccagtgatctgtctaatactgtcagtggggtgttgaaatctcccactgttattgtgtgggagtctaagtctctttgtaggtctctaagaacttgctttatgaatctgagtgctgctgttggctgcatatttatttaggttagttagatcttgttgaattgaataccttaccattatgcaatgcacttctttgtctttttttgatctttgttggcttaaagtctgttttgtctgaaattaagaytgcaactctgcttttgtctgttttctatttgcttggtagatttttctccatttcttcattttgagtctgtgggtgttattgcatctgagatgggtcttttttttttcttttgagacagagtcttgctgtgttgcccaggctggagtgcagtggcgcaatctcggctcactgcaacctctgtcccccaggttcaagcaattctcctgcctcagcctcccaaatagttgggattacaggcacgcgccaccacgcctggcggttttctatttttagtagagacgaggtttcaccatgttggcc

SEQ ID NO: 150578 - DNA, 601 bp, Human
ctaatttttttttggtatttttagtagagacagagtttcaccatgttagccaggatggtctcgatctcctgacctgacctcgtgatccacctgccttggcctcccaaagtgctgggattacaggcgtgagccactgcacccggcctttttttttttttgagatggagtcttgccctgtcacccaggctggagtgcaatggcatgatctctgctcactgcaacctctgcctccctggctcaagcaattctcctgccttagcctcccgagtagctgggattacaggtacccaccaccatgacyggctaatttttgtatttttagtagatatggagttacaccatgttggccagactggtgtcgaactccacacctcaggtgattcgcctgcctcagcctcccaaagtgctgggattacaggcatgagccaccacacccggccttcttttcatatttagtacttctttcaggagctcttgtacagcaggtctgctggtaaacaaattccctcagcatttgcttgtctgaaaggatcttttttattcttctttttttttgagacagggtctcattctgttgctcaggctggagtgcagtggcatg

SEQ ID NO: 150579 - DNA, 601 bp, Human
acccaggctggagtgcaatggcatgatctctgctcactgcaacctctgcctccctggctcaagcaattctcctgccttagcctcccgagtagctgggattacaggtacccaccaccatgaccggctaatttttgtatttttagtagatatggagttacaccatgttggccagactggtgtcgaactccacacctcaggtgattcgcctgcctcagcctcccaaagtgctgggattacaggcatgagccaccacacccggccttcttttcatatttagtacttctttcaggagctcttgtamagcaggtctgctggtaaacaaattccctcagcatttgcttgtctgaaaggatcttttttattcttctttttttttgagacagggtctcattctgttgctcaggctggagtgcagtggcatgatcatggctcactgcaacctctacctccctggcacaagctattctctggcctcagcctaccaattggctgggactataggcaggtaccaccacacccggctaatgtatatgtttttggtagagatggggttttgccatgtttcccaggctagtctcagactcctggattcaggcactcc

SEQ ID NO: 150580 - DNA, 601 bp, Human
ccaaagtgctgggattacaggcatgagccaccacacccggccttcttttcatatttagtacttctttcaggagctcttgtacagcaggtctgctggtaaacaaattccctcagcatttgcttgtctgaaaggatcttttttattcttctttttttttgagacagggtctcattctgttgctcaggctggagtgcagtggcatgatcatggctcactgcaacctctacctccctggcacaagctattctctggcctcagcctaccaattggctgggactataggcaggtaccaccacaccckgctaatgtatatgtttttggtagagatggggttttgccatgtttcccaggctagtctcagactcctggattcaggcactccacccacctcggcctcctaaagtgctgggattacaggttgagccaccacacccaagttgaaaacgatctcatttctcctttgctgatgaagcttaggttggccagatgtgaaattctggattggaatttctttaaaaatgtttaatatattggccaggagtggtggcttacacctgtaatcccagcactttgggaggctaaggcgggggcgggggggggg

SEQ ID NO: 150581 - DNA, 601 bp, Human
gggtggggttgggggagtaggggggggagtgagtagtgcttgcgcgtgggagacgaccggttgtgtggtgctgtgggcaatcggcggcatgcgcgctgagatcgccgagcagctgttgggacggccgaggtcgaggggatcacctgaggtcaggaattcaagaccagcctggccaacatggtgaaacctggtctctactgaaaatataaaaattagcagcacgtggtggtgcatgcctgtagtcccagctgcttgggaggctgaggcaggagaattgcttgaacctgggaggcggaggttrcagtgacctgctgagatcccaccactgcactccagcctgggccacagaatgagattccatctcaaaaaaaaaaaaaaaaaaaaaaaaaaaaagaatgtttaatataggcctccaatctcttctggcttgtagggtttctgctgagaggcccactgctagtctgatgggcttccctttgtaggtgacctgctatgtctctctagcttctttcattttgaccctggacaatctgatgattatgtgttttggggatgatcttgtgaagtattttgcaggggttctctgcattccctgattttg

SEQ ID NO: 150582 - DNA, 601 bp, Human
tccccatctctttcagggacaccaatgagttgtagatttgctctcttttttaatcccatatttcttggaggctttgttcattccttttcgttattttttctctattctcatctgactgtcttatttcagaaagccagtcttcaagctctgagattctttcctcagcttggtctgtactactgttaatacttgtgattacattattaaattcttatactgtgtttttcagctgtatcaggtcagttacatcattttctatcctggctgttttgtctgccagctcatatattgttttattatrattcttagcctccttagattgggtttcaatgttcctaatctcaatgatctttgttcctatccatattctgaagtctatttctgtcatttcagccatctcagcctagttaagaactcttgctttgggaggccaaggtgggcggatcacaaggtcaggagattgagaccatcctggtgaacacagtgaaaccccatctctactaaaaatacaaaaaattagccgggtgtggtggcgggcgcctgtagtcccagctacttgggaggctgaggcaggagaatggcgtgaacccaggaggcggag

SEQ ID NO: 150583 - DNA, 601 bp, Human
cccatctctactaaaaatacaaaaaattagccgggtgtggtggcgggcgcctgtagtcccagctacttgggaggctgaggcaggagaatggcgtgaacccaggaggcggagcttgcagtgagccgagattgcaccactgccctccagcctgggcgacagagcgaaactccgtctcaaaaaaaaaaaaaagaactcttgctggagaactactgcagtttggaggaaagaggacactctggttatttgagttgtcaagagtccttgtgctcgttctttctcatttttgtgggctgatattccyttagtctttgaagttgctgtcctttgaatgggtttctttttcctttatcctatttgatgaccctgggggtttgattgtgtataaggtgggttcagttggatggcttcattattggaagattttaggggaccaaggctcagcttaggactcctgaactgcatgctctaactctggaggactggtatccagccctggctttgatctctggctccttcaggttaagaacctgctctgctagaggggccaagctgctcccagacagctggtcacaacactccaatgggtggtgccaggcaaagc

SEQ ID NO: 150584 - DNA, 601 bp, Human
attgtgtataaggtgggttcagttggatggcttcattattggaagattttaggggaccaaggctcagcttaggactcctgaactgcatgctctaactctggaggactggtatccagccctggctttgatctctggctccttcaggttaagaacctgctctgctagaggggccaagctgctcccagacagctggtcacaacactccaatgggtggtgccaggcaaagcacttcatagggtagtggcagcaggatctgttcttgtttgcatgtgccagcggcagcacagcggggtgcacgctyatcggctgtgacagagtgctagtggatgtcagggagccagcctctgggagggcatttgtagcagcagcagtagtggcagtatggctggggtgggggcaggggccacgctggcaactgtgcacctgttcattggtgccgatgatggggttagcatgggggcactggtgggtgcaggactgtgtgtgccctttgtgcatgttcacactggcagcagtggctgctcagggctaggggtaggtcctctgttttctctgcctagtttcctgtgggaggcccagcataggtggggcactgggaggg

SEQ ID NO: 150585 - DNA, 601 bp, Human
agggagcagtgcctctgctgccgtgcacatggctgctttagtaaaagttctgtttatcaccaccagctcgcccttgagttctttcctggctgaaaccaagaaccctcccgggctgtctcagttttggggctcgcctgccctgcatcactaccacttctttaagcagcttcccctgccaacgcagctggccgtggcagtcgaggggtccttcctgccgggattccagaggccatggcaagagtgggttgccccttgctagttcaattcaccccctccacaggagtcactgggagccaggaaygattcctggtgcacagtagccctgtgcagggttcccagcctcctcctctgccttccatccagcctctatatcttccctccgttcactctcagggccttcccactgaagatctaggagtctaggagtgcacctgtctgcacagtgtccctgtctcttagtgggagatgtttctcctggctgcgtctagttggccatcttggagcaggagcaaaatctaggcagtctttaaacagcttcaaattagggttctcacaaacccctctttgggtaagcaaggtatagagggaagggacccagagc

SEQ ID NO: 150586 - DNA, 601 bp, Human
cccttgagttctttcctggctgaaaccaagaaccctcccgggctgtctcagttttggggctcgcctgccctgcatcactaccacttctttaagcagcttcccctgccaacgcagctggccgtggcagtcgaggggtccttcctgccgggattccagaggccatggcaagagtgggttgccccttgctagttcaattcaccccctccacaggagtcactgggagccaggaacgattcctggtgcacagtagccctgtgcagggttcccagcctcctcctctgccttccatccagcctctatrtcttccctccgttcactctcagggccttcccactgaagatctaggagtctaggagtgcacctgtctgcacagtgtccctgtctcttagtgggagatgtttctcctggctgcgtctagttggccatcttggagcaggagcaaaatctaggcagtctttaaacagcttcaaattagggttctcacaaacccctctttgggtaagcaaggtatagagggaagggacccagagcttccttgccctctctggacacaccaccctccaggaacctccacgtgttcagctctctggaagcttctttt

SEQ ID NO: 150587 - DNA, 601 bp, Human
gcagctggccgtggcagtcgaggggtccttcctgccgggattccagaggccatggcaagagtgggttgccccttgctagttcaattcaccccctccacaggagtcactgggagccaggaacgattcctggtgcacagtagccctgtgcagggttcccagcctcctcctctgccttccatccagcctctatatcttccctccgttcactctcagggccttcccactgaagatctaggagtctaggagtgcacctgtctgcacagtgtccctgtctcttagtgggagatgtttctcctggctgcgtctagttggccatcttggagcaggagcaaaatctaggcagtctttaaacagcttcaaattagggttctcacaaacccctctttgggtaagcaaggtatagagggaagggacccagagcttccttgccctctctggacacaccaccctccaggaacctccacgtgttcagctctctggaagcttcttttatctcttttgctttacgtcttccctcactgagacttccagcacagtgttgaatatgagtggtgagagctgacattcttgctttgttcctgatcttagagggagaccatta

SEQ ID NO: 150588 - DNA, 601 bp, Human
tccacgtgttcagctctctggaagcttcttttatctcttttgctttacgtcttccctcactgagacttccagcacagtgttgaatatgagtggtgagagctgacattcttgctttgttcctgatcttagagggagaccattaagtcttttgccaccaactaggatgttagctgtaggtttattataggtgttctttttcaccttgaggaagttcccttttattgctagtttgctaacagtttttttttttttttaatcatgcgtgggtgttgtattttcttcagttctttttctgcatcarttgatgtaatcacatgagttttcttcttttggttgttaatatggtgtattccactgactgctttctgattattgaaccagtgttgcattcctggaataaaatcccattggtcatagtgtattataggttgagtatcccttatacaaatgcttgggagcagaagtgttttggatttcagatttctttggattttggaatatttgcatatgcatcatgagatatcttagggctgggacccaggtccaaacgtgaaattcatttttgtttttttgttttttttttttttttgagatggaattt

SEQ ID NO: 150589 - DNA, 601 bp, Human
tcttgctttgttcctgatcttagagggagaccattaagtcttttgccaccaactaggatgttagctgtaggtttattataggtgttctttttcaccttgaggaagttcccttttattgctagtttgctaacagtttttttttttttttaatcatgcgtgggtgttgtattttcttcagttctttttctgcatcaattgatgtaatcacatgagttttcttcttttggttgttaatatggtgtattccactgactgctttctgattattgaaccagtgttgcattcctggaataaaatcccrttggtcatagtgtattataggttgagtatcccttatacaaatgcttgggagcagaagtgttttggatttcagatttctttggattttggaatatttgcatatgcatcatgagatatcttagggctgggacccaggtccaaacgtgaaattcatttttgtttttttgttttttttttttttttgagatggaatttcgctcttgttgcccaggctggagtgcaatggcacaatctcagctcactgcaacctctccctcctgggttcaagcgattctcctgcctcagtctcccaagtagctgg

SEQ ID NO: 150590 - DNA, 601 bp, Human
tattttcttcagttctttttctgcatcaattgatgtaatcacatgagttttcttcttttggttgttaatatggtgtattccactgactgctttctgattattgaaccagtgttgcattcctggaataaaatcccattggtcatagtgtattataggttgagtatcccttatacaaatgcttgggagcagaagtgttttggatttcagatttctttggattttggaatatttgcatatgcatcatgagatatcttagggctgggacccaggtccaaacgtgaaattcatttttgtttttttgttttttttttttttttgagatggaatttcgctcttgttgcccaggctggagtgcaatggcacaatctcagctcactgcaacctctccctcctgggttcaagcgattctcctgcctcagtctcccaagtagctgggattacaggcacctgccaccatgcccggctaatttttgtatttttagtagaaacggggtttcaccatgttggccaggctggtctcgaactcctgacctcaggtgatccacctgcctcagccttccaaagtgctgggggaattcaggtgtgagccactgcacctggc

SEQ ID NO: 150591 - DNA, 601 bp, Human
tttcttcagttctttttctgcatcaattgatgtaatcacatgagttttcttcttttggttgttaatatggtgtattccactgactgctttctgattattgaaccagtgttgcattcctggaataaaatcccattggtcatagtgtattataggttgagtatcccttatacaaatgcttgggagcagaagtgttttggatttcagatttctttggattttggaatatttgcatatgcatcatgagatatcttagggctgggacccaggtccaaacgtgaaattcatttttgtttttttgttktttttttttttttgagatggaatttcgctcttgttgcccaggctggagtgcaatggcacaatctcagctcactgcaacctctccctcctgggttcaagcgattctcctgcctcagtctcccaagtagctgggattacaggcacctgccaccatgcccggctaatttttgtatttttagtagaaacggggtttcaccatgttggccaggctggtctcgaactcctgacctcaggtgatccacctgcctcagccttccaaagtgctgggggaattcaggtgtgagccactgcacctggcttc

SEQ ID NO: 150592 - DNA, 601 bp, Human
gttgcccaggctggagtgcaatggcacaatctcagctcactgcaacctctccctcctgggttcaagcgattctcctgcctcagtctcccaagtagctgggattacaggcacctgccaccatgcccggctaatttttgtatttttagtagaaacggggtttcaccatgttggccaggctggtctcgaactcctgacctcaggtgatccacctgcctcagccttccaaagtgctgggggaattcaggtgtgagccactgcacctggcttcatttatgttttatatacaccttatgcacgtagyctgaaggtaattttacttttcccttggagatgctgaataaactgcattgtgcacctgcattttgactgcaacctgtcacatgaagttgggtatggaatcttctacttttgacatcatgtcagggctcaaaaagttttggattttggagcattttggatttgggatttttgaattaggaatgcttaacctgtattctttttatgtattgctggatttcctttgctggtattttgttggagatttttggatctacactcataagagatactggtttgtaattttctcttttttgtaatgttt

SEQ ID NO: 150593 - DNA, 601 bp, Human
tatgttttatatacaccttatgcacgtagtctgaaggtaattttacttttcccttggagatgctgaataaactgcattgtgcacctgcattttgactgcaacctgtcacatgaagttgggtatggaatcttctacttttgacatcatgtcagggctcaaaaagttttggattttggagcattttggatttgggatttttgaattaggaatgcttaacctgtattctttttatgtattgctggatttcctttgctggtattttgttggagatttttggatctacactcataagagatactgrtttgtaattttctcttttttgtaatgtttttgtctggttttggtatcaaggtaatggaggaagtgttttttcctcttccgttttctggaagacattttatagaatccatgttaattctttaaacatttgttagaattcaccactgaaactatccgagcctggagatttattttacaaaatgcttttaactattaatttcaaaaaaaagtgttttcttgagtcagggcttcgatctgttgcccaggctggagggcagtagcgtgaacacagctcactacactttgactccagtgatcatct

SEQ ID NO: 150594 - DNA, 601 bp, Human
gaaggtaattttacttttcccttggagatgctgaataaactgcattgtgcacctgcattttgactgcaacctgtcacatgaagttgggtatggaatcttctacttttgacatcatgtcagggctcaaaaagttttggattttggagcattttggatttgggatttttgaattaggaatgcttaacctgtattctttttatgtattgctggatttcctttgctggtattttgttggagatttttggatctacactcataagagatactggtttgtaattttctcttttttgtaatgtttttrtctggttttggtatcaaggtaatggaggaagtgttttttcctcttccgttttctggaagacattttatagaatccatgttaattctttaaacatttgttagaattcaccactgaaactatccgagcctggagatttattttacaaaatgcttttaactattaatttcaaaaaaaagtgttttcttgagtcagggcttcgatctgttgcccaggctggagggcagtagcgtgaacacagctcactacactttgactccagtgatcatcttgctcaagtgatcatcccgcctcagcctccca

SEQ ID NO: 150595 - DNA, 601 bp, Human
ttgcccaggctggagggcagtagcgtgaacacagctcactacactttgactccagtgatcatcttgctcaagtgatcatcccgcctcagcctcccaagtagctgggactgcagccgtgtgccaccatgcccggcttttggggtttttttgttttttgtgttttttttgagacagagtcttgctctgtcacccaggctggagtgcagtggcgcgattacagctcaccgcaacctctgcctcccaggttcaagcgattctccagcctcagcctcccatgtagttgagattacaggcatgtacyaccacacctgggtaatttttgtatttttggtagagacaggatttcaccttgttggctgggctggtcacaaattcctgacctcaagtgatctgctcaccccggcctcccaaaatgctgggattacaggcatgagccactgcgcccagccctaaaaaggtttttttaaaagccattcttgtagaggaggtctactggctacacattcccttggctttcctttaagaatgtctctatattttacctttatccctaaaggctattttcactggatatggacttctgaattgacggtttttgttt

SEQ ID NO: 150596 - DNA, 601 bp, Human
tcccaagtagctgggactgcagccgtgtgccaccatgcccggcttttggggtttttttgttttttgtgttttttttgagacagagtcttgctctgtcacccaggctggagtgcagtggcgcgattacagctcaccgcaacctctgcctcccaggttcaagcgattctccagcctcagcctcccatgtagttgagattacaggcatgtaccaccacacctgggtaatttttgtatttttggtagagacaggatttcaccttgttggctgggctggtcacaaattcctgacctcaagtgatcygctcaccccggcctcccaaaatgctgggattacaggcatgagccactgcgcccagccctaaaaaggtttttttaaaagccattcttgtagaggaggtctactggctacacattcccttggctttcctttaagaatgtctctatattttacctttatccctaaaggctattttcactggatatggacttctgaattgacggtttttgtttagcactttaatatgttataccacttccttctggcatccatcatttctggtgagaaatccacagtcccccaaatctttattcccctataggt

SEQ ID NO: 150597 - DNA, 601 bp, Human
gttcaagctgttataagtaaaatgtttattcagaaacagaatgcttgttcctcggtaccacaaggaaaaatcagcattcaaacaaaaagttttctcagcaaggcaaatttactttctgcagaaagggtgctcctcgcagatggaacaatggcgagagcacacccgaacaaaggaggaaagccgtttttatcccttatgcagcttgtccctgctgctgtgtcctatctccattggctggagccagacctcacaatctaagctaaacctgactggctaataacttaaaactttcctaaatagrtaaaggcaagggagaacaaaggaaaaagaggaagttgactcattcccttatatctaacatcccttacatctaaaaacaaatatcttggttaaagtacaaggacacagaatgtactcattcccttatatctaacatcctttatgtctaaaacaaatatttcggttaaagtacaaggacatagaatgtacattatttctaacacttatgatttattctttagtgagaagggaaactttgaagaggaacttttttactttctacaaagcaattctcctgtctcagcctcccgagtagctggga

SEQ ID NO: 150598 - DNA, 601 bp, Human
ctcaagctcccaacctcaggtgatccacctgcctcagcctcccaaagtgctgggattacaggcatgagccaccgcacccagccctcagatatgtttttgtcattttactcttccttcaggactccagtgacatgaaagacctttggttattatatcatgtgtccctgaggctgcttattttattctatcttttcttctctctgttagattggataatttacattgaactgcctttaagttcacaggtcctttggccctttcctgtttatctccattctgttattattattatttattattattattttttttttttttttgagataggttcccactctgtcatccaggctggagagccatggagcaagcatggctcactgtagccccaacctcctgggctcaagcgatccttctgcttcagcctcctgagtagctgggactacaggtgtgcaccaccaagcctggctaatttttaaaaaaaaatttttgtagagatgagggtctctctgtgttgccctggctgatctagaactcctggggcaagtgatcttcccacctcagcctcccaaagtgctgggattacaggcatgagccactgtac

SEQ ID NO: 150599 - DNA, 601 bp, Human
aagctcccaacctcaggtgatccacctgcctcagcctcccaaagtgctgggattacaggcatgagccaccgcacccagccctcagatatgtttttgtcattttactcttccttcaggactccagtgacatgaaagacctttggttattatatcatgtgtccctgaggctgcttattttattctatcttttcttctctctgttagattggataatttacattgaactgcctttaagttcacaggtcctttggccctttcctgtttatctccattctgttattattattatttattattattattttttttttttttttgagataggttcccactctgtcatccaggctggagagccatggagcaagcatggctcactgtagccccaacctcctgggctcaagcgatccttctgcttcagcctcctgagtagctgggactacaggtgtgcaccaccaagcctggctaatttttaaaaaaaaatttttgtagagatgagggtctctctgtgttgccctggctgatctagaactcctggggcaagtgatcttcccacctcagcctcccaaagtgctgggattacaggcatgagccactgtacctg

SEQ ID NO: 150600 - DNA, 601 bp, Human
gctcccaacctcaggtgatccacctgcctcagcctcccaaagtgctgggattacaggcatgagccaccgcacccagccctcagatatgtttttgtcattttactcttccttcaggactccagtgacatgaaagacctttggttattatatcatgtgtccctgaggctgcttattttattctatcttttcttctctctgttagattggataatttacattgaactgcctttaagttcacaggtcctttggccctttcctgtttatctccattctgttattattattatttattattattatattttttttttttttgagataggttcccactctgtcatccaggctggagagccatggagcaagcatggctcactgtagccccaacctcctgggctcaagcgatccttctgcttcagcctcctgagtagctgggactacaggtgtgcaccaccaagcctggctaatttttaaaaaaaaatttttgtagagatgagggtctctctgtgttgccctggctgatctagaactcctggggcaagtgatcttcccacctcagcctcccaaagtgctgggattacaggcatgagccactgtacctggc

SEQ ID NO: 150601 - DNA, 601 bp, Human
agattggataatttacattgaactgcctttaagttcacaggtcctttggccctttcctgtttatctccattctgttattattattatttattattattattttttttttttttttgagataggttcccactctgtcatccaggctggagagccatggagcaagcatggctcactgtagccccaacctcctgggctcaagcgatccttctgcttcagcctcctgagtagctgggactacaggtgtgcaccaccaagcctggctaatttttaaaaaaaaatttttgtagagatgagggtctckctgtgttgccctggctgatctagaactcctggggcaagtgatcttcccacctcagcctcccaaagtgctgggattacaggcatgagccactgtacctggcctccattctgctattaagtccattgagcaagttgtttatttcagttactatatttttaaaaattttccatttgattcttctctttttgtttgtttttgtttttgtttttgttttgagacagggtcttactctgttgcccaggctggagtatagtggtgcagttatagctcactgcagcctcaacctcgtgtgttcaagtg

SEQ ID NO: 150602 - DNA, 601 bp, Human
caagcgatccttctgcttcagcctcctgagtagctgggactacaggtgtgcaccaccaagcctggctaatttttaaaaaaaaatttttgtagagatgagggtctctctgtgttgccctggctgatctagaactcctggggcaagtgatcttcccacctcagcctcccaaagtgctgggattacaggcatgagccactgtacctggcctccattctgctattaagtccattgagcaagttgtttatttcagttactatatttttaaaaattttccatttgattcttctctttttgtttgttgttgtttttgtttttgttttgagacagggtcttactctgttgcccaggctggagtatagtggtgcagttatagctcactgcagcctcaacctcgtgtgttcaagtgatcttcccatctgagtgtgctgagtagctgagaccacaggcacgcaccaccatgcctggctaatttttttttattttttattttgtagagaccaggacttgctgtgttgcccaggctagtctcgaactcctggttgattcttctttatcatctgtttctttgctgagactttctattttaacatttgttgcaagc

SEQ ID NO: 150603 - DNA, 601 bp, Human
aagcatttgcaattttaaaaatagctgtttaaagtcttcatcagataatcccaacatctgtgaagtgttgacagtggttgattgggttttccaggcaagttgacattttcgtggttgtttgtatgctgagtaattttggattgcatcctggactttttgagcattatgtggtgatactctaggtcttatttaagctatatgggaaatattgatatttttgttttagccaacagccaatcttactttcaggccacaagttccaatccccaacctgtaggccatgagcatcacgtcagttttkaaagcccccgtgccatttcctggtcagatctcctgggcgtgcactgcccagtggtcattctgggacccgagtggttagttcagttctcaaactctttcgtaagtcaaagtatggtatatgcacaggattcacagatgctcgattctagagagttctggagacataaaccacttcatggggtgactttcctgagcttctggctctgtgctgtctacctggtacttttctgattccttgcggtttactgttgtacacgtctgccattgggcccacttcccagcccacatggagagaggacag

SEQ ID NO: 150604 - DNA, 601 bp, Human
cgtggttgtttgtatgctgagtaattttggattgcatcctggactttttgagcattatgtggtgatactctaggtcttatttaagctatatgggaaatattgatatttttgttttagccaacagccaatcttactttcaggccacaagttccaatccccaacctgtaggccatgagcatcacgtcagtttttaaagcccccgtgccatttcctggtcagatctcctgggcgtgcactgcccagtggtcattctgggacccgagtggttagttcagttctcaaactctttcgtaagtcaaastatggtatatgcacaggattcacagatgctcgattctagagagttctggagacataaaccacttcatggggtgactttcctgagcttctggctctgtgctgtctacctggtacttttctgattccttgcggtttactgttgtacacgtctgccattgggcccacttcccagcccacatggagagaggacagagagagaaaaggacaacggttgccccaccccctcggaacagtagctggcaccacagggcctggggcatgaggaacaggggagatggggggcttctgtgttttccaggag

SEQ ID NO: 150605 - DNA, 601 bp, Human
tgctgcactttctcgtggggggcggtgggaacactctgcattcgtggctcttccctggtccacctgctgctgtcttcagtcttccggcagctgccaagcctcctgcccaggtttcagagctgtagtcagtggcaggggaaggggcgccagccgacctgcctcaccagccgcttgctttcttttgtgttcacgctggcctcatccctgcggtgtgggtggactgtatgggctcagccaatccagtcatgcaggtcactcaggtcccgtttctgacggccactggcagtgcagcattgagcaygcttgctcagccccagacgtgtgcacttgggtgtctccgtgacctgggccaggatttctggaggactgaggctgcagacatggaattgccaaggagagtgctgcccagaaagactgtctcgcgcactccgtgcagacctcttcgctttcttactttccgggacgggacagtggcctcgctaaccacattcccctctcccctggggactcttgtctgattgtttattgagccgaaaacagggtccatctgggtgctgtggggtgcaaaggcaagtcccagggggcagcttagagagagtcg

SEQ ID NO: 150606 - DNA, 601 bp, Human
gtagtcagtggcaggggaaggggcgccagccgacctgcctcaccagccgcttgctttcttttgtgttcacgctggcctcatccctgcggtgtgggtggactgtatgggctcagccaatccagtcatgcaggtcactcaggtcccgtttctgacggccactggcagtgcagcattgagcacgcttgctcagccccagacgtgtgcacttgggtgtctccgtgacctgggccaggatttctggaggactgaggctgcagacatggaattgccaaggagagtgctgcccagaaagactgtctcrcgcactccgtgcagacctcttcgctttcttactttccgggacgggacagtggcctcgctaaccacattcccctctcccctggggactcttgtctgattgtttattgagccgaaaacagggtccatctgggtgctgtggggtgcaaaggcaagtcccagggggcagcttagagagagtcgagcaggaaagcgctagggctgcgggggtccccgccacagtgcgctgctgcatgtggctccgcccggaaggatcccactcctccaaacaggtcagcacaagggcagctgtcaggatgccacc

SEQ ID NO: 150607 - DNA, 601 bp, Human
gcctcgtgggctgggcagcttttcagctccactccctgggcctgctctcgcggcattcacgacctcatgtgttcagttacagctggctgccagggccagtcccaactccctgagggggaggcagcacccaaggggaattaggggccgtcacagtggagtggagggccctccgagaaagaggcaggcaaaatcccaatgctcgggctcctggagccccggccagtgagggtcccgagctcctgagcctccgcttgcccactgagcacctcctgccacacacgctgtttctggtgctggacayggcagcgcgcagccccacgtggcttcccccagcagggagagagagagagagacaagcaggcagacgcagggaagctgttgtgcaccatgggatcagggagccgcttgcgagatgaggacaggacagcacgaggaggtgaggctggggaaggtgacagatccggagcccttggggccatgtccggttccctgcccctcccagggctgtcatttgcttggcacctcagttttcccaattccctcagaggcggcaagctggtgaggggcttttgtttgtctacccagtgctttttggacatca

SEQ ID NO: 150608 - DNA, 601 bp, Human
ggagggccctccgagaaagaggcaggcaaaatcccaatgctcgggctcctggagccccggccagtgagggtcccgagctcctgagcctccgcttgcccactgagcacctcctgccacacacgctgtttctggtgctggacatggcagcgcgcagccccacgtggcttcccccagcagggagagagagagagagacaagcaggcagacgcagggaagctgttgtgcaccatgggatcagggagccgcttgcgagatgaggacaggacagcacgaggaggtgaggctggggaaggtgacagawccggagcccttggggccatgtccggttccctgcccctcccagggctgtcatttgcttggcacctcagttttcccaattccctcagaggcggcaagctggtgaggggcttttgtttgtctacccagtgctttttggacatcatgcataagactgcacagactctcctgccactctgcagacaggaaatgcaggccctgcacatgttagcctggctggagccagcatctgggcccaggtatccaagtcggtggcctttggcccacttgctggtgtgagcatggcctcgtgcagcatagcagt

SEQ ID NO: 150609 - DNA, 601 bp, Human
acagatccggagcccttggggccatgtccggttccctgcccctcccagggctgtcatttgcttggcacctcagttttcccaattccctcagaggcggcaagctggtgaggggcttttgtttgtctacccagtgctttttggacatcatgcataagactgcacagactctcctgccactctgcagacaggaaatgcaggccctgcacatgttagcctggctggagccagcatctgggcccaggtatccaagtcggtggcctttggcccacttgctggtgtgagcatggcctcgtgcagcatrgcagtgtgcagtggtggccagggctgcagccccagcgattcttctgccagtcactctgtgccctcagcacggggcctctgatctgtgcctgtttcctcacctctaaaatggatgcaagaagagatgctccagcatcttggctcacgcaggacaggctagggggtgcaggaccgtcgccccggtgtggattttcagttgcactttcagatgcatctcggcatgcgcagtgggttacagcccctcaggtcatctccccacagtccctgccccagaggttgtcgaggcgtgtgtggagcaatg

SEQ ID NO: 150610 - DNA, 601 bp, Human
atgtccggttccctgcccctcccagggctgtcatttgcttggcacctcagttttcccaattccctcagaggcggcaagctggtgaggggcttttgtttgtctacccagtgctttttggacatcatgcataagactgcacagactctcctgccactctgcagacaggaaatgcaggccctgcacatgttagcctggctggagccagcatctgggcccaggtatccaagtcggtggcctttggcccacttgctggtgtgagcatggcctcgtgcagcatagcagtgtgcagtggtggccagggctgcagccccagcgattcttctgccagtcactctgtgccctcagcacggggcctctgatctgtgcctgtttcctcacctctaaaatggatgcaagaagagatgctccagcatcttggctcacgcaggacaggctagggggtgcaggaccgtcgccccggtgtggattttcagttgcactttcagatgcatctcggcatgcgcagtgggttacagcccctcaggtcatctccccacagtccctgccccagaggttgtcgaggcgtgtgtggagcaatgcctggcgcagtggaaatgctgtc

SEQ ID NO: 150611 - DNA, 601 bp, Human
gctgtcatttgcttggcacctcagttttcccaattccctcagaggcggcaagctggtgaggggcttttgtttgtctacccagtgctttttggacatcatgcataagactgcacagactctcctgccactctgcagacaggaaatgcaggccctgcacatgttagcctggctggagccagcatctgggcccaggtatccaagtcggtggcctttggcccacttgctggtgtgagcatggcctcgtgcagcatagcagtgtgcagtggtggccagggctgcagccccagcgattcttctgccwgtcactctgtgccctcagcacggggcctctgatctgtgcctgtttcctcacctctaaaatggatgcaagaagagatgctccagcatcttggctcacgcaggacaggctagggggtgcaggaccgtcgccccggtgtggattttcagttgcactttcagatgcatctcggcatgcgcagtgggttacagcccctcaggtcatctccccacagtccctgccccagaggttgtcgaggcgtgtgtggagcaatgcctggcgcagtggaaatgctgtcagtgttagccactgtgactggattta

SEQ ID NO: 150612 - DNA, 601 bp, Human
caggacaggctagggggtgcaggaccgtcgccccggtgtggattttcagttgcactttcagatgcatctcggcatgcgcagtgggttacagcccctcaggtcatctccccacagtccctgccccagaggttgtcgaggcgtgtgtggagcaatgcctggcgcagtggaaatgctgtcagtgttagccactgtgactggatttaagttgattattttggatcaagtgttatcacacttcagggtggccctgagaagcaagaaggggtcaggactcaggaagcaccatctctcataagccctsgggggtgaggggccagtggcctccctgggaggccaagaggagaaacagctttcaagaaaagcaagtctggcctggttcaagagaccccagcccagcccagcccatcggctgagcagggaccacagggtcctggcccaggtccagccgagctcatggactctcaaagctgactcagcgtggggaccagctgccgggccggcccggagcattcagggggctcctgggagggagggactggtacctgatagagaaccctcagagggggctccaggcacgcatcatcaggtcccagtgtggcct

SEQ ID NO: 150613 - DNA, 601 bp, Human
gaggggccagtggcctccctgggaggccaagaggagaaacagctttcaagaaaagcaagtctggcctggttcaagagaccccagcccagcccagcccatcggctgagcagggaccacagggtcctggcccaggtccagccgagctcatggactctcaaagctgactcagcgtggggaccagctgccgggccggcccggagcattcagggggctcctgggagggagggactggtacctgatagagaaccctcagagggggctccaggcacgcatcatcaggtcccagtgtggcctgaggccagaggcaggacccacagtgtccacctcatgtccacagggcctcggcatgaaggctggaggggtgagcctggggaccctcagccaggcgtgggttggtgtgggttaggggtagaccttagccacagctgggactctcccagctcaggggatgcccaggagagggatgggcttggaggtgagaagggcgttgagagtggggtggccagagggtcacatgatgtggtaggaggcagtggctggtgagttggggacctcccctcacgcccacaccgccacccccaggtcagcgccaacggcaatg

SEQ ID NO: 150614 - DNA, 601 bp, Human
ggccagtggcctccctgggaggccaagaggagaaacagctttcaagaaaagcaagtctggcctggttcaagagaccccagcccagcccagcccatcggctgagcagggaccacagggtcctggcccaggtccagccgagctcatggactctcaaagctgactcagcgtggggaccagctgccgggccggcccggagcattcagggggctcctgggagggagggactggtacctgatagagaaccctcagagggggctccaggcacgcatcatcaggtcccagtgtggcctgaggcctgaggcaggacccacagtgtccacctcatgtccacagggcctcggcatgaaggctggaggggtgagcctggggaccctcagccaggcgtgggttggtgtgggttaggggtagaccttagccacagctgggactctcccagctcaggggatgcccaggagagggatgggcttggaggtgagaagggcgttgagagtggggtggccagagggtcacatgatgtggtaggaggcagtggctggtgagttggggacctcccctcacgcccacaccgccacccccaggtcagcgccaacggcaatgtcct

SEQ ID NO: 150615 - DNA, 601 bp, Human
aggtgagaagggcgttgagagtggggtggccagagggtcacatgatgtggtaggaggcagtggctggtgagttggggacctcccctcacgcccacaccgccacccccaggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgtgagtacccttgccaagggccctgcccatgaggatggcctcaccaggcacacacattacagccyagggcagggttgggccaggcggaggaacgagctggtttcaagcacttggttgagcagcacttcacactgcttgagacagctgtgtagagtattcatccttccctggacatagaaggtgcaggggagtgaagatcctccagtccagctgggaggcccccgtcacctggcctcacacgccaggtcctgcaccctgccctgctctgcctggggcactggggcctaggctaaggccttgttctctccctcccaggccaggtttctcccctcaccttgggccctaggtgtgggccgtgtgaaggc

SEQ ID NO: 150616 - DNA, 601 bp, Human
agtcttcctctcgggcatgcccgagctgcgcctgggcctcaacgacaaggtcctctttgacaacacgggccgtgagtacccttgccaagggccctgcccatgaggatggcctcaccaggcacacacattacagcccagggcagggttgggccaggcggaggaacgagctggtttcaagcacttggttgagcagcacttcacactgcttgagacagctgtgtagagtattcatccttccctggacatagaaggtgcaggggagtgaagatcctccagtccagctgggaggcccccgtcaccyggcctcacacgccaggtcctgcaccctgccctgctctgcctggggcactggggcctaggctaaggccttgttctctccctcccaggccaggtttctcccctcaccttgggccctaggtgtgggccgtgtgaaggccacgcatggtgattctcgctcccgccgcctggcctctaacacttcccacagcagggcgggggcagaggggcccagggcctggttttgtgaactgtgcctcccactcagctgtcacaggccactggaagagggtgcagtggctgggcatgcccccgttcctagccc

SEQ ID NO: 150617 - DNA, 601 bp, Human
gtgagtacccttgccaagggccctgcccatgaggatggcctcaccaggcacacacattacagcccagggcagggttgggccaggcggaggaacgagctggtttcaagcacttggttgagcagcacttcacactgcttgagacagctgtgtagagtattcatccttccctggacatagaaggtgcaggggagtgaagatcctccagtccagctgggaggcccccgtcacctggcctcacacgccaggtcctgcaccctgccctgctctgcctggggcactggggcctaggctaaggccttgytctctccctcccaggccaggtttctcccctcaccttgggccctaggtgtgggccgtgtgaaggccacgcatggtgattctcgctcccgccgcctggcctctaacacttcccacagcagggcgggggcagaggggcccagggcctggttttgtgaactgtgcctcccactcagctgtcacaggccactggaagagggtgcagtggctgggcatgcccccgttcctagcccggtgagggcttctcgggcatcagtctatcagggcagctccccgcctggggctgggcagggccccacccaca

SEQ ID NO: 150618 - DNA, 601 bp, Human
ggaacgagctggtttcaagcacttggttgagcagcacttcacactgcttgagacagctgtgtagagtattcatccttccctggacatagaaggtgcaggggagtgaagatcctccagtccagctgggaggcccccgtcacctggcctcacacgccaggtcctgcaccctgccctgctctgcctggggcactggggcctaggctaaggccttgttctctccctcccaggccaggtttctcccctcaccttgggccctaggtgtgggccgtgtgaaggccacgcatggtgattctcgctcccrccgcctggcctctaacacttcccacagcagggcgggggcagaggggcccagggcctggttttgtgaactgtgcctcccactcagctgtcacaggccactggaagagggtgcagtggctgggcatgcccccgttcctagcccggtgagggcttctcgggcatcagtctatcagggcagctccccgcctggggctgggcagggccccacccacatagccctcagtgaggtggcaaaccaaggtaggacccaggaccccgtggatgccagggcctgagcccttggggagccccgagccatccc

SEQ ID NO: 150619 - DNA, 601 bp, Human
cctcagggcagtgccctctccctccctctctgtgatgcccctgagtactgatgtgagatggggctcctgtccatgcaggccctgaaggagccccgtccacactggcaggtccaaggccctttctgtgcaggctcagccttgcctgccatcgaggggaacggctgcctgtaggccggagcagcacagcctccagagctccgcaccagccgcccatgtcctgggccagctctgcatcggcgtggcttccctgacaacatgttaaggattctgaggagctgagtctgggcttgccgggtgtacrcagtgcacagagaggctaggcccaggcatggctctggagctgagccgggtggcactgacctgctccaccaggggggctcagggcaggcgctgctttccatgttctcccctctctctccatctgcatcccagggggacttggggacagccccagctgagttaagctggaaatgctgcaattcaagtgccttgaatttcatgatggtactttccctcccagcctcagtctaatcacatgacataaaatacagaaagtagaggaaggagagagaaaagccagttaccccaccacctaatactc

SEQ ID NO: 150620 - DNA, 601 bp, Human
tgtgcttcccagatactgcatttttatttttgttttagtttttaaacaaatggaaggtttgtggcaaccctgcgttgagcaagtctgttgatgtcattattccaacagcatgtggtctctgtgttgtcactttttagcaataaagtatgttttaactaaggtatgtacattctcctagacataatactgttgcacattcagactacagtatacggtaaccttttttttttttttgagacggagtctcgctctgtcgcctaggctggagtgcagtggcacaatctcggctcactgcaacctstgcctcccaggttcaagtgattctcctgcctcagcgtcctgagcagctgggattacaggcatgtgtcaccacgcctggctaatttttgtatttttaatagagacggggtttcaccatgttggccaagctggtgacgaactcctgaccttgtgatccgcctgactcagcctcccaaagtgctgagattacaggtgtgggccaccgtgcccggctggtaaacgtaacttttacatgcactgggaaaccaaaaaatgtgtgtgacttgcctaactgtgctatgtgctttatggcagtggtctg

SEQ ID NO: 150621 - DNA, 601 bp, Human
gcagctgggattacaggcatgtgtcaccacgcctggctaatttttgtatttttaatagagacggggtttcaccatgttggccaagctggtgacgaactcctgaccttgtgatccgcctgactcagcctcccaaagtgctgagattacaggtgtgggccaccgtgcccggctggtaaacgtaacttttacatgcactgggaaaccaaaaaatgtgtgtgacttgcctaactgtgctatgtgctttatggcagtggtctggaaccaaacctgcactgtgtgaaggtacacctgtcagtgcttyccatgcatagaaaacaaaattaaatcacaatggaaaaaaggtaattcctaaaaaccaaaagcaaaattaattcatcagcgtatcaagttgatgacaaccacagagacacgtcacttcaaataacacaccctaaggacaaaaggaactgcaaaaaataaattttaagaaatacagagagggccaggcgctgtggctcacgcctgtaatcccagcactttcggaggccgaggcgggcggatcacaaggtcaggagatcaagaccatcctggctaacatggtgaaaccccgtctctactaaaa

SEQ ID NO: 150622 - DNA, 601 bp, Human
actcagtgcatgctccttggtttcttccttttgtcgcctctccctggtcatggttctcacctggacactctcttttctttcacatgctgttctgagactgggcgtgtggcccctgtccccagcagccctcccctgccacggtcattacacactcttccttcccatggccggtctgtctggttcaccagccttggaggaaagtgcattaggggagctgggcggggggtgctgggccactgcagaccacactggcaggggcttggtgactggggctggcagcttggtgagctcagctctgggygcctgggtatcctcatggggcagctgggcaccccagagcaggggctgtccttaccagcctggggcagcacagggccgagctttggctccccagcacaggggctcatgctcccctccctggactggggtgagtggtcagtctctgcccatcgccactagggccagagctgttggctaagctggggcagggcctaggcctgagcgcctcccccgtctgctccccagggcggcaaggagtacctgatgcgggcccacttcggcctgcctagtgtggaggccgaagacaaggagggcaagcccc

SEQ ID NO: 150623 - DNA, 601 bp, Human
tcgccactagggccagagctgttggctaagctggggcagggcctaggcctgagcgcctcccccgtctgctccccagggcggcaaggagtacctgatgcgggcccacttcggcctgcctagtgtggaggccgaagacaaggagggcaagcccccgatcagtgtcaagttcgagatcccttacttcactacctccggcatccaggtacgtaaggcccaggcggccggggcccagaacagggacagaggccgcaggtgacagatatcaatgcagccagcttgggaaagggtgtcagtcagctgsaatcaggaccctgctgtgctgtgggcctctgcctccccacagacagggtgaggccaggctgcctctgctcagccctgacccctgagctcaaagctcactcattctgccccaaactagcgtttgaggctctgccgtccactcatgccccatgggacctcttttccctggcaccccctcaaaagcccacagagggaggagaggctcccagagagccaggggccttctggccgggccccccaagcaggctgctgaggccgtgtctgcaagccacatcctggctgctcaccacttccagaggcg

SEQ ID NO: 150624 - DNA, 601 bp, Human
gtgtggaggccgaagacaaggagggcaagcccccgatcagtgtcaagttcgagatcccttacttcactacctccggcatccaggtacgtaaggcccaggcggccggggcccagaacagggacagaggccgcaggtgacagatatcaatgcagccagcttgggaaagggtgtcagtcagctggaatcaggaccctgctgtgctgtgggcctctgcctccccacagacagggtgaggccaggctgcctctgctcagccctgacccctgagctcaaagctcactcattctgccccaaactagcrtttgaggctctgccgtccactcatgccccatgggacctcttttccctggcaccccctcaaaagcccacagagggaggagaggctcccagagagccaggggccttctggccgggccccccaagcaggctgctgaggccgtgtctgcaagccacatcctggctgctcaccacttccagaggcggctctgccctcccacacatttgcatggtccagacaaatccctttcacccccctgaggcctgtgctcatcctgtcgtcatggcctcccctgccagccccaggctgccccagcaggaaaga

SEQ ID NO: 150625 - DNA, 601 bp, Human
catcctggctgctcaccacttccagaggcggctctgccctcccacacatttgcatggtccagacaaatccctttcacccccctgaggcctgtgctcatcctgtcgtcatggcctcccctgccagccccaggctgccccagcaggaaagattaaggggggaccaacagggcgggagcctgcggtgctcagggccctgctacctgtgccccaggtgcgctacctgaagatcattgagaagagtgggtaccaggccctgccctgggtgcgttatatcacgcagaatggaggtgagtgaggcccyacccgtggggtggggttgtactgaggggtcctctgtggctgcccccagggtggagccatcgggtcgggtcccgaaagcagggagggtgcagagcccagcatgacgcctccctcctgtctcctagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctg

SEQ ID NO: 150626 - DNA, 601 bp, Human
gttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccrgcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgt

SEQ ID NO: 150627 - DNA, 601 bp, Human
ccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgctaggtgcactggggctgccggggccagccgagcccccgccccagccctagggcccggaggagtctccgccactacgcgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctca

SEQ ID NO: 150628 - DNA, 601 bp, Human
caaattcatcctttagttctcagtttcagctgtctgagaggctgtccttgaactcccgatctaaattagatccacctttccaccttatgaccccaaggcatcttgtgcctttcctaaatatcacttatcacaattggtaactatatatttatttgcaaaattatttgtctcatactatctcctttgctagattgaaagatccctgaggacagagaccacgtctgtattggaacatcccgtatcacctctgcaaaacgtcagtatttgttgaaggaattaaaggcagaatgaatcaataatygaaaggagctacttggaatagtaaacttgttcttcctttaatatgtataaacaagacagttttttaaaaaggcttctgagggaaggtggaacccacttgttgccagaatataaccaggaagtacattaagtaacaataacagctataatgaattaagggtgggctttgtattaggcatatcccgagtgcttgagtgctttctctgcatcaaataatttttctttggcataggttctattgttattcccactttccagctaaggaaactgagaacagagcagttattttaaaacaccccat

SEQ ID NO: 150629 - DNA, 601 bp, Human
tttccattcatctttggatagagtccaaactccttgtggtcaacaaggcttgatatgatctggtccctgaatacttctccagtctttttttcccccaacattttattatgaaaattcaaacagactgcaaagtggaaaaaaaattacagtgattatccatagacccaccacctcaatttagttattaactttttttttgagatggagtctcgctctgtcaccagactggagtgcggtgtcgcgacctcggctcactgcaacctctgcctcctgggttcatgcgatttcctgcctcagcctsctgagtagctgggattacaggcatacaccaccatggctggccagtgactaacattttatacttgctttatcatatgtctatccatttacccatccctctctcttagcattaatctttcttgcttctggtacatttcaaaatgaactgcagactccattctcatttttatcactcttctccctgttcctagccatagtcatctttccattccttgaatcagttaggctattttatctctctgggcttttgtacctattgtcccttctacctaaaatgctttcaggtcttgttaattgcaaa

SEQ ID NO: 150630 - DNA, 601 bp, Human
ccgtcatatttctcttgctgtggcccaggcaactatatgagttgtcatgagctgggaagagtgggtgcctagatggcccagcgggaccatctcagctcagctcagtctgggagctgcatgcttactgtcctacactggggatgagtgacatggagaaagctattcaaaaaactccagctagttctcacatcttgattgctcaattccataaacatttttttctgttcttattatataacagaagaaatctacaggagtaagtcagctaagaattctgttactgggtcgtagaattcagctycctccctgtgggataatggaaaaggcccagagacgtgcactgctgtgctaggagaagatagatcaagtaaatccagcagcaccgaccaggcgccaatgggatatatgtggagggtggagcacaacttgcatttctccaaaagatcctgagcagcatgggtgagcaaagaacatgtgccaagaatccacacagtcatgagctctaatctggttatgccacttacaagtgagtatgtttgtaatacatgtgtatttgttatgcaagttcctttggttctctgtaccttgaaatttcttattt

SEQ ID NO: 150631 - DNA, 601 bp, Human
agctggagagccactctggccaaagtgaagcctcagacatctacatatttatgtgcaaaagaacatctgccatcccacagctgcctccgtcatatttctcttgctgtggcccaggcaactatatgagttgtcatgagctgggaagagtgggtgcctagatggcccagcgggaccatctcagctcagctcagtctgggagctgcatgcttactgtcctacactggggatgagtgacatggagaaagctattcaaaaaactccagctagttctcacatcttgattgctcaattccataaacayttttttctgttcttattatataacagaagaaatctacaggagtaagtcagctaagaattctgttactgggtcgtagaattcagcttcctccctgtgggataatggaaaaggcccagagacgtgcactgctgtgctaggagaagatagatcaagtaaatccagcagcaccgaccaggcgccaatgggatatatgtggagggtggagcacaacttgcatttctccaaaagatcctgagcagcatgggtgagcaaagaacatgtgccaagaatccacacagtcatgagctctaatctggttat

SEQ ID NO: 150632 - DNA, 601 bp, Human
aggagaactcaaaggttcctgggttatttctgacaaagttcctagtggacttataaaaataatctgtgctttctgcgagatagttatgttggggctgactttcagcctgattctagagttctattggagtcaaaagaaggaaatttggtggtaaagatgacaagttgggtgaaagcaaaatcgtcttcttattaatggaagatgaggggaaccagctggagagccactctggccaaagtgaagcctcagacatctacatatttatgtgcaaaagaacatctgccatcccacagctgcctcygtcatatttctcttgctgtggcccaggcaactatatgagttgtcatgagctgggaagagtgggtgcctagatggcccagcgggaccatctcagctcagctcagtctgggagctgcatgcttactgtcctacactggggatgagtgacatggagaaagctattcaaaaaactccagctagttctcacatcttgattgctcaattccataaacatttttttctgttcttattatataacagaagaaatctacaggagtaagtcagctaagaattctgttactgggtcgtagaattcagcttc

SEQ ID NO: 150633 - DNA, 601 bp, Human
catatgaggacccagcaagaagttggctatacatgggaagagagaactcaccagaaaccaaccatgctggcaccttgatcgtggacttccagactccagaaatgtgagaaaacaaaatttctgttatttaggcaacccagtatgtggcgtttttaaaaatgcagtctgagctgactaatacaccaagcacaaaggccagtacacctgaaacacatcctcccacaggtaaggtactcttcgccacgctccgtccaacagaccccatccttctcaggttaaaacctgttcataagggcccctstagattcctaaactccatacatcttttttccccttacacacagacccccaccccacttcatttaacatttgttgtaagcgatcaagtcatttacctctaaagcacagaagtgaaagtctgactacccccatacaagcacacaccctttctcattacccaggatgaccctttctccaaagaaagctatgaacattaacaattaatatttcccactattaactctttccacagtgaacttggagcaggagaactcaaaggttcctgggttatttctgacaaagttcctagtggacttataaa

SEQ ID NO: 150634 - DNA, 601 bp, Human
gattttttcttgccattttgctaagaaatgggaactgtcatctcagctttaaagataataaaatcaggaaggaggacatttaaacaaaaacacatatacacagataatcactgcagcatcttatgtaatataaaagctggaaacgattttctatccacagggaactactaaataaactgtggtactgtcatactatggagcaccgtgcagccattaaaaggcatgagacagatgtaggtgttctgatatggaaaaatcttgaagacgtatcactagtagaaaaacaaagtgcaaataaaaygggcagtgtgtactcatttatgcaaacatcctccccaactatatatctgtacatgtatatttaaatgtatgaatagaaagatggctctgaggaagtctaccaactactgataatggtaacctttgggtaggaaagtgggatgggcatgggatggagggtgattcatgctttatttacttatcatgcttgaatccttttaagtaagaaagaatatagtattatttgacttataaataaaaacataaaggcagagggaaatgtgaattataataatgcagttggcatgaaccaacagacctc

SEQ ID NO: 150635 - DNA, 601 bp, Human
gatggttatttgttccaccagccacctttgctgagtccctgattcactccagcccaggactgtctccagcattcatgctgcaaggcagctcctgccaacaactttgccaaatggctcctctcaaagtcatggctgcccagacagactggctcctccatctgcagcagcttttggcaaagagaagtttccctttctggctctgcctcttggctgcaccagaaccttcttgccagaaggatgatttgacccaggaagtacagccagacctggaatttctggggtcatttaaagcctatggccrtgttttcccagtctcacccctgaggtgaacatcagaacatatcaaagagacctagatgatcacaaatacagaaataatgcctcatagaaactgagagtcagaaaagtctgtagagagcatgccttccctcccccatcttcaacctcattatagtagcttaggaaactgaagcccagagaataaaagtgacaaattatggtagcaggactggaatcctacccaggtcttctgatgtgcattccacataactgcttacgatactgcattgcctttccatttccccccagttcattttcaaat

SEQ ID NO: 150636 - DNA, 601 bp, Human
tggttaattatattttgagaaggacggagtgtcacctgcccaaatagatggaaagacatttgagaacaagactataggcttatacttcaccatatgccccagaacttcctacatagcacttggcaataaataatttttgtttgaattgttaaattttctttcctactttataatagtggaagaaattggggccttcctggtttctgaaaaaattatgctcccttggagtttataacccccaccatggagtataaaataacaggagagaaattctattgtgcctgtcagatcatgtcattgmgagcttaacctcattgattggcacttgctcttccccatcagtgtggcaagatgagcagcaccctgctcaccagatggttatttgttccaccagccacctttgctgagtccctgattcactccagcccaggactgtctccagcattcatgctgcaaggcagctcctgccaacaactttgccaaatggctcctctcaaagtcatggctgcccagacagactggctcctccatctgcagcagcttttggcaaagagaagtttccctttctggctctgcctcttggctgcaccagaaccttctt

SEQ ID NO: 150637 - DNA, 601 bp, Human
ctccagctcacttgttaaaacaacatgccaccttcctcgcatacttttgcctcctaacatcacacaagactctgcctccaatgaggaaagccattgccacccatctctacctgccagcatcctaccaaggccccacctccccacttaaccacttctggtgaggtgagcttccctctagcacttactgcagccactcacttagacgattaatactgtttggacctctattaggttcccggtactcttctagaacaggggtcagcaaatgatggtctacaggctactccttgattttgtaaayagagtttcactagaatacagccatgtccacatactacaatggaagaattgagtagctgggacaaaggctgtatggtcagcaaaggctaaaatacttatcatctgaccctctacaggaagagtttactgatccctgctctagaacatcgacatacttttacaaaatggagataataccaaagtttcattctattagaatattcataggcaatatgagatccaaagtatatgtccaataactttgtacagaaaaattattgtattgtacgtcagtttgctcttaataacatatatttttatg

SEQ ID NO: 150638 - DNA, 601 bp, Human
ctgtcaaacattcattccattacatctctaatctccagctcacttgttaaaacaacatgccaccttcctcgcatacttttgcctcctaacatcacacaagactctgcctccaatgaggaaagccattgccacccatctctacctgccagcatcctaccaaggccccacctccccacttaaccacttctggtgaggtgagcttccctctagcacttactgcagccactcacttagacgattaatactgtttggacctctattaggttcccggtactcttctagaacaggggtcagcaaatgrtggtctacaggctactccttgattttgtaaatagagtttcactagaatacagccatgtccacatactacaatggaagaattgagtagctgggacaaaggctgtatggtcagcaaaggctaaaatacttatcatctgaccctctacaggaagagtttactgatccctgctctagaacatcgacatacttttacaaaatggagataataccaaagtttcattctattagaatattcataggcaatatgagatccaaagtatatgtccaataactttgtacagaaaaattattgtattgtacg

SEQ ID NO: 150639 - DNA, 601 bp, Human
aaaatacatcttgttcacaaatggaactgcacccaaaactttccctctatatcctattaagtgaccagaaggtcttgacttctaaaacatagtatgtcagtttcacccaggctaatcctacagaataggaaaagggattagaaattagtcattgcaggatatgtcagctggaaacactaaactgtcctaatctcttctgatagttcagggttctagggaagctcttctctgcctgtcatatcttctccttttaaactggcaccattgatgagttccagtttgcatgtccctacagatctgygctactctaattaatcccacctacccttggctccaagacagaagaggaagaggatgaaaagtagattttaatattgcacccccaaatctccattgaaacttggagtttctagaagatgctttaacacttttagtcctctgagaaggcaactgggtcacctactaaccaccacaaatatttatccattcaactgcccatccatccatctatccatccatccatccatccatccatccatccatccatccatcctttaaattttatgtgcttatcctgcgtataatttttaaaatattgtat

SEQ ID NO: 150640 - DNA, 601 bp, Human
ttcagcatgtgccaatgtctacatcaaggccattcatatgagtgactcaaaggcaacctgcttgtcaagtaattggaaaaaaaaaaaaaaaaaaccctggcttacataatgggctcaaatccaagtttctaagacttataggaaaaattctgatcagaaaatttccatctcaaattgtgctgaggaagcttgaggactgagtaagcatgttgccagctgaagtacaatacgataatcagactgcttttgcttttttttttttccacagtgcacagagatttgtaggtcctggtgggtgctyaccaagtttctgatctctgaccccagaaggggtcagagaacctacagaaaaatacatcttgttcacaaatggaactgcacccaaaactttccctctatatcctattaagtgaccagaaggtcttgacttctaaaacatagtatgtcagtttcacccaggctaatcctacagaataggaaaagggattagaaattagtcattgcaggatatgtcagctggaaacactaaactgtcctaatctcttctgatagttcagggttctagggaagctcttctctgcctgtcatatcttctcctttt

SEQ ID NO: 150641 - DNA, 601 bp, Human
gtaccagggaaggggaagcaggaatggcctggagtagtgaggacccagcacaagccagcctcaatgctttgaagatcaattaggagagacttaaaagatgagaggataggcaggaaacatgaaggtttataagcacaggagaaaactgtgaacagactaatcttcttaaagggtcaaagaaaagtaaattttttttttttttgccttttcagcatgtgccaatgtctacatcaaggccattcatatgagtgactcaaaggcaacctgcttgtcaagtaattggaaaaaaaaaaaaaaaaamccctggcttacataatgggctcaaatccaagtttctaagacttataggaaaaattctgatcagaaaatttccatctcaaattgtgctgaggaagcttgaggactgagtaagcatgttgccagctgaagtacaatacgataatcagactgcttttgcttttttttttttccacagtgcacagagatttgtaggtcctggtgggtgcttaccaagtttctgatctctgaccccagaaggggtcagagaacctacagaaaaatacatcttgttcacaaatggaactgcacccaaaactttccc

SEQ ID NO: 150642 - DNA, 601 bp, Human
gtctgtcttgttggggagatgacgtgcaggatctgtgtctttagatctagctgtctgaacttggacctcagttgccacattcgtgaaatggggaaaatatctataagctcataggattgctgtggtgatcaaagaacttgaggaattcaggaaaaacttcacaggaaaatgtggactggaggcaggccttgcaggtaccagggaaggggaagcaggaatggcctggagtagtgaggacccagcacaagccagcctcaatgctttgaagatcaattaggagagacttaaaagatgagaggayaggcaggaaacatgaaggtttataagcacaggagaaaactgtgaacagactaatcttcttaaagggtcaaagaaaagtaaattttttttttttttgccttttcagcatgtgccaatgtctacatcaaggccattcatatgagtgactcaaaggcaacctgcttgtcaagtaattggaaaaaaaaaaaaaaaaaaccctggcttacataatgggctcaaatccaagtttctaagacttataggaaaaattctgatcagaaaatttccatctcaaattgtgctgaggaagcttgaggactga

SEQ ID NO: 150643 - DNA, 601 bp, Human
ttgaaatcaaattcaaaaaccattactaagcacctgtgtgccaagaaccctactgtcctttgtatggtaaactagagggaaagatgtggtcactgccttcttggagtgtctgtcttgttggggagatgacgtgcaggatctgtgtctttagatctagctgtctgaacttggacctcagttgccacattcgtgaaatggggaaaatatctataagctcataggattgctgtggtgatcaaagaacttgaggaattcaggaaaaacttcacaggaaaatgtggactggaggcaggccttgcargtaccagggaaggggaagcaggaatggcctggagtagtgaggacccagcacaagccagcctcaatgctttgaagatcaattaggagagacttaaaagatgagaggataggcaggaaacatgaaggtttataagcacaggagaaaactgtgaacagactaatcttcttaaagggtcaaagaaaagtaaattttttttttttttgccttttcagcatgtgccaatgtctacatcaaggccattcatatgagtgactcaaaggcaacctgcttgtcaagtaattggaaaaaaaaaaaaaaaaa

SEQ ID NO: 150644 - DNA, 601 bp, Human
gccatttttccatggaattctttgtctatacaaataaaattttatataagagaaatcatactttacataccctttttatcatggatgaagctacctttgactttctttaaaatacagcattgtttttttttttttttggcttgctgctttcatccccctcatagccaatattaataaactttcacataatttttcttattgatattatcatgtaataactcatataatatgaatgaagtttcagttgctcagtaaatacctgctgaatggttaaagagtgaaagaacacacgcataaacaygagtgaatgaaagaataaataatctattatgatcttaattagccagtacagtttccaagtgattgcagaaatctcagatcacatcttttgacatctcccctgcatctttaaactttagttggggtaggaggacctggctttacctcattcagagggacctgcaagtctaaactcccaagaaaagaatatgtaactggctgctctcctaactacagaaatgctgttaatctactctcaaattgaaatcaaattcaaaaaccattactaagcacctgtgtgccaagaaccctactgtccttt

SEQ ID NO: 150645 - DNA, 601 bp, Human
gttaaccaggatagtctcaatctcctgacctcgtgatccacccagctcagcctcccaaagttctgggattacaggcgtgagccaccgcgcccgtcgtcaaactaatgtgtcttcaaagtaaaaggaagaactcaggtgaatattcgctacattaattcccagagactagtcacatagcagacactccatgaattgtttctcaccacaatggcagccttactgtttttattatataaacaatgtatatatttatttaaaactgtcatacattatagacaatataaaaacagtagaagttacytaaaatttcatcagcctgagttatcaatatatttttgttgccatttttccatggaattctttgtctatacaaataaaattttatataagagaaatcatactttacataccctttttatcatggatgaagctacctttgactttctttaaaatacagcattgtttttttttttttttggcttgctgctttcatccccctcatagccaatattaataaactttcacataatttttcttattgatattatcatgtaataactcatataatatgaatgaagtttcagttgctcagtaaatacct

SEQ ID NO: 150646 - DNA, 601 bp, Human
ttttagtagaggtggggtttcaccgtgttaaccaggatagtctcaatctcctgacctcgtgatccacccagctcagcctcccaaagttctgggattacaggcgtgagccaccgcgcccgtcgtcaaactaatgtgtcttcaaagtaaaaggaagaactcaggtgaatattcgctacattaattcccagagactagtcacatagcagacactccatgaattgtttctcaccacaatggcagccttactgtttttattatataaacaatgtatatatttatttaaaactgtcatacattataracaatataaaaacagtagaagttacctaaaatttcatcagcctgagttatcaatatatttttgttgccatttttccatggaattctttgtctatacaaataaaattttatataagagaaatcatactttacataccctttttatcatggatgaagctacctttgactttctttaaaatacagcattgtttttttttttttttggcttgctgctttcatccccctcatagccaatattaataaactttcacataatttttcttattgatattatcatgtaataactcatataatatgaatg

SEQ ID NO: 150647 - DNA, 601 bp, Human
gagatcagagatatagtcttagctttcttgtcgcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaatttttttttttttttttttttttttttgagactgagtctcctctgtcgctcgggctggagtgcagtggcgcgatctcggctcattgcaacctctgactcccrggttcatgtcattctcctgcctcagcctcctgagtagctgggactacaggtgcccgccaccacgcccggctaatttttttgtattttttgtggagacagggtttcaccgtgttagccaggatggtgtcgatctcctgacctcatgatccgcccagctcggcctcccaaagtgctgggattacaggtgtgagccaccgcgcccagcctaatttcctatatttttagtagaggtggggtttcaccgtgttaaccaggatagtctcaatctcctgacctcgtgatccacccagctcagcctcc

SEQ ID NO: 150648 - DNA, 601 bp, Human
aggacattttttcttagatgagttttccatcattgcaattgattttcactgactcatccagaccgttgctcagtccccttataaaatgattggctgagatcagagatatagtcttagctttcttgtcgcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaattttttyttttttttttttttttttttgagactgagtctcctctgtcgctcgggctggagtgcagtggcgcgatctcggctcattgcaacctctgactcccgggttcatgtcattctcctgcctcagcctcctgagtagctgggactacaggtgcccgccaccacgcccggctaatttttttgtattttttgtggagacagggtttcaccgtgttagccaggatggtgtcgatctcctgacctcatgatccgcccagctcggcctcccaaagtgctgggattacaggtgtgagccaccgcgcccagc

SEQ ID NO: 150649 - DNA, 601 bp, Human
cagacctctccagtaggtccgatagtcactaatccactgactaaacattttaaaactggctttggcaaaacatgccagaaattccttcagggtaattaaaaccaccctctgtgtcaataaacacagactgaaatctttcatgtgcagaggggctggctctgacccactggctctaggacattttttcttagatgagttttccatcattgcaattgattttcactgactcatccagaccgttgctcagtccccttataaaatgattggctgagatcagagatatagtcttagctttcttgtygcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaatttttttttttttttttttttttttttgagactgagtctcctctgtcgctcgggctggagtgcagtggcgcgatctcggctcattgcaacctctgactcccgggttcatgtcattctcctgcctcagcctcct

SEQ ID NO: 150650 - DNA, 601 bp, Human
cccatactctgtctttaacagcctcattgccatacactacacttgacctgctgccccatatgcagacctctccagtaggtccgatagtcactaatccactgactaaacattttaaaactggctttggcaaaacatgccagaaattccttcagggtaattaaaaccaccctctgtgtcaataaacacagactgaaatctttcatgtgcagaggggctggctctgacccactggctctaggacattttttcttagatgagttttccatcattgcaattgattttcactgactcatccagaccrttgctcagtccccttataaaatgattggctgagatcagagatatagtcttagctttcttgtcgcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaatttttttttttttttttttttttttttgagactgagtctcctctgtcgctcgggctggagtgcagtggcgc

SEQ ID NO: 150651 - DNA, 601 bp, Human
gcaagagtaacaatgagtgactttaggaatgagacacaacccatgcccaagccccaaaatcaaaggtgtaaagcacaccaagttgttccacccaaagaaccttgttctaaaaatgttagtggtcagtgtcttacagagagtcagcaagcagatgcacttttttccaagactataagatttcatctagttgggagtttattgatttatctgatattccaatatcatagaaagagctcggttttatgaatcagtctctaaacctcagtcttttctccaccataaactaggtatgtgatcataracaagttgattaactccactggatctcagttttctcactgaaaaaatgagaataaaggaaatttactctttatatttgttgagcagagtagataagagctgtgaaaatgctttgcagaaatacaaaacccctcccacaagtataagatgacattactattttacataactccttccttgcctaatatttagctgctaatgtatcaacctgtttggagaagttggtttattgaagaactaatttaaaagcaagaggaaggggcaattcttaagagttgaaaactatcagcagtgccaaaga

SEQ ID NO: 150652 - DNA, 601 bp, Human
tatgtctttattatcaccaaaccctagtgctttaaggcttgcaccactgtccaggaatgtggttccagagactcttccacttggcaagagtaacaatgagtgactttaggaatgagacacaacccatgcccaagccccaaaatcaaaggtgtaaagcacaccaagttgttccacccaaagaaccttgttctaaaaatgttagtggtcagtgtcttacagagagtcagcaagcagatgcacttttttccaagactataagatttcatctagttgggagtttattgatttatctgatattccratatcatagaaagagctcggttttatgaatcagtctctaaacctcagtcttttctccaccataaactaggtatgtgatcatagacaagttgattaactccactggatctcagttttctcactgaaaaaatgagaataaaggaaatttactctttatatttgttgagcagagtagataagagctgtgaaaatgctttgcagaaatacaaaacccctcccacaagtataagatgacattactattttacataactccttccttgcctaatatttagctgctaatgtatcaacctgtttggag

SEQ ID NO: 150653 - DNA, 601 bp, Human
catatacataactgtactaatttttttttttttttgagatggagttttgctcttgttgcccaggctggagtgcaatggcacgatctcggctcattgcaacctccgcctcccaggttcaagcaattctcctgcctcagcctccctagtagctgggattacaggcatgtgccaccacacctggctaactttgtatttttagtagagacagggtttctccatgttggtcaggctggtctcgaactcccgacctcaggtgatccgcctgcctttggcctcccaaagtgctgggattacaggcatragccaccatgcccagccaactgtactaacattaataaaaatacagcttaacatttagcaattactacctactattttcctgggactgtcatgagcacattacaggcaccgtcacttttaatacttacaatagccttatgaggttaagcattgttatctttattttacagatgaggcacctgggcttagagaggttaaataacttgcccaaggactagcaagtggtggagccaggatacaaacccagtcatctccagagtctgttttcttgactacttttttcatataattctaaactcta

SEQ ID NO: 150654 - DNA, 601 bp, Human
agttttgaagaggctgtagtgatcaggagagctggcttcatatagccaaagtagggtcctgtggacaggatactcagcgtttggggtagggttttatggtgcagggctaggagcagtgggtgaaagagaatgctctggtgcagaacaacttctatgcaataggaactattcaggagcagaagtaagtcacctcactcgttagaaatggccccatttctctgcaagcgttcagaagtatgaggttatatcctacgagaaactatgaaaaaggtgatataagaagaaatattcaaaataaacrtgtaagattaaaaaaaattaggccttaatgggaagcttcaacataccactaatatagaacaaaaggttcataattagtccattattgttaattttttagtatcttaaatttattatccttaaatatcctgctgatggtgcatggagtagataatgagttttagtttcctcaatgtttcatttcatattcagaaaaagaatccaacctaacagattatttaaaagagataaaatcaccaccagccagtactgatactggatcaaagattaaggttagtgtattaacttatttgtcctctgt

SEQ ID NO: 150655 - DNA, 601 bp, Human
gagttaataatgaaagggctttagaatatttgatacaggtgagaagttgtttttcctacacagtgatttctagatctattttctcattggaaattacctgttcagtgataccttttattcttcgttatattcaaagtaagatgcccatattgtctttctttgcctcttgaccccaagctctttttctttgtgtcttgaccccaagctctttttctttgtttgagcagttaatatatctactttgttctctagcttattcgacaaacctaacatcaataaagcaggctctattcttgtttarccaacactctctctcctggtaattttataaccagttatatcatccccatgtacatttggtcaaaatatgttcttgttcttaaaacagtaaatcaaactatgcttcctatgtacaataactatttaaaaaatgtaaattaacttgtgtcctacggaacaaattttaagcaactggaactatttaaaaaatgtaaattaacttgtgtcccacggaacaaattttaagcaattggaactatttaacacttctatactgctactttatcaagaagagtaggtataaataataatacgaatacct

SEQ ID NO: 150656 - DNA, 601 bp, Human
gccttcatgctacttcatccaaatcaagtgtaactacttaggagttaataatgaaagggctttagaatatttgatacaggtgagaagttgtttttcctacacagtgatttctagatctattttctcattggaaattacctgttcagtgataccttttattcttcgttatattcaaagtaagatgcccatattgtctttctttgcctcttgaccccaagctctttttctttgtgtcttgaccccaagctctttttctttgtttgagcagttaatatatctactttgttctctagcttattcracaaacctaacatcaataaagcaggctctattcttgtttaaccaacactctctctcctggtaattttataaccagttatatcatccccatgtacatttggtcaaaatatgttcttgttcttaaaacagtaaatcaaactatgcttcctatgtacaataactatttaaaaaatgtaaattaacttgtgtcctacggaacaaattttaagcaactggaactatttaaaaaatgtaaattaacttgtgtcccacggaacaaattttaagcaattggaactatttaacacttctatactgctac

SEQ ID NO: 150657 - DNA, 601 bp, Human
tatcccaaaatatagccaaatgtggaggctgtaaagctaaagcctcaccacacactgtatcgagaaatgaataaaaaagcctagcagaagccttcatgctacttcatccaaatcaagtgtaactacttaggagttaataatgaaagggctttagaatatttgatacaggtgagaagttgtttttcctacacagtgatttctagatctattttctcattggaaattacctgttcagtgataccttttattcttcgttatattcaaagtaagatgcccatattgtctttctttgcctcttgascccaagctctttttctttgtgtcttgaccccaagctctttttctttgtttgagcagttaatatatctactttgttctctagcttattcgacaaacctaacatcaataaagcaggctctattcttgtttaaccaacactctctctcctggtaattttataaccagttatatcatccccatgtacatttggtcaaaatatgttcttgttcttaaaacagtaaatcaaactatgcttcctatgtacaataactatttaaaaaatgtaaattaacttgtgtcctacggaacaaattttaagcaa

SEQ ID NO: 150658 - DNA, 601 bp, Human
catttcacattctcttgtacttcctccatcagagaacctctcattctgcattataattgcctgttgtcctgtatgtgtcccctactaaaccacaggttccttaacagtagagaccaggtctatatactaaacctttgcatccccagcaccgagtacagcaccagacacatagtaagtgcacaataaatacttaataagtaaaaggatggatgccagactcttcattcccaatctgctgacacacattaaattattatttcacactggaatggattttagaaaatcagagagagccctacawggcttcatgtcttatactgctcttaaataatcataatctcatgtcagaaattcaaggcaatttttaaaatacataatatgttacatatttatggggtacatgtgatattttattacatgcatagaatgtataatgatcaagttatggtattcgggttatttatcaccttgagtatttattatttctatgtgttggggacatttcaaattctctcttctggcttctttgaaatatgcaatacattgttgctaactacagtcactgtactctgctatcaaacattagaatttatacctttta

SEQ ID NO: 150659 - DNA, 601 bp, Human
tgattacaggtcattagtgaccattaatatgtgaaactgtttgcatttcactagtatatctgaataacagtcttgcctttcacactagctcagtcaagtttccaaaaggaaagccccgttatcaggccacgagcaggacttaaattaacaattagcctctagaatcgaactatgatgcagaagaattcattattttggttcattgtggttccgcctactgtagaaccagtctttgcctttgtagtggagacatgctctttgtgccaaaagattgtgtgaccacctctctccaaacattctsaacaattcccaatgactgctaatgtgttggccagcaacatgaacctgcttatgtgacaatagtatagacggtcctaagttcacaatacgatggctgattagagtacagataaatgcagggagcacattgggaattatcagaaacatagaagtgacaggaaaaaggtctatttgacaaaaaagcggaggcagagtagagagtatgtatacctgagtgaacctgataatctagaatttttaaaagtgcaattagagctttggattatcagcattaagaggcaagattcttcaaaggaattgg

SEQ ID NO: 150660 - DNA, 601 bp, Human
caaaagatcaaagtgccttgctctttaagatgcatatctcaacagagcagctgtttcatttcaagagagtcttcattttttttttagtgataagtttacaagcagttgttagtggtacagaaaatcttacgacatctgtggagaagttgtaaatttttcagattgggttaggattctcttgataatcattaaaatccttgaggtctaggatagcatttggagcataatttgacctcaattatgtgttaaatgtttgctgaagaaatggtgatgctttgagaaaattagctatttgaagcaygagaccagagtggagctgaaagaaaaaaattaaaattaaagtggctcacttatcaaaaaccaaagccacagagaaaggggaccaataacagcatcctcttcattccattttgattaaggctgcaggcttatgaggggacaggaagctgggagaatctcaagaaaagaaaatgcagtccctaaatgccacagctcaagaggaatgctccagcctactgtctccaatggagaagaacaatctgcagattgacaaagccctctgtttacactcctgaacaaataaactaatcatgcctttgtt

SEQ ID NO: 150661 - DNA, 601 bp, Human
cagtaaaggttcacaatggtgccaatcatctcctaatcctgtccctcagagatctgtttattaagtaatttttctttatttcacaatatctcaaatgctactattgggctcaagctctcatcattggccttggatttcattcaacatttaacaaatatttactgagcatatttactagattccaggcactgtgttagagcctgggatacacactaggcaagagagacaggtgctcaccttcaagaagagaggataaccaacacacaaatgagtaaataaaatgattgctgattgctattartgctaacaaggaaagagatcctgttccatgtgagtgagatcatgcccattgcttcatcatgattgtaagtgatccaaatgcctcactgggataacctgcatcattattgcttcgtggtaccaggtagatcacagtcttttctttttacttgatgaaggagtaaagaattttctgttttaatgccatggtttcctataagaatttaaatatactcactttctcaaattaaataagtgtaggcaaaacacaaggtataccttttctaaggagtcactataacacctcaaaatctctattgtc

SEQ ID NO: 150662 - DNA, 601 bp, Human
acacttctaggaaggaaaataagacctgagaacagcctttgaaggtggagggtaaagtacaaagggaaaggtgctaaagtgatgcatcagctggaagtataactgggctctaatgtgacactctgcattaacgatgctaatttatgtctgggtaagcgtgtgtgggtgacacagaggaatttgaagaggtctatattataccatgggggagctcatcttgaatcttttgccagggtacatgctttatgcagggactgcttcacgtgggcatatattatgtacattttgtgtcagtttcatstgagtaaatcacgtgtctctttagatctattctagaccctttccaatctattctttgcactgcagccagaatagtatttttgaaaagcaaacttggtcactttccccaatcttccctacatttaagcatttaaatggcttcctgttactcataagataaaaagcaaaaatggctcatatatttttgcaagactctgcaagatgtggcttctgtctaatgtccatcctgtgggaacttaagccacactggccacctttcactttttgaacacacactctctctactgctactaccataaag

SEQ ID NO: 150663 - DNA, 601 bp, Human
tgcaaatgttacaaaatacggatttcaaagactaaaatcacaacaatttattagggcaaacagtacaagagggtgcactaacaaaggtctgatttaagtgcttttattcaacccagtgaagggaaaatgacagtaatacatctaagccatgcaaaaaggattcaggcttccttgaaaaggattcaagtggcataaaatggtttgtttctccacagcaatttacatttattaaaatagataataggcataatcattgtcaaaatagagcttctaccctgtataatatcttaatacatcctcraagttcctgacaaacaggcacaaagccatggcagattagagtctaagtggaggatcactccaatagcacagcagaaaaaccaatctcacacttctaggaaggaaaataagacctgagaacagcctttgaaggtggagggtaaagtacaaagggaaaggtgctaaagtgatgcatcagctggaagtataactgggctctaatgtgacactctgcattaacgatgctaatttatgtctgggtaagcgtgtgtgggtgacacagaggaatttgaagaggtctatattataccatgggggagct

SEQ ID NO: 150664 - DNA, 601 bp, Human
gtttttataagtaatgaagcaatattggtatgtaatcattaaccaaagtccatagttcattcagatttgcttaattttctaatgtcctttttctactctaggatcctacccaggatagtacattacagttagttgtcatggctcctcaggctccttgaggctgtggcagtttctcagacttaccttacctttgatgatcttgacagttttgaggaatagcagtaaggtatactgtaggatgctcctccagtggaatttatttgatgtttttctcgtgattgaagaccacagagataaagtrccatttccatcctatcacatcaatcaaaggtacctatatcaacatgccttattttcatgttggacttgatcacctggctgaagaaatgtttgtcaggtttctccactgtaaagttactcccctctcctccaaactgtactctgcacccttagaaagaagtcatgatgtacagctcacccttaaggcttagggagctatgccaacttgctgtcttccttgagggtatgttatctgcacaatttatctggagttctgcatgggagattttctcctcctctcctatttattcaattatttact

SEQ ID NO: 150665 - DNA, 601 bp, Human
ctactaaaaaattaaaattacatatgtggcttatgttagatctcttggaatgatgctggtctagaatattcctctattctctcatcatttcagagttaatctgattttaatgcttatgactttttcttaaacctgcctataatggtatatattgagagtgaaaaatatttagaagtctcaaagccactgccttaaattcttatgttattctacagtattcttatctcatgcagatcttagaacattgttcaagtatcataaactataatacatcagactatgggtgggaaaacatcttcayataattttagaatcattatttacactactgttcaaatcctttaattctacttccagagctactaccatcatctaggccaccgtaatctctcaactgatctgtatgactgaagtaacttcctaactggtcttctacctctatctcattgttttccaacaatagacagtgtaaaagtcttacatgctgccttcttgcttgacctgcctgtagttgtccactaaccccaggataaagttcaaatcttcaattcagcctttaattcctgacataatagacttacttcctcctcttgcctacttc

SEQ ID NO: 150666 - DNA, 601 bp, Human
aaaagaattcctccagcaagtgtaaatctaaactatttttgactaactttgggagctccagacctgtactgtgcaacacagtagccactaaccacgggccactattgctcacttgaaatgacaccagtctgaattcaatgtgctgtaagagtaaaatatacactgagttctgaagacaacatgagaaaaagaatgtaacatctcataattgtcattttgattacatattaaaataatatttttgatacattggattaaaatattaaaattaattttatctggccaggtgcagtggctcacrcctgtaaacccagcactttgggaggctgaggtgagtggactgcttgagcccaggagttcgtgaccagcctgggcaacaaggcaaaacccgtctctacaagaaatacaaaaattagctgggcatggtggtgtgcacctgtaatcctagctactcaggaggctgaggcaggagagtcacttgaacctgggaggcagaggttgcagtgagccaagattgcgccaccacactccagcctgggcgacagagtgagactccatttcaaaaaataataatagtaaaagtcaggcacagtggctcacg

SEQ ID NO: 150667 - DNA, 601 bp, Human
ctgcaagctccgcctcccaggttcatgcctggctaaatttttttttgcacttttagtagagacggggtttcaccgtgttagccaggatggtcttgatctcctgacctcgtgatccgcccgcctcggcctcctaaagtgttgggattacaggcgtgagccaccacacctggccaatttatgactatttcattttctgttttattcatgtctcctccataaaggtgtaagctgaagaacagacactgtgcgtggtcagctcatgattagagctccagtgtgtgaaccatcactcatgctaacrtagttgatgctccatgaccatacagtgagtgcgtgaaaaatatacatggagtgaaataggcaatttgagtatgtacactaaattctgtttcccatgtgcatgtactagaataggaatgttgattaacttgttttgaaaaagaattcctccagcaagtgtaaatctaaactatttttgactaactttgggagctccagacctgtactgtgcaacacagtagccactaaccacgggccactattgctcacttgaaatgacaccagtctgaattcaatgtgctgtaagagtaaaatatacact

SEQ ID NO: 150668 - DNA, 601 bp, Human
agtatctcaacctctcttttgttttcatcatagcataatttatgactatttcttttcttttccttttctttttttttttttttgttttttttgagatggagtctcactctgttgcccaggctggagtgcagtggcacactcttggctcactgcaagctccgcctcccaggttcatgcctggctaaatttttttttgcacttttagtagagacggggtttcaccgtgttagccaggatggtcttgatctcctgacctcgtgatccgcccgcctcggcctcctaaagtgttgggattacaggygtgagccaccacacctggccaatttatgactatttcattttctgttttattcatgtctcctccataaaggtgtaagctgaagaacagacactgtgcgtggtcagctcatgattagagctccagtgtgtgaaccatcactcatgctaacatagttgatgctccatgaccatacagtgagtgcgtgaaaaatatacatggagtgaaataggcaatttgagtatgtacactaaattctgtttcccatgtgcatgtactagaataggaatgttgattaacttgttttgaaaaagaattcctcca

SEQ ID NO: 150669 - DNA, 601 bp, Human
cctaaaatacccaaaggggtttggaggtccatcagctgtgacaggcagacttcaaaaaatcagactcagatactgccccattcaaatagttctattttgactccaatttgtttttatacaaaacaaaaataaactgcttttcattttaattaccagccagcaagtatagtatatgtagcatagaaatcaaagatataaatgatgctgcagtatcagaactgctcattctaaaacaatctattcattgtctgtaatgtgtgagacattgtgatggtattagactaataaaagaaacaaacaygtccttaatctgatagagcttactctgtaggaagggagatatacatctacctttagggaggctaaacaaagagatgaaacaagacaaatatgtattaaacattagtggccaatatgctgtattacaagcattaaattttgaactagagtctctaatgtagggattcaggagaggtaacaaagtcaaggagactttttgggaaaaaagtggaatttgagcctagacacttgaagcttatggaggattattcaatgccttctattattcctgtgcataaagatcaaatgcaccaaaactcaa

SEQ ID NO: 150670 - DNA, 601 bp, Human
cagagcttaaagtccaagtaagttaattaccccttggaatctttttttttacatcgaaaagaaaatataatactatatgcagggctcttataattaaatgaaatgacatatctaaagttataaagcccagtgcctagcatatagtagttgcttaataaatcttagtttcttttccttgtcttcagaataaccaaattaatctctcctttgagtcaaactgtgatttaaaagcacagccctagtacatcactaaaaataaaatcaacagacagttccacacatctagacactcctaaaatayccaaaggggtttggaggtccatcagctgtgacaggcagacttcaaaaaatcagactcagatactgccccattcaaatagttctattttgactccaatttgtttttatacaaaacaaaaataaactgcttttcattttaattaccagccagcaagtatagtatatgtagcatagaaatcaaagatataaatgatgctgcagtatcagaactgctcattctaaaacaatctattcattgtctgtaatgtgtgagacattgtgatggtattagactaataaaagaaacaaacatgtccttaat

SEQ ID NO: 150671 - DNA, 601 bp, Human
acttccttagggtatgaggaagagcatgttctaacacaattgttctgagttgttgccaggaagtcaagtgtatctttagcatcacctctgggcaaatagtacaaacagaggaaaatgatgtttgaggccaaatgttgaaaacttgagacttgtgtagctgagctaaaagagcagagagctaaaatgaaaagttaattatgttgattctgtttttttctatgagaatttctatttaaaggagcagcagtagtgaaaacaggatgggctttaagtaccaacagctttgggttcaaatgcaggyttgtcaattgctgcctgattgagttcccttgaatatacataacaaacatttaattgagtgactcctctgtgccaggcacgttgtccttacagagcttaaagtccaagtaagttaattaccccttggaatctttttttttacatcgaaaagaaaatataatactatatgcagggctcttataattaaatgaaatgacatatctaaagttataaagcccagtgcctagcatatagtagttgcttaataaatcttagtttcttttccttgtcttcagaataaccaaattaatctctcctttga

SEQ ID NO: 150672 - DNA, 601 bp, Human
aacatttatttttacttccttagggtatgaggaagagcatgttctaacacaattgttctgagttgttgccaggaagtcaagtgtatctttagcatcacctctgggcaaatagtacaaacagaggaaaatgatgtttgaggccaaatgttgaaaacttgagacttgtgtagctgagctaaaagagcagagagctaaaatgaaaagttaattatgttgattctgtttttttctatgagaatttctatttaaaggagcagcagtagtgaaaacaggatgggctttaagtaccaacagctttggrttcaaatgcaggcttgtcaattgctgcctgattgagttcccttgaatatacataacaaacatttaattgagtgactcctctgtgccaggcacgttgtccttacagagcttaaagtccaagtaagttaattaccccttggaatctttttttttacatcgaaaagaaaatataatactatatgcagggctcttataattaaatgaaatgacatatctaaagttataaagcccagtgcctagcatatagtagttgcttaataaatcttagtttcttttccttgtcttcagaataaccaaatta

SEQ ID NO: 150673 - DNA, 601 bp, Human
gataaaaaccatgatgaagttctaacttgctgacttcttggctgtgtttggacagccacaacttccctgcctttctaaaggggcagagaatagaatgcgaaatgtcaccatttctacaattttattcatccttctttccaaacatttatttttacttccttagggtatgaggaagagcatgttctaacacaattgttctgagttgttgccaggaagtcaagtgtatctttagcatcacctctgggcaaatagtacaaacagaggaaaatgatgtttgaggccaaatgttgaaaacttgagwcttgtgtagctgagctaaaagagcagagagctaaaatgaaaagttaattatgttgattctgtttttttctatgagaatttctatttaaaggagcagcagtagtgaaaacaggatgggctttaagtaccaacagctttgggttcaaatgcaggcttgtcaattgctgcctgattgagttcccttgaatatacataacaaacatttaattgagtgactcctctgtgccaggcacgttgtccttacagagcttaaagtccaagtaagttaattaccccttggaatctttttttttacatcgaa

SEQ ID NO: 150674 - DNA, 601 bp, Human
ttcagatatcatgtgcctacctagtctattcgatcttgtgggggaggcaggaaggcaaacattacttatgcaatactcaagtcaaatacatatggattcaaactgagtcctaaaatgtatatgtggccgggtgcagtggctcctacctgtaaccccagcacttacggaggctgaagtaggcagatcacctgaggtcaggagtttgagaccagcctgggcaacgtggtgaaaccttgtctttactaaaaatacaaaattagccgggcatggtggcatgtgcctgtaatcccagctactcggraggctggggcaggagaatcgcttgagcctgggagatggaggttgcagtgagctgagattgcgccattgtactccagcctgggtgatgagcgaaatcccatctcaaaaatatagtaaaatgtatatgcaatttccaaaaaattaaaaatcatgtttttgtgtcatctgggaggtaagtataagaaccagggcttggccctataaaatttaatattatctcatttttacttaagaaatggacttgctaaatctgctgaccatcccaaaaaatcatcagcaacttggagagtcagctttacat

SEQ ID NO: 150675 - DNA, 601 bp, Human
tcttaaatagttcctcatatattataccttggacctctcttctgtttcttctgacaaggttttcttgaaataagaaacaaaaacaaatgactgccttcccaaggcaaagggtattttgggaaatctgaagcagcgttagaggtttagcccagtcttcctcactacagcctcttcaacatttctgaaaagtgaatgtccatcctccctgtgagaaaaccatctcccaagacagtccctgccactctttgataggctgaacactagaaaattcgtccacatactgatttccaaccttcccttyttataacttccaattagaagcttgttctaattgtgccttcctaaatactcttcttcattcagatatcatgtgcctacctagtctattcgatcttgtgggggaggcaggaaggcaaacattacttatgcaatactcaagtcaaatacatatggattcaaactgagtcctaaaatgtatatgtggccgggtgcagtggctcctacctgtaaccccagcacttacggaggctgaagtaggcagatcacctgaggtcaggagtttgagaccagcctgggcaacgtggtgaaaccttgtctttac

SEQ ID NO: 150676 - DNA, 601 bp, Human
tggccaacatggtggatccctgtctctactaaaaatacaaaattagctgggcatgatggtgggtgcctgtaatcccagttacttcggaggctgaggcaggagaatcacttgaacctgggaggcggagattgcactgagctaagattgtgccactgcactcctgcccagaggacaaagtgagcctccatctcaaaaaaaaaaaaaagaaaaaaaagaaggaagggagagaagaatgggacagagttacataatgggaaggaaagcatacaaaaagaggaatgaggatagactagacagaagrgtgagctacacaagtgagttaagaaagtgatatgctaacacattaatgattaataggtacgaatttgtccatcaaatcttaaatagttcctcatatattataccttggacctctcttctgtttcttctgacaaggttttcttgaaataagaaacaaaaacaaatgactgccttcccaaggcaaagggtattttgggaaatctgaagcagcgttagaggtttagcccagtcttcctcactacagcctcttcaacatttctgaaaagtgaatgtccatcctccctgtgagaaaaccatctcc

SEQ ID NO: 150677 - DNA, 601 bp, Human
ggagttcaagaccagcctggccaacatggtggatccctgtctctactaaaaatacaaaattagctgggcatgatggtgggtgcctgtaatcccagttacttcggaggctgaggcaggagaatcacttgaacctgggaggcggagattgcactgagctaagattgtgccactgcactcctgcccagaggacaaagtgagcctccatctcaaaaaaaaaaaaaagaaaaaaaagaaggaagggagagaagaatgggacagagttacataatgggaaggaaagcatacaaaaagaggaatgagkatagactagacagaagagtgagctacacaagtgagttaagaaagtgatatgctaacacattaatgattaataggtacgaatttgtccatcaaatcttaaatagttcctcatatattataccttggacctctcttctgtttcttctgacaaggttttcttgaaataagaaacaaaaacaaatgactgccttcccaaggcaaagggtattttgggaaatctgaagcagcgttagaggtttagcccagtcttcctcactacagcctcttcaacatttctgaaaagtgaatgtccatcctccct

SEQ ID NO: 150678 - DNA, 601 bp, Human
agaatggtatcagagaaactgattaagcagggacctgggaatctgagttgagttccggggcatgtttgttccctagcaccatgacctacatggcagtgtctcttctcatactattttaagagtccctggtaagtaggttctgtgttcatattcctaacagtgagccccctatgcccctgtcctatggcgttaaagaaatctttatatgttgaatgaataaatgaaagaagaatttaaaaaatagttatctacagcttggtagaccctgtgttggtatttgcatatagtctctaatacttayattgtgacaaactttcaaggagctactaacatcaccattttataagagagaaatgtgaaatacagggtggttaggggatttcccaaggttacagacttagaaggaaggaagggaggccgggctcacacctgtaatgccagcactttgggaggccaaggtgggtagatctcttgaggtcaggagttcaagaccagcctggccaacatggtggatccctgtctctactaaaaatacaaaattagctgggcatgatggtgggtgcctgtaatcccagttacttcggaggctgaggcaggagaa

SEQ ID NO: 150679 - DNA, 601 bp, Human
aatatgtattgaacacttggttttaggtgctacgccaacaactagcagcaccaataatagtgataaatagtatcctggaagagtttaaaatttagaaggaaaaataatccacaagtacagacagttatgacttagggtgatttgatttaggatttttcaactttacgatgatgcaaaagtgatacacattcagtagaaaatgtacttcgagtatccacacgatcattgttttttcactttcagtacagtattcaataagttacatgagctattcgaactttaaaaataggctttgcatgaratgattttgtagtagatgagttgtagtttaatgtaagttgttctgagcccatttaaagtaggctaggcttagttatgattttcagaagattacgtgtattaaatgcattttttgacttaagatattttcaacttaatgatgggtttatcaggatacaaacctgtggtaagttgaagagcatctgtatagtatgttagttgtatgggggtgggagaagaaagtgatgtggctataaggtggcacagtgaagtgctgggacagcactgttcaatagaaataaaatgtgagacacatatgtgg

SEQ ID NO: 150680 - DNA, 601 bp, Human
catcccagttccaccgatttaagctatgggaccaattatgaaactttccaaagcctgagttccattatttgtaagaaggtgatgataacaccaccaaccgcattgggttgttggtgatatatatatgtaataattcatatatctgacacataataaatattcaataaatattactttatcttatcattttgctaaattgtaacagaaaattccctataaggtcttcagagtaattctgcctactatgccctccccatgcagctgccaacaaatttattatagttggtatgtcactggttaygttttccaatgtttgaaaaaaattctacctcactccccatccttaccacacatatatcccccacctacttggagtataaactcctgggaaaccacttacaatgtacagtttggctgtggctcaccacactcttctcaaggctcttcagtattgggatggatggcaagaattgcatttattttctcacttcttttgtttaaggtgctgagtcagattaagagatggcactgtcccaaattgcaacgaactggactccacttgtattttgtaaagttgagctgacccggctcagctcctaaa

SEQ ID NO: 150681 - DNA, 601 bp, Human
cagatgctactaattctgcatcaaagacatcttggacattatgctaattagagcctaatgaagtgggttggcatcccagttccaccgatttaagctatgggaccaattatgaaactttccaaagcctgagttccattatttgtaagaaggtgatgataacaccaccaaccgcattgggttgttggtgatatatatatgtaataattcatatatctgacacataataaatattcaataaatattactttatcttatcattttgctaaattgtaacagaaaattccctataaggtcttcagartaattctgcctactatgccctccccatgcagctgccaacaaatttattatagttggtatgtcactggttacgttttccaatgtttgaaaaaaattctacctcactccccatccttaccacacatatatcccccacctacttggagtataaactcctgggaaaccacttacaatgtacagtttggctgtggctcaccacactcttctcaaggctcttcagtattgggatggatggcaagaattgcatttattttctcacttcttttgtttaaggtgctgagtcagattaagagatggcact

SEQ ID NO: 150682 - DNA, 601 bp, Human
cttccccatcccatcctcctcccccacccccagctgcacagctgacaacttcaaacatttaattactgatcccctcatcccctaacaatcaatagttggcatcccccaaaatcaaataatattcaatgtgcagagctgtatttgttttcacataacactgcagggaaattaaagataactcatcatgtgaatcaggttctctctttatgattaagaagtgactgccacttccatgcacatcctaggggttacctaacgtggctctaaaatgtccttggcaaatgttcttactgcttctccrattacattaaactatggattgtctaatgattctttggaaaaatatacttttatgataccttgaatgctaaaaaggattcttgttatttatgataaattacttatcttttaacaatagaaatagtaacatgtattgagggcatacaccatactagacaaggtcctaggtgctttatatacataatccatttcattctcatagtaagtccatggaggtaagtaccattattatttctcatgttttatgtagaggagaacaatgacattctgatagaatgggtgacttgactaaagttacaac

SEQ ID NO: 150683 - DNA, 601 bp, Human
taagcctttcactagtcacagcaagagtacatgcaaggatctaagcaaacaaagctcttaggctgccttgaaacaaaacctgtctgtaccatcatactaaattcccccagcctatttcaacactggcaatgaaaacatggcatttttcaccttgactttactttcaatgtgacaaggcagtgtctaacttcagggcattccgtggttatgaaatcttgacacctcacctactgtgggaatgacatgttgaaacagtttctccattctctgaggcattttcatattaagctctggtgaatgrgtattaatgagatggtcattggagtgtcaggcgggccgtgtctcttctttttctgtctctctccccctgcccttccccatcccatcctcctcccccacccccagctgcacagctgacaacttcaaacatttaattactgatcccctcatcccctaacaatcaatagttggcatcccccaaaatcaaataatattcaatgtgcagagctgtatttgttttcacataacactgcagggaaattaaagataactcatcatgtgaatcaggttctctctttatgattaagaagtgactgccact

SEQ ID NO: 150684 - DNA, 601 bp, Human
agagagccaccaacttaaaatatttccacatacttccagctgaaacttcacaggctgctttcattttttacttagtttctaacattatgatttctgaaatttccacattagctcatcacttcaaaatgcctttaatgccaatatatcaagcccatcatcaaacagatcatcttacatatttgtgcagtgtgtgaggctctaagtgaacactttctacaaagggaatttttatctacatccccaagtagaagagagattgtgctgtgctcctttccttctcatggaaggtttactaataatwtcattgtcatctttaagcctttcactagtcacagcaagagtacatgcaaggatctaagcaaacaaagctcttaggctgccttgaaacaaaacctgtctgtaccatcatactaaattcccccagcctatttcaacactggcaatgaaaacatggcatttttcaccttgactttactttcaatgtgacaaggcagtgtctaacttcagggcattccgtggttatgaaatcttgacacctcacctactgtgggaatgacatgttgaaacagtttctccattctctgaggcattttcatattaa

SEQ ID NO: 150685 - DNA, 601 bp, Human
taagtgccctacacaagtaagtgtgccatttttaatatttttttttttttttttttttttttttttgagacagagtttcactcttattgcctgggctggagtgcagtgaagcgatgttggctcaccgcaacctccgcctcctgggttcaagtgattctcctgcctcagcctcccaagtagctgagattacaggtgcctgccaccacacccagctagtttttttgtatttttagtagagacagagtttcatattggccaggctggtcttgaactcctgaccttaggagatccacctgcctcrgcctcccaaaatgctgggattacaggcatgagccactgtgcccggccatttttaatcatttatatcatatttttactatgctttttctatgttgagatacacaaatgcttaccattgtgttatgattgcctacactattcagaagagtaacatgctgtacaggtttatagtccaggagcaatagcctataccatatagcctaggtgtgcagtaggctataccaccccaggtttgtgtaagtacactctggtgttcacacaaggatgaaattgcctaatggcacacttctcagaacatatc

SEQ ID NO: 150686 - DNA, 601 bp, Human
gcatagttgtgtgtttgtgttttaagctaaatgttattacaaaacagtcaaaaagttaaaaaaattaaaaagtttataaagtaaaagttatagtcagctaagcttaacttattattgaagaaagacttttaaaaaataaatttagcatagcctaggtttacagtgtttatagcagtgtacaataatgtccttggccttcacattcactcactagtcagtgactcacccagaacaactttcagtcctgaaagctccattcatggtaagtgccctacacaagtaagtgtgccatttttaatatttttttttttttttttttttttttttttgagacagagtttcactcttattgcctgggctggagtgcagtgaagcgatgttggctcaccgcaacctccgcctcctgggttcaagtgattctcctgcctcagcctcccaagtagctgagattacaggtgcctgccaccacacccagctagtttttttgtatttttagtagagacagagtttcatattggccaggctggtcttgaactcctgaccttaggagatccacctgcctcggcctcccaaaatgctgggattacaggcatgagccact

SEQ ID NO: 150687 - DNA, 601 bp, Human
tgcatagttgtgtgtttgtgttttaagctaaatgttattacaaaacagtcaaaaagttaaaaaaattaaaaagtttataaagtaaaagttatagtcagctaagcttaacttattattgaagaaagacttttaaaaaataaatttagcatagcctaggtttacagtgtttatagcagtgtacaataatgtccttggccttcacattcactcactagtcagtgactcacccagaacaactttcagtcctgaaagctccattcatggtaagtgccctacacaagtaagtgtgccatttttaatmtttttttttttttttttttttttttttttgagacagagtttcactcttattgcctgggctggagtgcagtgaagcgatgttggctcaccgcaacctccgcctcctgggttcaagtgattctcctgcctcagcctcccaagtagctgagattacaggtgcctgccaccacacccagctagtttttttgtatttttagtagagacagagtttcatattggccaggctggtcttgaactcctgaccttaggagatccacctgcctcggcctcccaaaatgctgggattacaggcatgagccac

SEQ ID NO: 150688 - DNA, 601 bp, Human
tgtcagttgtataaaagtagagcacataccgttatgtacagtatgtgatactcaatcatgataataaatgactatgttactcgttatgtatactatactttttatcattatttcagagtgtactccttctgcttataaaaaaaaagttaacctttattaaaaagtctctgggttgctgagcacagtggctcatgcctgtaatctcagcactttgggaggctgagacaggtggattacctaaggtaagaagtttgagaccagcctgggcaacatggcgaaaccccatctctactaaaaatayaaaaattagccgagtgtggtggcaggtgcctgtaagcccagctactcgggaggctgaggcaggagaatcacttgaacccggaagactgaggttgcagtgagccgagattgcggcactgcactccagcctgggggatagaatgagactccatctctcaaaaaaaaaaaaaaaaaaaaaaaagcctctgggttgataggtacagcaaaccactatggcacacatttacctatgtaacaaacctgcacatcctgcacatgtacctcggaacttaaaataaaaaatttaaaaaagcatcaggtt

SEQ ID NO: 150689 - DNA, 601 bp, Human
tcatagatatgccataggaatgtgataagtaaactaaataatttaagccacacgtttaacacagtatctgacacaagctaatgcctataaaaaactagctgttaggatttcaatcgtagtcatatccactcaataaggttaatgtgacacttaaatgtgataatgtatataaagcccaaccaacagtacccgaaccttaaatgttacctcactcttcctgcatcttggttagccacctgcatgtatcacatagtatttttaaccaatagtatcttctgtatattggctttttttttttttgagatggagtctcactctgtcgcccaggctggagtatagtggcatgatcttggctcactgcaatccccgactcccgggttcaaacattcttggctaatttttgtatttttagtacagatgggattcaccatgttggctaggctggtcttgagctcctgacctcaagtgatccacccaccttggcctcccaaagtgctaggattgcaggtgtgagccattgcatccaacctctatatcagctttaatatttaccagtctccaagttcattaggtgacttgctaccatactatcatttcacaa

SEQ ID NO: 150690 - DNA, 601 bp, Human
agctcagattccatctgtgacagcagaatgttgtagaattcagctattaatagctgctggtacacacttactcagagctaagaggcccaaggctgtagagacagccagatggagataataccagagagtgactgtatggacaaaaaggatgatctttttccccccaacacaaaacagacaacactaaaaacatgacaatcctgttttattgcaagccaaactctctgaagaatttttttccccctctttggaattcttaggtctggttctaaatcacatttgatttatcactgtttctgaygttcaaataactccttacacaggttataaaaccaaaaacatccagatgagttaacaaccattatttagtaaaatgataccaagtaaccacacagaaaatcaggaataatacaatttggctattattcaaggaaaaataaactttgatacaggacagccttccgaatcaggaatattttccttaacatagagaagaacgggtaagtgagctgaataatacagacctttttatggaaagaaaaaattttttaaaaaaacctgcttaatgtgatttagagtgattatggctttagttcatctt

SEQ ID NO: 150691 - DNA, 601 bp, Human
aggggaaaaagaattgggagtctccatggcctagttgaagagagagagagagagagagagagacagagacagagacagagacagacaatcatgtacgctttctttcatggtggcgtcctggctgctgcaatagttgcaactcaaggaggttaggagcagccccctcctgcatgatcatgcattatcccatgaattctaccatccataatgcacattctctagttgaaggttttattttcccttttctttgttgtaatggaattttctattataccctaaaatattacttttactttttttwaaaaaaaaaaagacattctcttgctgtttcacatatagttcttagattaatactcagatccatttaacatcataaaagagaaacttctgtatcaatgaccaaatcagtgggtgagatctacaaactagaatcagggctggtgcattgctttcagaatgttccttatttatagacagcttaattgcattaagtgccaaagaatgtactgctttctttgtaatgagtttttatggtcttagtgttcagaagctcagattccatctgtgacagcagaatgttgtagaattcagctattaatag

SEQ ID NO: 150692 - DNA, 601 bp, Human
cttgctcaggggaaaaagaattgggagtctccatggcctagttgaagagagagagagagagagagagagacagagacagagacagagacagacaatcatgtacgctttctttcatggtggcgtcctggctgctgcaatagttgcaactcaaggaggttaggagcagccccctcctgcatgatcatgcattatcccatgaattctaccatccataatgcacattctctagttgaaggttttattttcccttttctttgttgtaatggaattttctattataccctaaaatattacttttactttttttaaaaaaaaaaaagacattctcttgctgtttcacatatagttcttagattaatactcagatccatttaacatcataaaagagaaacttctgtatcaatgaccaaatcagtgggtgagatctacaaactagaatcagggctggtgcattgctttcagaatgttccttatttatagacagcttaattgcattaagtgccaaagaatgtactgctttctttgtaatgagtttttatggtcttagtgttcagaagctcagattccatctgtgacagcagaatgttgtagaattcagcta

SEQ ID NO: 150693 - DNA, 601 bp, Human
taaatcctttaattctgtcggtaaatactgggaaggaaaggggatcatggagaaagagggcccagaaatagacattaagccctttttccgtcgtcttcctacactttagtaatattaagacagttccttgagaaagagagcaatctctgccttgctcaggggaaaaagaattgggagtctccatggcctagttgaagagagagagagagagagagagagacagagacagagacagagacagacaatcatgtacgctttctttcatggtggcgtcctggctgctgcaatagttgcaactcarggaggttaggagcagccccctcctgcatgatcatgcattatcccatgaattctaccatccataatgcacattctctagttgaaggttttattttcccttttctttgttgtaatggaattttctattataccctaaaatattacttttactttttttaaaaaaaaaaaagacattctcttgctgtttcacatatagttcttagattaatactcagatccatttaacatcataaaagagaaacttctgtatcaatgaccaaatcagtgggtgagatctacaaactagaatcagggctggtgc

SEQ ID NO: 150694 - DNA, 601 bp, Human
atattactgagggtagaagagatgacacaagcagttaatctgatttaataaatcctttaattctgtcggtaaatactgggaaggaaaggggatcatggagaaagagggcccagaaatagacattaagccctttttccgtcgtcttcctacactttagtaatattaagacagttccttgagaaagagagcaatctctgccttgctcaggggaaaaagaattgggagtctccatggcctagttgaagagagagagagagagagagagagacagagacagagacagagacagacaatcatgtaygctttctttcatggtggcgtcctggctgctgcaatagttgcaactcaaggaggttaggagcagccccctcctgcatgatcatgcattatcccatgaattctaccatccataatgcacattctctagttgaaggttttattttcccttttctttgttgtaatggaattttctattataccctaaaatattacttttactttttttaaaaaaaaaaaagacattctcttgctgtttcacatatagttcttagattaatactcagatccatttaacatcataaaagagaaacttctgtatcaa

SEQ ID NO: 150695 - DNA, 601 bp, Human
agagaagtgaacaaaaccaatatagtcttgccctcatagaatccacattctaacaaaatgagaaaataaaggaaatttctcccattcatttatataataagtattgataaagtatcgactccatgcacagcattgggtttcactttcctggctttgctgctctgatattactgagggtagaagagatgacacaagcagttaatctgatttaataaatcctttaattctgtcggtaaatactgggaaggaaaggggatcatggagaaagagggcccagaaatagacattaagccctttttcygtcgtcttcctacactttagtaatattaagacagttccttgagaaagagagcaatctctgccttgctcaggggaaaaagaattgggagtctccatggcctagttgaagagagagagagagagagagagagacagagacagagacagagacagacaatcatgtacgctttctttcatggtggcgtcctggctgctgcaatagttgcaactcaaggaggttaggagcagccccctcctgcatgatcatgcattatcccatgaattctaccatccataatgcacattctctagttgaaggttt

SEQ ID NO: 150696 - DNA, 601 bp, Human
atatcataggggcttatgtgcatgcttggaataactacagtaataaaaatatgacctagctgaattgccagggaattaggagaaattttcaaatctctagttcaaggagataagctatgctcctaagtgaatttattttatttcagatgagaatcactttcaaagtaccattgggagatttgtgtttgtaaattctgttctcagctacaacaaaaaatgtagcacagaccatagatcaaggcatagagtaaggtaaaatacaatacgaataaaagggaaagagcacccagaacacatcggatattttcaaaatgtcttatgtaaagactgaggcattatgcttcagcacagagctgagaagaaatttgcatgaaccctttcaagagcttgcaagctgccttaactccatttatttatgtatttttcaggaatgtttattgtggtagatgttagggatagagaagtgaacaaaaccaatatagtcttgccctcatagaatccacattctaacaaaatgagaaaataaaggaaatttctcccattcatttatataataagtattgataaagtatcgactccatgcacagcattgggtttcact

SEQ ID NO: 150697 - DNA, 601 bp, Human
tctcctccaattcagaacaggcctatgggaatgaaggatccatctcatgccaggggaatcttatgagttatagatataagaagaatttcacttgaaagaaagtagagaagtgtagaagctgtaaaatttatatccggtaaataattcaaagattaatacccaaagtctcagtcatctctaggctcatcatcattgccacttcctcggtacttggcatttcttttttaaaaatgccccagtcatgatttaatctgaacacattctctttaaatgatctaggaataattaaatatcctgcccracataataaagggtggcagagacaaaacttgacatcggattattctgaattcaaattctcaaccatcatgcctacagccttctaaatctaaatgagtcttctaggtataggttaaattaggagctggccaaaacttcttggatcccttattctgaagtagaaccttagagagcctaagtctagcattttagagaccaccctgaaaataagcttttttaggaggagggggataagggaaaatttgctttgtgaatctaacccaagataatcttcagtttccatgatgtaacaaaccagagg

SEQ ID NO: 150698 - DNA, 601 bp, Human
ttggctccctagggtaccttcaatagctatagaattagcatctattgcttttcatttggttcttatcatcacagaagagggttggccatacatagaatagttgagttttgggggaaagcattgggtaagaggaagggagtatgcactagaaaaagtagactcatgacacacactgtggtagagtggtaatttttgaaacgggctttaacagagatagaaagaaaactgtatgaaaactcttcataataattaattaagcctctcttagtcctaaattgagaaaaatgcaagaatcaatacttttttttttttttttgagatggggctgaagtgcagtggtgcaatctcggctcactgtaacctctgcctcctgggttcaaatgattcttccacctcagcctcctgagtagctgggattacaggtgcccaccaccacacctggctaattttttgtgtgtgtttttagtagagacagggcttcaccatgttggccaggcttgtcttgaactcctggcctcaagtgatccacccgccttagcctccccaaagttctgggattacaggcgtgagccaccgcacccagccaaaaatcaataatttt

SEQ ID NO: 150699 - DNA, 601 bp, Human
catatcactacctatggtggacttgctctgtggccagagtttacttcttcttcttcttcttttttttgagatggagtcttgctctgtcgcccaggctggagtgcagtggcatgatctcgactcactgcaacctccacctcccaggttcactccattctcctgcctcagcctcctgagtagctgggactacaggcgcccaccacaaggcccgcctaattttttttatttttgatagagacggggtttcaccatgttagccaggatggtcttgatctcctgacctcgtgatctgccctcctcrgcctctcaaattgctgggattacaggcgtgagccactgcacctggcccagagtttacttagacggcacaccacataacgagcagaacgtgcactgagatgggaagaacagattttccaagtagtttaatttcgagaattaacttaaaaattatctggtaacctcattcctaatgtcatagtgccacgtccactttaaagtttaaaatcttggaaatggattcaatcatccatgacaaacatatgttgttcttctcaagcagaagtataaaataattcttctccctaactttctgaatttt

SEQ ID NO: 150700 - DNA, 601 bp, Human
tatcacaatgtactaaggtttgctagccctgcctctaggcttagccctggagtcctaaaaagcagcagaacttaacagcacaggctttgggggcaaacagagttggggtgaaacctcagtcatctcttactagcttgggaaagtaaattccctaagcccccttttttctcacttcaaaaaaagataatagagttgaaattagaaataagtgaaaaaattctaactaacactcagttaagactcaataaaatggcaactattattaaaactatttagacctcatgtgcctagtactctgccaaaaaaaaaaaagcttaattacatgaatggatttaactttcagctggttcagtgtcataaaaagcatattcaagtatgatgccacattgtaaattcccatttatgcaaagtaagcaaaggaactactaatattcatattcacattttaccaatggcaaaatacacactgacaacgtaagtaactgtgttcagaacacacagtgaatccgtggcccaagtaagactagaactcagcctttgagtgttatttccgtgtaaaacattgtctcacatttcaaaaatgagtccatctaaaaatgat

SEQ ID NO: 150701 - DNA, 601 bp, Human
gtggtacattcagccacaccctggcttctcaccaggtcactcaccacacatcgcacacaacacaaccttctcacatactaaaaaatatccacagagaaacacacacaatacacaatctccaacacctatatatatatccacagacaacacgtgcacatgcatgtgcttacacacatgtacaattgcacaaatcctcaaatacatcaacccacctgccatcccttaataccatactcttctctcccatttctagatgtctcttaaggctatttttatcttctgagacctcctttcttcactrtcataccacccattaatgcccccttgaagctctgatttatccttgtagatcaagctcaaagcatgagcccaccctcccatgaaacagctaagcatggctctcccttctctggttgtcacagcactttgtggatgtatatcacaatgtactaaggtttgctagccctgcctctaggcttagccctggagtcctaaaaagcagcagaacttaacagcacaggctttgggggcaaacagagttggggtgaaacctcagtcatctcttactagcttgggaaagtaaattccctaagcccccttt

SEQ ID NO: 150702 - DNA, 601 bp, Human
ttcctaggactccatccgtcaaattgccaacctagagacacaggattcattctgagcacttctcagctgcaccattgacctagatagaagccctactaattctatctcaaaatatccctctcataaatctccttttccacgccatgccctctgcactgcgctagtcctgggccataccatctctcaccaagattagtgcatcgccttctaataggcctccctccttccatcattccgcctccttgacagtggtacattcagccacaccctggcttctcaccaggtcactcaccacacatcrcacacaacacaaccttctcacatactaaaaaatatccacagagaaacacacacaatacacaatctccaacacctatatatatatccacagacaacacgtgcacatgcatgtgcttacacacatgtacaattgcacaaatcctcaaatacatcaacccacctgccatcccttaataccatactcttctctcccatttctagatgtctcttaaggctatttttatcttctgagacctcctttcttcactgtcataccacccattaatgcccccttgaagctctgatttatccttgtagatca

SEQ ID NO: 150703 - DNA, 601 bp, Human
caatcagaatgacatttaaggtacttatgcaaatctcctctttcccaaggtaaacattcccaatgtcatcaaccagaaagcctaagacatttttctcttccccactgacttggacacctggcctagatgctcaccacttaggacagagatgctacctccatcccaccaccaccatttttaaaactttgatgataaatgtatttatatgcaaataaatttgcatatatttatagtgtacagtgtgatcttttaatatatgtgtgcattgtgaaatggtaaatcaggcaaattgatatttccrtcatctcacacaatttttttttattgtgagccttttcccttttaatgtagatcctggaacaggatttgaaaaggctccaatttgttgcataaaagtctctaactagggtttttaatgactaaagtaacataggcttgttgtaaaatatttttcaaaaatttatggaaactcgtaaaataaaagtctcccccatttccaagctcattttcccaaggcaatcactattcacaacttagtggtatgcgccactttacatctctcatctaggctcagtttcatttctttgaccaacggtcaaat

SEQ ID NO: 150704 - DNA, 601 bp, Human
tggtcatcttctataatagagtttatgcgcctattaaacattatgctaaagagcatagaaaaatatccatatcagaatattaaatgaaatcacattacaaaatgatgcattcaacatgatttcaattttatttaaaactgatttgagtaagtagaaaacttagcatgaagactgcattgtccaaaaattacttcaataatcaaataaaaacacaggttttttattaaacatgatttcagaaattaaaaatttaagattgtagctcctttaacattgaagagtcttttgtcagtttttaaartcagagacccatatggaggagctgattccaaaatccatgttctaattccttatcccttctccccaagatttgaatacagtcagtttgggtggggcctgagcatatttttaaaaagactgtcaggtgattttgatgaataccagtggttaagaattaaactagacagatttctatcaatgctgtcaaacaacatataccttttcttggcagctgcatgactttttgacttcctcttggagttaaccaagaccctggaggcttgttgtgatgagcgttgctcttgagggctactcccctccc

SEQ ID NO: 150705 - DNA, 601 bp, Human
atcaggaaagaacataagaccccagaggtatgacaacatggaaaaaccccaagtcaaaagtcaaactgcgcacttgatctctcaagttgtctgcttggccctcttccaagtgcactttccttcctttcacccctgccttggtctctccttctgtcttatgcccctcagttgaattctttcttctgaggaggcaagaattgaggttgctgtagacctgtacagatttgcctctggtaacatactttggtgccacgtgactcagatacgttccgctgctaacacttacagtagaaggagacayggaagccatctatcctacttctgcagagctggaatctccttcatatcatccctgaaggatgtgcatgctggcactgcctacactagtctgctgggggaaatccaatgcttccagcaaggtccattctcttccttgtgaactggattatgaaagttcctcctcttaacaagccaaagcactctctgctgttaacatcatcactggtcttaagaccttctggagttaattacaaaacccggatttcctcttccaatgtatattcattcaacactcctgcacacactttcattgtatgcttat

SEQ ID NO: 150706 - DNA, 601 bp, Human
agtgcctagtgcataggaagcacctaataaatcttagccttttaataatcattaaaaaaaacccctctctttacacacaaacacacatacctcacataccaattcaacttctacaccaacaattttggagttacattatttggatgcatatttttgaaaatgtcactaagaataaatattacctcatgcccaacctcaggagcagcttcttcaagcacagttacctataaactttgtaccaaatagtatgcccctccaaaaccaacagacccttctttgtagaagtcaagtggaagcaacrcttagaggtatgaatcagtgtgtcgctcggttccatggagacaaatccaagtaggcactggcagctgtccgggtcctcagtgagctgaagcaggccacatggcaagataatttttaaagtttcttagcatcaataaaacacctcctttttaagagctccatctcttaattcaaagtcgaaaccttctattttccactgctctgctccgctgctatttcagttattagaacacctgctgtctgaacgagtttgcctcccaaatagccgaataatcaaaagatgaggagacttgcttaagca

SEQ ID NO: 150707 - DNA, 601 bp, Human
gtgtgtgtgtgtgtatatgtatgtatatatatatatatatatatatatatatatatatacacacatttccattataaaaccatcagattgtgtgagacttactcactaccatgagaacagtatggggaaaaccacccccatgattcagttatatcccgctgggtccctctcacaacaggagggaattatgggagctacaattcaagatgagatttgggtggggacacagccaaaccataccagatggggaaactcagatagagcaagtaatttgcccaaagtcacacatctggtgaatcayccagccaggacatatatatatctacatatacatatactatgaatgaagctatatatatagtgtgtgtgtgtatatatatgtatatatgctatatgtagagtatgaagcagtgcctagtgcataggaagcacctaataaatcttagccttttaataatcattaaaaaaaacccctctctttacacacaaacacacatacctcacataccaattcaacttctacaccaacaattttggagttacattatttggatgcatatttttgaaaatgtcactaagaataaatattacctcatgccca

SEQ ID NO: 150708 - DNA, 601 bp, Human
aatagccaacaaactgggagtcctaaaacttgaccctgacttcaagttcaaagacagcatcctagaagccggggctctggcgtgtgttgccagccttgccagccttggctctcatggttcactgtgacaactcctcatttctatcaggggaaagaaagtccaatcaggcaagttttatttcctctctgaaataaaacagaattgacttgccaaggtatctgcagggacatcaactgttgggccttaaattacctggtaactcttctagtcaattctactttcatgttggagtttgcaatcmacatttatctctataggacagaccgtctgcaggtttctaataccatttttattattaccttgtaaatgtaaaatcctcgaggcagaaatgccagctgctaacactggtgtgtgtgtgtgtgtgtgtgtgtgtgtgtgtgtgtgcgcgcgcacccacttctccagtgatgaatgtccttgggtcctggagtttccaacagcaacaaaaagacataccaaggacttgcctagaaattatgtattgtatggatccaatgtcaggggctttgggggcagctttctctagtagacctgctgagac

SEQ ID NO: 150709 - DNA, 601 bp, Human
gcaaggagaaggatttaattgcagagagtgattagccaaatgcttagatcaatagaatgcaggtcaaactgtgctcagaaatatccatggctcttattacatagaaagttgaggacacagaaaccatttggggaccctgagccatttgtgcatgaagtcatctgcaaacctttccctagaccgcagaagcatccttctctttacccagcaatgatggcatgctgactcaaggaacattcacccctccccccaactcttggcattagagaaagtcaataaaacagctgggatccttgaatgytgttttcaaaagtagagaaaggatcctgcctggtctagctctttgttgtctaattgcaacaaaaatcaatggttttgaaaatggaaagcagatagatcattcctcatttatccaagatatttgagcagaagatggagtgacattgtctaacatgctttaatttttgctctcaccaaagccctctttattcaatgagtctgtgtttgcactgttcttatgaagaaattcattgatagcaatggaatatggtaaagcagatgagcctgtagtacaaattgcaccctaggaaaaaaatggagt

SEQ ID NO: 150710 - DNA, 601 bp, Human
tttaatcctcacaataacccaatgaagtaggtactttcatctctgtttttaaagatgagaggaatccgatgcttagagaagaccagtgacttgctccaggtgtcactactagcatctggcagacccgggactggaacccaaggccatctgtgtacaaagtttgtagttctgttgcctgccctctcccctccatcccctctaaccctgctctgatccattgccttttaaattgactatattttcaataacaacataaacaccttgagagccagggttgtgacttgtcactcaataaatattygccggatggattactgactcttctgatgttgtttagaaagacaaaatcagaatctgtttagaagcaatgaggagtcccttagaaagcttaaactgaagtgaggatggagactgtggattttctgatattattatatattagacatgaatctcttcaaactggaacaaaaactggtaaacagaataattgcaaaatatgtgccaatggccttgaaatcaaagaggagcaggtcgcctgaggagaagcatatgtttaatgcttcacactccatgatgagtcctggagaagaaatgaggctgg

SEQ ID NO: 150711 - DNA, 601 bp, Human
gccctatgacatgtgcagctcctaaaaatataaggaaagcttagcccagtcaccctggggtaatggtaaggaatacaagaccaagttaggcatccctgggttaaagcctgccatttataaactatgtggtttttggcaaattattttgcatctctagaccttggtttttctatctgcaaagtagggagaaataacagtgcttgcttcatgtagttgttgtgaggaaatcaggtaataattatatagttaagctggttgggcacggtggctcatgcctgtaatcccagcactttgggaggcygaggcaggcagatcacaaggtcaggagataaagaccatcctggctaatacggtgaaaccccgtctctactagaaataaaaaaaattagacgggcgtggtggccagtgcctgtagtcccagctacttgggaggctgagggagaagaatcgcttgaacccgggaggtggaggttgcagcgagcagagatcatgccactgcactccagcctgggtgacagagggagactctgtctcaaaaaaaaaaaattatattatataattataattattgctaacatttattgagcactacttcctatgc

SEQ ID NO: 150712 - DNA, 601 bp, Human
gttcttagagcaaatcttgttttctagcgatgaacatatttctccttgtctttgacttagatgttatttgcactagcctaatttaaattgttaacacagtacaaattttaacagaaagacagaaagagaatgaatatgaaagatttgggctgctgctggtgatagtggggagctctatttacttttggttaaatgccagtgctgtaagagtccaaggtcagtaaaagaggtgtgaaaccaattagggtttctcagcttctggctgctggaagatatgcatattgcacacccaaaatatacrgttttgtaaggaggtatcgacaggctacagtcactctgccatgctgcacaatggcatggtgccaatctagcctgagacaacacatgtccactcatgagttttgggttaaaagtgctgcaacccaaaagaacagaggtgaacaaaagagattcagcaagactgggaatgaagcatgaatcacagatagaggagatcaccatcaaaagcttaggaaaaaatctgccaaagctatatagctctctgctaatgactatgattgtaatttctgcatattttaacagatgttctgtttataaaact

SEQ ID NO: 150713 - DNA, 601 bp, Human
caatacatctaagaaataggactgtatcagtgatgggggctctgaagggaataaagaggaggtggtataagataatgataatggattggatttaatattaaataggtggtcagggctgacctctctgaggagtgacaactgagcctaaatgtgaaggataaaaagaggccagacataagaatgtctgtggataaacctttccaagaagaaaaaagagagatgtgcaaatggccggatgtagcagatggtcaggcaggcaggggccagatcagggagacagagaacataactaggtctgcarggataatgggtagaggggcaaagtctcagggaagttgactgaaatgcagaggtaaaatgtaatcacaacacaagggccttgacatgccccatctctgggggaaatgttctcaaacactagccctccagggggcaggaaataatgtagtctagttaattgcccttcgggactgctctgtgtatgaatgtaaaactagggattatccagccccagatgcaaatgaaaagggcacagtgggtcactggttttcctgaagactcttctcacttgagatagaagtgaaaatgccaattaccctca

SEQ ID NO: 150714 - DNA, 601 bp, Human
tggccactgttgagatcactgtgaggcttttgttttgctctgtagggtggaatccgagggcaacagctgattgtgtcttgacaaaagagtaggaaggaggatttctgagtgaatatgtgggtggaaaggcaagagaaaatagccaaaaacttggggggcaaatgggtaagacttggaaaagaaaaaagatgttgggtatgtgacataaccctttcagtctctccataaaactttcagtaacatgttcactatcatcaatgattttagaatcgagtaacatggtcagtattaataatatagytatcacacatgcttaacatagagaagcaaatataaatacaaaaatacaacaaaatctctggagcagtctcaggtgaaacagccaaagaaataaaaccttatacttcaacatgaaaatcactcaaaggtacttggaaaacactgttgatttacgcaaagacatttactgagcatttactatgggcctggtgatgttatggcaaacgagacagtcacgggcatggtccctgccctcaaggagagagaggcaatacatctaagaaataggactgtatcagtgatgggggctctgaagggaata

SEQ ID NO: 150715 - DNA, 601 bp, Human
actgagtctagctatattttgtcttggaggaggaagaaaaataaatccatattagactccaaaaaatatagcttggcttcaatctcctctgcccaaattttggggataatggtaaattccacactcaccagccacattttttttttctttagcacaccctggtttaaagaaaaaaaaaaagggaacagtaacctccaaagtagggaggtttaggttggacagagcaacctacaatcttaacattaagtaatttggaaaattactttaaaaatctacggtggggctgggcacagtggctcaygcctcccagcacgtttgggaggccgaggtgggcagaccacctgaggccaggagttcaagaccagcccagccaacaagacgaaaccccgtcgctactgaaaatacaaatattagccaggcgtggtggcacatgcctgtaatcccagctacttgggaggctgaggcaagagaatcccttgaacccaggaggcagatgttgcagtggtccgagatcgtgcatcattgcatttcagcctgggtgacagagaaaggctctatctcaacaacacaacaacaaaaattatggtgaagggtactcttt

SEQ ID NO: 150716 - DNA, 601 bp, Human
gcaggctggaagggaaatatggcaacctggaatactcctacatgatctacagggtgatcactattggccaactccagctaactgtggtcatgaaggttgtatgtacacactgtggccacaggatcagatttgtcaagggaagatagacgcatagatttttttaacatttaaaaattgtatgtttttcaaatgttggcagctcatttaaaatattttaactggctgaacaaaagccttctgtagggagagttcagatcttgggccaccagagctcttccttcctttcctctcttttctcttytctcctctcctctcttttctcctcccctctcgcctctcccctctcccttctctcttgtcttctctttcttcttgagatggagtctcactgtgtcacccaggctggagtgcaatggggtgatctcagctcactgcaaccttcacctcccagattgaagtgattatcttgcctcagcctcctgagtacctgggactacaggcgcacaccactatgcctggctaagttttgtatttttagtaaagatggggtttcaccatgttggtcaggctagtctcgaactcctgacctcaggtgatccac

SEQ ID NO: 150717 - DNA, 601 bp, Human
atggatatcccaagttaccctgatatgacgattacacattgtatgcatgtatcaaaatatcacatgtaccccataaatatgaacaattactatatatcaataaaactataataaacggaaggaaaaaaagaatcactcaagatatgtagaatactattgagaaggactcatttcaaaggtcatttctgagctttaggataactctagacactgtcccccaccccacttttctgtgatacacacatcaggaaacactactttaaatgcattatcatggttcacccaggttgccaagtgaagygctcctggagacagtcagccaggtgccaattatgaagttggcaccttcctgattatcccacatcctgataaggaagacagatgctgccacttcctgaaacccctggctgtacccacctgggcctcctgacaaccaccaactatcactgaagtgctgttcatgggggccaggttacttccagacaatttaagatatttacattgccctctgctttctccgagctcttaatttataactcctttctgtttgtgtataaacccttttagtcctttgcccatattaatccttcttggtatcatt

SEQ ID NO: 150718 - DNA, 601 bp, Human
gggagaataaagagaagtagattaatgagtacaaaaatatagtcagatagaagaaataagttctagtgttcgatagcacagtagggtgactacagttatcaataatttgttatatatttaaaaatagctaagagagaagatttggtatcttctcaacatgaaggaataataaaatctttgaggtgatggatatcccaagttaccctgatatgacgattacacattgtatgcatgtatcaaaatatcacatgtaccccataaatatgaacaattactatatatcaataaaactataataaayggaaggaaaaaaagaatcactcaagatatgtagaatactattgagaaggactcatttcaaaggtcatttctgagctttaggataactctagacactgtcccccaccccacttttctgtgatacacacatcaggaaacactactttaaatgcattatcatggttcacccaggttgccaagtgaagtgctcctggagacagtcagccaggtgccaattatgaagttggcaccttcctgattatcccacatcctgataaggaagacagatgctgccacttcctgaaacccctggctgtaccca

SEQ ID NO: 150719 - DNA, 601 bp, Human
gtagtgcacacctgtaatccctggtacttgggaggctgaggtaggaggatcacttgagaccaggaggtggaggctacagtgagctttgattgtaccactgcactccagcctgggcaacagagtgagaccctgtctcaaaaacaaacaaacaaaaaacaaaaacaacttaatagcttaagttggtgaaacaagaaatagaagtttcatggtgacatttaaacttacaaaggcaagcaacggaactaaaataataactagcaaaaatcagaatggagtaatttttaaaaagtcagataagttwtggaagtaaatccttatttttcacagttgaggagttaatagaaatatattaaatgtatatatcaagaaatagtgatatatgcatgttctcactgatacatgggagctaaaaaagttgatctcatggaggtagatagtagagtggcagttgccagtggttgggaagggcataggggaggggagaataaagagaagtagattaatgagtacaaaaatatagtcagatagaagaaataagttctagtgttcgatagcacagtagggtgactacagttatcaataatttgttatatatttaaaa

SEQ ID NO: 150720 - DNA, 601 bp, Human
gttgattttaaaacattgtccatttttctagttaaataaatatttccacatcagaaaagaaggttctattatgttaactttacagaatatcagtttcctggtgagttcagaatcagacatacttgacttgtcagaatcatgaaattgtaggattagacatacataagttagataccaatttacaaaggaataaaatagatggagtatcaacttttggaatatatgattgcgaagaaaaaagcaaacagaaaataagagtcacccaagagtgcatcacacccatggagaataaagtacaatygtagcactccattttacttagcaataaataaaaagtaaattgtttaaatattatttattgcttttcaactttatgagataactcattgaataaaccctcaaccttaatagtggttacaaaagagaatataaacacaatcaaccctgatgatataaaaggagaagagtatagaaaaggaggaaggaagtgggagctaactttctcatctgacacagtgggaagtcaagataaaatagctggccaggcaccgtgtctcatgcctgtaacccaagcactctaggaggccgaggcaggcagatt

SEQ ID NO: 150721 - DNA, 601 bp, Human
aatctgtaatgtatataatatatacagtctgtaggttgctcttaaatatactattaaaagtgctagttcaagttggtaaacatatcaatacaatttctttttgtgtggctctcagctcttcagaaggatgactgccgtgttgattttaaaacattgtccatttttctagttaaataaatatttccacatcagaaaagaaggttctattatgttaactttacagaatatcagtttcctggtgagttcagaatcagacatacttgacttgtcagaatcatgaaattgtaggattagacatacrtaagttagataccaatttacaaaggaataaaatagatggagtatcaacttttggaatatatgattgcgaagaaaaaagcaaacagaaaataagagtcacccaagagtgcatcacacccatggagaataaagtacaatcgtagcactccattttacttagcaataaataaaaagtaaattgtttaaatattatttattgcttttcaactttatgagataactcattgaataaaccctcaaccttaatagtggttacaaaagagaatataaacacaatcaaccctgatgatataaaaggaga

SEQ ID NO: 150722 - DNA, 601 bp, Human
atttttttaagacactcctctaacacaaagcacccaaaaggaacttcttggaggtggatgcttgtctttgcaatggtcaacagatacaagattgcagacaacgcatttgtaagtctctggcagatgttatgagaatttcccatgaaccagaaatgaagcctctgaggaacaaggacctgaatcactaaatatcaattccatcccagagcactgcagaaattttgctactgtctgatcgggggataggaagagcaagaaggctgtgcttctgcctcggagaatgatgttattaacttatcayattagaatatcaaggaagatcagagtatgtatatatctttgtgtgtgtacctgtctatatgagcttagcacgtaattcccagacctacaaaacttggcacacaaaggaagcagaagcaccgaaatagtgaaggattgactggagtaccccaaaatcttatgcaataaaaagaacctcagctggttaacattttaccctttctctctttaattgtgaataataacattgaatgtttcagcctatttttccccaaaatggtctccaacttctagttttttctgtaaatagcatgcatgatat

SEQ ID NO: 150723 - DNA, 601 bp, Human
ataatgccaccatgatatatatatatatatatatatatatatatatatatatatatatatatatatataaaattattctcatgatataagtgaagaaactaaaacagacacactaagtaaacctgccccaaatcacatcataacagtagtgtgagtatatcaacccaggtctaagtctaaatctttgctcttagccactacattatcctgcctctctcataattctcagctaatgacaaacagatgtgaaagtgtgtatattgaactgtatccttgaagaaggcaacttgaatattccatytgcctgtctgatgccaactacccaaatttgtgtagtcactcgaccacctggatatttagtttacgttaacacaaaaatctggatatttgaaaaactgtggtgctcaagcaagcatttcaaatctcatctaaattcctagcttcatataatactcaggcaaggcatttttcatgaaaacagaacataagagatctgagccaagaaaaaaaaaaaagagacaaaattttagacaaaaagtatgtattgcttaatcaataccagttaaaaaaatgaattttcctgtagcccaccaccacattt

SEQ ID NO: 150724 - DNA, 601 bp, Human
aacaacaaaaatgccatttgattcgtgggctgagccaatccatctgggaaatctctcaaagaaagtagctggaaatgacatttcagctctgattttcctagtcaagtctgcaccttaagccaaagactcaaaaatagcactccatctagatggtgtaaatacagtgacacttgagtctcttcactttggtcttttaagagtgattttaactctttcagagataacatgggagactgaaggggctggatgctggaaacgagactgtccacatcttgtttccagaaaacggattactctgctrgcggttgattcttggatttcctatcataagatctgaaccctgggcctgatgtacagtgaggcgtgcgattggcatttgcagaagccttgacatcccacactgcagttcatgattggtgtcagacaaagaagcatattaaatgactgccggcccggtgataaggccggttattaccgaggtgtagtttccccaggtctaaagactcatagtggtaccactgaagcatgctggggagaagataaaatttaattaataatttccttagaggccaacagtctattacaactatgttccttgctg

SEQ ID NO: 150725 - DNA, 601 bp, Human
gtctcaaaggccttccactttttaagagtttaaagttctatgagaattgtgtacaactagaaactttcccaaggttaaataattttcctttttccagaggcaatggaaaatggcaatttgggttccggcattcctgataaaaatttactgtttttgtctggtgatgtctctactgaaaatattctttgctataaatctcttgcctgaaatttccatagagcttatcaggtttcataaagcagatcaccttaaaatggcttttaaaaattcagagtggaacagattcctctatgaaattgtwatatggaaaataaagttctcctaaccctaattgtcttcacaaaagtgtttccaaggagaacacccagggatatgacataagtagcaaggccataataaagatgtgagtgtaatttccacacatgctgtcaacctcaaatatgcagcctactcagaggcaatttgggtaaaaattgtcatagctattgccagtgttgtcacttcttgattttttcatcctagggactgtgtcttattcattcttggtctcactgatggtgccacagtaccatctttcaggcattcagtcaaagtctcctga

SEQ ID NO: 150726 - DNA, 601 bp, Human
gtcaaatgattttctacaagggtgtcaagaccattcattgaggaaagaatactctcctcaacaaatggtgctaggaaaaaaccagacatccacattcaaaagaatgaagttgggccctacccaaatatgaacaagaaattaactcaaaataaactacaaacttcaatttaagagctgaaactataaaactgttgcaagaaaatataatggcaaatgtgtattatgtcagacttggcaatagttttaatatgacaccaaaagcacaggtaacaataacaaaaatatataaaattggacttcrccgaaataaaaatttctgtatatcaaaagacactatcaagagagtgaaaatacaacccacagaataggaaaaaaatttgcaaatcatacatttggtaaggttttaatatccagagtaaaaaaataactcttataactcagcaacaaaaagacaaacaacccaaataaaaaatgggcaaaggaattgaatacatgttttcttataaaagatatacaaatggccaatatgtacatgaaaagatgctcaacattattaattattaggaaaatgcaaaaaataccacactaagatactacttca

SEQ ID NO: 150727 - DNA, 601 bp, Human
aaatactaggaaaccaagctcaacagcatattgaaaggattatacaccctgagcaagtgaaatttatcccaggattgcaaaagtggtaaaatgtatgaaaatcaatgagtgtaatataccacattaatagaataaaggaaaaaactatgtgattgtctcaattgacaaagaaaaagcatttgacaaaatctaacaaatatcctttcatgataaaaccctcaatacattagaaatagaagggaacatcctcaatttgataaaagccatgtagcccctaagattaggaacaagacaaagatgyctgcttttatcacttatattcaacaaagatgcctgcttttatcacttatattcaacataatactgaaagacctagccagagcaattaggcaggaaaaataaataaaaggcacctaaattagaaaggaagaagtaaaactatcttcgcctgcagatgatatgatcttacatttaaaaaccttaagaacacaaacacacacacgcaaatctgtcatagctaataaaatgaattcagcaaagttgcagaatacaaatcaacaacaaaagaagttgtatttttatgaactggcaatgaacactc

SEQ ID NO: 150728 - DNA, 601 bp, Human
agctgttattgctgtcattattatcatcactatcagcaatgtgtttttgtcttaaactgaccaaaaaataataaagtctgagaaccaggaccaaatgtcagaaaggttcttggatccagattttagtaaaaatcaaggaaaacctctctaatgatgagagagacaaaaataaagtggggggttgtatactaacattattactgagtttacagaaaaaaaaaatggatgtaagagaatattataaggctgggtgcggtgactcatgcctataatcccagcactttgggaggccaaggtgggyggatcacctgaggtctggagttcgagaccagcctggccaacacggcaaaaccccgtctctactaaaagtacaaaaattagctgggcgtggtggtgcatgccagtagccccagctacttgggaggctgaggcaggataatcgcttgagcctgggagatagaggctgcagtgagctgagatcatgccactgcactccagcctgggagatagagcaagactctgtctcaaaaaaaaaaaaaaaagaaaagagagagaatattatgaataactgtatgccaacaaattgggtaacctagattaa

SEQ ID NO: 150729 - DNA, 601 bp, Human
actcaacagctatttcagataaaatagtctcccaatttatccatcttttcctgaaatatttttaccatagaggccaattttaattgccatgagttttttgtttaatgtgaattatttatataattaatctgtttttcttagcacttattgacagcctaccttcacagaccatctcttctcccaaatacctcatccttgtttctcctacctgtaaacattcccactgcaacccgtcgtaataggtaatgtcagccacagaaggaaataaaatatcttagtatccataagcaaaacaagagagaaaactgtatattttgtaggcttggtgaattctgtggacttataagccttggactaatcctaatcaaaattaaatctttctttgattttcctggatactctaacttgatgaatgacttaactgctttgtgttttagttttctgaaaattgataggataagatgataatacctaactcatggggttaagagttgagtgagatgatataggaagctatttcacatataatgcctggcatgtggaaagcatttagtaaatgggagctgttattgctgtcattattatcatcactatcagcaat

SEQ ID NO: 150730 - DNA, 601 bp, Human
ttccttcttttgccaccttccctttcagcttgctttcctgagcagcagggtttgagaattctctttttttctgcatgtttaaattaaggcacaactcaacagctatttcagataaaatagtctcccaatttatccatcttttcctgaaatatttttaccatagaggccaattttaattgccatgagttttttgtttaatgtgaattatttatataattaatctgtttttcttagcacttattgacagcctaccttcacagaccatctcttctcccaaatacctcatccttgtttctcctayctgtaaacattcccactgcaacccgtcgtaataggtaatgtcagccacagaaggaaataaaatatcttagtatccataagcaaaacaagagagaaaactgtatattttgtaggcttggtgaattctgtggacttataagccttggactaatcctaatcaaaattaaatctttctttgattttcctggatactctaacttgatgaatgacttaactgctttgtgttttagttttctgaaaattgataggataagatgataatacctaactcatggggttaagagttgagtgagatgatata

SEQ ID NO: 150731 - DNA, 601 bp, Human
ttgaaacagaatgcattctccattgtattagcacatgcacaaaataatgaattatggcctatctacaaaaataaacattgtctgacagattatagggtgagtggattggatgatacagagcctgaaggtaatcaaagttcattccttcttttgccaccttccctttcagcttgctttcctgagcagcagggtttgagaattctctttttttctgcatgtttaaattaaggcacaactcaacagctatttcagataaaatagtctcccaatttatccatcttttcctgaaatatttttaccrtagaggccaattttaattgccatgagttttttgtttaatgtgaattatttatataattaatctgtttttcttagcacttattgacagcctaccttcacagaccatctcttctcccaaatacctcatccttgtttctcctacctgtaaacattcccactgcaacccgtcgtaataggtaatgtcagccacagaaggaaataaaatatcttagtatccataagcaaaacaagagagaaaactgtatattttgtaggcttggtgaattctgtggacttataagccttggactaatcctaatca

SEQ ID NO: 150732 - DNA, 601 bp, Human
gattaaacagtattatccagctgatggagagcaacttggaaattatgggaaatggccatactgcatagccgtttgcattccaggaattccgtttggaccttccatgattaatatgtctgatataattctggggagctggtgtcttttctcctttgactttttcatttcatcttttcaaaaggcttgcacaaagcagagccaggcttcatgctcttctttcagactgtggtttattatgatctagatttgaattaaagcagtggaaatggcctcacaattctacaactccacttttagtatytggttgaaacagaatgcattctccattgtattagcacatgcacaaaataatgaattatggcctatctacaaaaataaacattgtctgacagattatagggtgagtggattggatgatacagagcctgaaggtaatcaaagttcattccttcttttgccaccttccctttcagcttgctttcctgagcagcagggtttgagaattctctttttttctgcatgtttaaattaaggcacaactcaacagctatttcagataaaatagtctcccaatttatccatcttttcctgaaatattttt

SEQ ID NO: 150733 - DNA, 601 bp, Human
agacttaagcttttcagatgtcaaatagcactcaataaacatcacaaatgagttctgatgtggaaaatgcattctcaaatagaagagtttttgttttattttaaaattgtgttagcacctaaaagacccctgtaatagtgaagataaagttaatccagtaatgcatttaccatagtaaacctccagaacagaaacacattacttccctctgatggaattttaaatcagcgtaagggattaaacagtattatccagctgatggagagcaacttggaaattatgggaaatggccatactgcayagccgtttgcattccaggaattccgtttggaccttccatgattaatatgtctgatataattctggggagctggtgtcttttctcctttgactttttcatttcatcttttcaaaaggcttgcacaaagcagagccaggcttcatgctcttctttcagactgtggtttattatgatctagatttgaattaaagcagtggaaatggcctcacaattctacaactccacttttagtatctggttgaaacagaatgcattctccattgtattagcacatgcacaaaataatgaattatggcctat

SEQ ID NO: 150734 - DNA, 601 bp, Human
cagagatacaaattctatttcaaaaaagccaccttactgaaacacttgcacatgtacacagagaatcattttcatgggtgttcgttgcagcattgcttatactagcagaaaattggaaacaacctgaattacatctacaggaaaatggtaaagcaaattctggaatatccatactaaaaaacataatgcaacctttaaaaaggttctatatgggctatcatggaaagatctccaagacctattgctgatcataaaagcaagctgcaggataatttatcccctaaaacagcaaacatttatwgatgatttatatgtcaggtactgtttagggagtggggataaagtagtgaaccacagacaaaaatccttgcctatataaaacttatgagcacgtagaatgtatattttaacatcctaaaattatatattagttaataacttgtgcatatatatatatatatatatacttatttctaaatacagagagaagatccagaatgagacccaccaaattgttcatggtggtaatctctagagaggggagtggggtcaaagaggggataacaacttttttgtctatattcttctgtgtttccatgtt

SEQ ID NO: 150735 - DNA, 601 bp, Human
aagtgtcaatagagcagtggcagatgatgagctgtctaccaatatcagtcctgcccttcttgaacaataagaaagttttagctgggcacatgattaggtagaacatttgctagcttctcttgctatgacagacatgtgagaaactctccaaacaatttttctatttttcttcggtatatagctaatctgtgtttcccaatcccctactgcagttaaaagagggcatgtgactaatttctagccaatgcaatgtgggtggggatgagatacccaatatcctggcccataaaaagtattccawgctcttttcacttgcaggagaagagaaaggaatccacaaacctagaggagatcagaatgtgtgtaccttcagagatacaaattctatttcaaaaaagccaccttactgaaacacttgcacatgtacacagagaatcattttcatgggtgttcgttgcagcattgcttatactagcagaaaattggaaacaacctgaattacatctacaggaaaatggtaaagcaaattctggaatatccatactaaaaaacataatgcaacctttaaaaaggttctatatgggctatcatggaaagatct

SEQ ID NO: 150736 - DNA, 601 bp, Human
tgctctaccaggcgcattttgaaaagccacagacagctttcctgctgcataaagaataatacaaataaatagaaattataacgtttcactttggctgattatgagataacatcagatgggagaaggaggaggatatatctttatatcttagacccaaagctcccagtgccagaattctagaagcaggcctaatcccatggtctggctctcatcagtggccaagaagactgaatgagcagtgaaatacctctttgatgcttgttcatcactcagcaccagcacagaaatttcaaaggccatrttaagtgacttgacaatctggagacagatgataaagtctcagcttctgatcactaaacacaataaatcccttgcgaacaggtgctactaattttttttaaaaagatccatcttgtgctgtcagtcattttcagatcaactacaagtgagcctgttgacctgaggtatactcagattgggctaaaattcagtaaaatatgagttttgagaagggtacatgtgatttaaatagatgggattgccccagagatgccttccataagagttacaaactcaagtgtcaatagagcagtggcagatg

SEQ ID NO: 150737 - DNA, 601 bp, Human
gtagtggctcatgcctgtaatcctagcattttgggaggccgaggcaggcagatcacttgaggtcagcagttcgagaccagcctggccaacactgtgaaaccccgtctctactaaaaatacaaaaattagccagacttggtagtgcacacctgtaatcctagatactcgggagaggctgaggcaggagaatcatttgaaccaggcaggcggaggttgcagtaagccaagatcacaccactgcactccagagtgggtgacagagtgagattccgtctcaaaaaaaaaaaaaaaaaaaaaaaargaatgaagaattcaaaaattatcctagacataggccagaacactaaaaaattattgcaattaaaaagaatccttaatgatgtgaaattgttcacaatatactactaagtaagaaactatataatatagtttttaattctatataaaaataaatgtattgggaaaatgtattaaaaatgttaacagaaattactaggtgttatgataacaggtaatttaacgtttctacttttatgcttctctttatttccaaatgttttgcaatgcactatgatactaagagaaaaatgttaagggcaac

SEQ ID NO: 150738 - DNA, 601 bp, Human
ttagaatataaactggctttccactgcattaaggtaaaatccaaacttcttcccatgatctataaggtcccataccatctgacgctgggcccacaccatctgacattgggcccacatctccaactttgactattattttcttcctcattaactgcaagtctcactggcctcctcccagctctttcctgttcctggagatttgctgtcgcatctgcctagtgtttctgagactttttacagctcttaatccttcaggtgtcagcttaactatcttatcgtcaggcaaagatttgttgttacttttttttttttttgagacagtctctcactctgcctctcactgaggctgaggctgaattgctcactttaacctctgcttctcaggttcaagtgattctcctgcctcagcctcccaagtaggtgggaaagcaggtatgtgccaccatgcctggctaatttttgtatttttagtagaggcagggttttgccatgttggccaggctggtcttgaactcctggcctcaagcaatctgcctgccacagcctcccaaagtgctgggattacaggccaggcaaagcttttgtaaccacctaaagcaca

SEQ ID NO: 150739 - DNA, 601 bp, Human
ataaagaatcaaattccattcttcccacaaaaatttattccagtatttttaggtttaaaaaagatgtctgggaaaaaaaagagaaaatgtctctaaattagcatttgagatgaattaccattttccagagatatcactccctacaatattccaccccaaataaaccggaggaagaactgtggctaaatgcctaagccaggagtgagtggggagtgggaaaaggctccaggcaggtgaaaagaaccaagttaaagtctgaccaagactgaggtaaaaaacacataattccttctgataacayagcagccattattatagctagtgttgtgctcagtactttccctgagtaatttcactaatccttgtaagtacttcatgaggtgatttctattatttatactttcaaatgagaaaacaggctcagagaggttaagttctcaaagtctcacagacagcaagttcttgtcttagcttctggaacagtgaatgctaccacaacaccgtgggccctacggcaccataaaaaagcttggcagaaggtggggcacggtggctcatgtctgtaatcctagcactttgggaggccaaggcgggagaatca

SEQ ID NO: 150740 - DNA, 601 bp, Human
aacacacagtaaacacgaataaattcagctgttgtgtaataacatcaataattactatttattgagtgcatattatgtgttaggaactatgccaagtgctttatatgtaccctcttaatattcctggcaaccctataaggtattgctttaatctctattttgcagatgaaggaactgaagtatatggaatttttataattttcactgcatagctagtaagtagaaaattaagcttgtctgcctccagagttcagcaaactatactgcctctatttaagcaaacaagcagcatttattaagkgtctttgtggccaccatgtgctattatgggatgaaatgaactctctgctctccagcaactcatactcttgctggaaaagacaggcaagatacccaagtggaagatgtgaggtgataagactgtatgtgatgaattatcaaactaaacaatttaaagcaaatatgctctagatttaaaggaggaagagactgaggagctgcaagtcagaagagacctcagaagttaaggtgcacctggaattattagtatggtctgcatgctctgctgtgattttgtgggtgagggatgcattggaaatac

SEQ ID NO: 150741 - DNA, 601 bp, Human
atataatggtatcacatataaatatctattgcatacacatatttaaagatagtactggctgccatgtagggtgaggattgtggaacggagggaccacagtaggaacacaaaaatagaagaaagagacacataccagcagagaactacaactgctttggagtttaaaggaaaatgggtggaaggcgagagatggaagccccatttgaggtgactttgaagaggacattgttttggacatgcaggggtgtctggaaaacatagatggcctcactagttgctatgtgtcttgcacagaggacayaggggtcttccctggagtgtcccaaatttaatatatggatctctgaaatctgtacaaacatgcgatatgggggaaggaaagaatacaagaatattgcttgtatcccaaatcacactggtacttagactatcctgtggaaccaaactgcaagaaagttccagaaataaccagtgacttgatctgcatccaagtggaaccctttgccctgacatcaccttggcttttgaaggccaagaaaacctacagggtttaaacttccattttccacaaagctttgaggccaagcggaactcttccatg

SEQ ID NO: 150742 - DNA, 601 bp, Human
tccaagtgagagatggtggcagcttggactagtgtggtagcagtgagggtggggagaggctgatcagcttgagacgctgtcaaggtagagatactgtagggttgccttgcacttgccttggagtatgagaggaaggagtcaaggatgactccaggggttttgttctgagtgatacatttattgagatgaaaaaaagcagtgcctgtaacatcacaatgttggctccttatcatgattcaggtctccatcgaatgtcttctctttggagacatcttccctgaccacccctcatcctatcagygctgctcattttatttctcagaacttaacacatatctgaaattatcttattcattttatttgactcatttatcatccggattccccactgaaatgcaagacctaagagaataagtgccatgtctgcttagtttattgcaatatctttagtacctaattcagtgcctggatcttgaaataagatcagtaaaagtttgctgaatgaggtttgcaatgtgtgagataagttaagtccccaggtttttggggtgtgtgtgtgtagttcttttcagagcaatcagttaatggattaaatagtatt

SEQ ID NO: 150743 - DNA, 601 bp, Human
gaattgcttttgcaattttgtaaaaaacaaacaaacaaactgagttgaacatatttgtgtgggtttgtttttggattctttattctgttcattgatctatgcctctatctgtctgttaatgttacacagtctttcatactatagccatataataaatcttaaaatcaaggagactgattcttcccagtttattattcttttaaaaatgatttttagctattttggttcctttggttttccatatacattttagaataatcagatctgtatttataaaaatcttggtgggattttgatagcratcacattaaacctatatatcaatttgggaagaattaacatctttgcctcgttgggtagacaagtcctatgcctttataaacacttttttattttaggacgaactagggtaacaaattcagttgctcaaaagaggccgcatgtatcaggtttaagaacatgcaggcttcttgtgatagtagattggatacagaatatttctgtactgtaagaaaacaataactcaatcagatgttaaatgaccaggaacacttgagctcagcattagaaacataataaggaatggtggggattgtggctt

SEQ ID NO: 150744 - DNA, 601 bp, Human
gacaaatacccagaggtgcaattcttgggtcatatggtattatagtttcatgtttaggtttttaagaaattgccaagttgttttccagaattttttccctagaatattcagaaggtacattttacattcctatcaaaaatatatgaatgatggactttctctgcattccagcacttgtattgctaccatttcattttagccactgtgatagatatgtatctcattgtgctttaatttgcatttccttaatggctgatagtgttaaacatcatttgctgtgcttattggtcatctgtctatygtctttggtgaaatatctcaggtcttttgcccattttctaattgcatttttttaatgctgttttgagagttctttatatattttggtaactagtctttgtccgacatgtggttttcaaatattttcttccggcctgtagtttgtcatttaatcctctaaacagaatctttggctgagcaaatgttttaattgtgatgaggttcaatttatggacagtgcatttagcataagaactctttgcctagcctagatcacagtgcatgtagcataagaactctttgcttagcctagatcacagtg

SEQ ID NO: 150745 - DNA, 601 bp, Human
accagtttccctccagtccccatcctttccttatcccctggcaaccattaatctgttctccatttctacaacattcttgaaatgatgaaatcataaaaatggagaacagattagtggtcacctggggttaagaagaggtacatccagtagtacataagcttttggaattggcttttttttccctcaatattttctggagatgcattcagattgttgattgtatcaatagctcattcctttttaattgctgaatagtattccatggtatggacgtaccacagtttgatgtgctgttcacacrtctaagaacatctgggttgtttccagttttttggtaattatgaataatgctgctataaacattgtgtacaggtttgtatataggtttttgtgtgcacatacattttttttatttttcaaagacaaatacccagaggtgcaattcttgggtcatatggtattatagtttcatgtttaggtttttaagaaattgccaagttgttttccagaattttttccctagaatattcagaaggtacattttacattcctatcaaaaatatatgaatgatggactttctctgcattccagcacttgtat

SEQ ID NO: 150746 - DNA, 601 bp, Human
ctggagttttggtagttaatataattaaaaacaagcactgcatcaaaatcaatgtggagcagataatgaaggtgacagtattcaatctgattccaaggtttgggaagtggtacagactattagggacacataattccattgtaagcaattgtagttaagaatgaaataaaattatttcttcaatttatgttactatgtttcaaacagttactacattgttagtgcaaacatacttattaagtagtttgaacctaactacttagtaaacagaacagttgtgaatttttttttggcccaagarcagcatgaaaaaaattaggacgatacgaagggtgatatgaactgaggtacttggggaacctctgttctacacaaagcatggtttaacccgagatgttccagggctgaacctgcctctggattctctatgtggtacagtgacagccacaaaagcagctcccatctactgagctcttggccaaacataggcaagctcttaagcattgtaactgcatgacctcatttaatctccagagcactgtgagcatgggtcttttatgatccccatttaaccgatgagtaacctgaggccccaagaggc

SEQ ID NO: 150747 - DNA, 601 bp, Human
atgagggaacttaccacttcaacattagtacatagtatattccccttaattacaaagtatttttgcaaagctggagttttggtagttaatataattaaaaacaagcactgcatcaaaatcaatgtggagcagataatgaaggtgacagtattcaatctgattccaaggtttgggaagtggtacagactattagggacacataattccattgtaagcaattgtagttaagaatgaaataaaattatttcttcaatttatgttactatgtttcaaacagttactacattgttagtgcaaacayacttattaagtagtttgaacctaactacttagtaaacagaacagttgtgaatttttttttggcccaagagcagcatgaaaaaaattaggacgatacgaagggtgatatgaactgaggtacttggggaacctctgttctacacaaagcatggtttaacccgagatgttccagggctgaacctgcctctggattctctatgtggtacagtgacagccacaaaagcagctcccatctactgagctcttggccaaacataggcaagctcttaagcattgtaactgcatgacctcatttaatctc

SEQ ID NO: 150748 - DNA, 601 bp, Human
ttaaaaaaaaaaagtcatatgtagcaatcattagacaaagcagccactgggtgacagccagaatcagaggccagaaagttgatctctttcaagtgacatattccagaggagaaaggaacaggaggatgagcagatcaatttagctctcaaagtatttattctctagcctgcaaaaggagaacagggcttccaggacgactctgtctgctcctcaatttctcactacaattataaaatcttttggaattttcttccttgcgctacccctgctatccccatttcttctaagaagcatgagaartatattttgttgtttggatttctttcactcttgggcaaagctgcttgaactgataattagtgattttaaaaagcagcacatctaaatggtggctattcattaatcataacattctgagtttacatgcatttatcttattaaatgctgtgagataaaagtgctgtagggatatttaaactcccattatgcagataccaaaactgaggctcaggaaggccaacctaacaagttcatatggcgagtccgaattttcattcgggtctcttggctccaaggcttttctataacatcgtgctgcat

SEQ ID NO: 150749 - DNA, 601 bp, Human
ggcttggctatgaaaaccttatagcgctattatgtgctacacctgtgatggccatgcagcgtgttaatcaagacaattaggctggggacccagagaacggctttccaccactgtgcataatcctcctcactttgaaagggaaattaactgctgctttatggtctctcatattatctcactttcttggagagagatcccaatcagatccaccttgactaaacaacacctatcactggcgcatgggatgacacaacatctgtattaactttgactttgaaacagcttttggactgggagtttaaaaaaaaaaagtcatatgtagcaatcattagacaaagcagccactgggtgacagccagaatcagaggccagaaagttgatctctttcaagtgacatattccagaggagaaaggaacaggaggatgagcagatcaatttagctctcaaagtatttattctctagcctgcaaaaggagaacagggcttccaggacgactctgtctgctcctcaatttctcactacaattataaaatcttttggaattttcttccttgcgctacccctgctatccccatttcttctaagaagcatgagaagta

SEQ ID NO: 150750 - DNA, 601 bp, Human
cttaggcttcagtgcaccatggggaacacagaattcattctctttcctcctccagtgacaacacacaggctgggactgaagagagctttcagaatgaacaatgggtggaaaacactgcccttccagcagtgagaaatgtgaaattccactcctaccctcacatgtgtcaccagggaaccatcctgtgtgctccatcagcactgggatatgagccaggcaatcatttgtactcagggactcagccttaacctaaaaaatcatcagaagagcctaagaagggttcctcctcattcctcatatstgagaaacaaagaacaacacattttactgcaagaaattgtttgtggatcttattgagaatagcttagagcttgcttttcctttaagcaggctatctacttcttattctgcctagccagctaagatatttatctcctactttcatggtcattcacagccacccagaactttcaaatgcattgctcagggcctctgggggtggcctgtaaaccaacaaaaatacttttatcaaacacaccatagagatcaggcagttaagagaccaagagtcaaatttatattcagtttagaatataaattg

SEQ ID NO: 150751 - DNA, 601 bp, Human
ggctatgtccaacagttcattattacttgaagatattcacactatgcattgatattctgatttcttcacctccctacttttttctgtttttgcgaatttttaattctctgcagggtagagaatagatttatagtataaaggaaactatgaaaagctaagaaataatgaagatataataataaatgataataattattatgggttgaattgtgccctcccaaaatttatatgaagttttaacccccaatatctcggaatgtgactttatttggaaataagagtcattgcagaagtagttgcratgaggtcattagggtgggtcctaattcaatatgactagtgtccttataaaaaggggaaactgaaacacagagatgggtatgcacacagggagaatagcacatgaaggcgatgaaggcgaaggcagagatggggtgatgcatctgcaagccaaggactgccaaaaattgcctaaagaccacaggaggctaggagaggggcctggaactgtttctctgtcatagccttagaaggaagtaactttgccaacaccttgatcttggacttttagcctccagaactgtgagacagtacagttctg

SEQ ID NO: 150752 - DNA, 601 bp, Human
agccttgacctcctgagctcaagtgatcccccatcccccgaacctcttgagtagctaggactacaggtatacaccactgcacccaaatagtttttatttatgtaaagacagggtctcaactatgttgcccaagctggtctggaacaccggggttcaaacaatcctcttgccttggcctcccaaagtgctgggattacaagtgtgagccactgtacttgggaagaagtgcatctaaatggaatttaaagaaattaggggaagcatcgtggagaaagcattccaaacccagtgttaaaagacmaatgagagtcagcctggccaaagggcaaaggatggggaggaaagaatgccaggggtgggggacaactcatatgaagactcatagaacatggtacatttggggaccaacagagatttcaatgagacggaagcatggagtgccagggctgggcaaaggaaggacacatgttcagaatatattagagaagtaaacttgaggttcatgaggaaggtctttgtgcatgataggaagaggatgcatcaaagattttaaggaaagaagctacgattataatttaagcacattttactctagccctgc

SEQ ID NO: 150753 - DNA, 601 bp, Human
ggatctcactgtgttgcccaggctggagtgtagtggtgtgatcatggctcacagcagccttgacctcctgagctcaagtgatcccccatcccccgaacctcttgagtagctaggactacaggtatacaccactgcacccaaatagtttttatttatgtaaagacagggtctcaactatgttgcccaagctggtctggaacaccggggttcaaacaatcctcttgccttggcctcccaaagtgctgggattacaagtgtgagccactgtacttgggaagaagtgcatctaaatggaatttaragaaattaggggaagcatcgtggagaaagcattccaaacccagtgttaaaagaccaatgagagtcagcctggccaaagggcaaaggatggggaggaaagaatgccaggggtgggggacaactcatatgaagactcatagaacatggtacatttggggaccaacagagatttcaatgagacggaagcatggagtgccagggctgggcaaaggaaggacacatgttcagaatatattagagaagtaaacttgaggttcatgaggaaggtctttgtgcatgataggaagaggatgcatcaaag

SEQ ID NO: 150754 - DNA, 601 bp, Human
acacagactaatgaagacacatacattgtaatataatgcaataggaattaagataaggataacatctaagaagtgcacctatttttttttaagagacaggatctcactgtgttgcccaggctggagtgtagtggtgtgatcatggctcacagcagccttgacctcctgagctcaagtgatcccccatcccccgaacctcttgagtagctaggactacaggtatacaccactgcacccaaatagtttttatttatgtaaagacagggtctcaactatgttgcccaagctggtctggaacacyggggttcaaacaatcctcttgccttggcctcccaaagtgctgggattacaagtgtgagccactgtacttgggaagaagtgcatctaaatggaatttaaagaaattaggggaagcatcgtggagaaagcattccaaacccagtgttaaaagaccaatgagagtcagcctggccaaagggcaaaggatggggaggaaagaatgccaggggtgggggacaactcatatgaagactcatagaacatggtacatttggggaccaacagagatttcaatgagacggaagcatggagtgccagggct

SEQ ID NO: 150755 - DNA, 601 bp, Human
gcagtagtagcagtggtggtggtagtaatagtagtggtagtaataacagctaacatttattgagcatttccaggaattgttttaagtgctttacatatattacctcatagggttgttgtgaagataaaatgagttaggttttttttttttttttgagacagggttttactctgttgctgaggctggagggcagtggcatgatcacagctcactgcagccttaacttccctggctcaagcagatcctcccaccttcgcctcccaagtagctgggactacagatgcacaccaccatacctggmtaatgtttttatttttttgtagagatggggcctccctacattgcccaggctggtcttgaactcccgggctcaagaattcctcctgccttggcctcccaatctgctgggattacaggtatgagcctggccattagccatttttaacagatggagaaactgtgttaaatgccctgtatacaatatctcattcagttctcataactacctatctactttattattcccactttgcaggtgaggaaactgaggcacagactggttacttatggtcctacaactcaataggttcaagaactagaa

SEQ ID NO: 150756 - DNA, 601 bp, Human
tcccacatgttgtgggagggacccaggcagaggtaattgcatcatgagggccagtctttcccgtgctagtctcataatagtgaataagtctcatgagagctaatgggtttatcaggggttttcacttttgcttcttcctcattttctcttgccgccaccatgtaagaagtgcctttcacctcctgacatgcttctgaggcctccccagacatgtggaactgtaagtccaattaaacctctttttattcctagtcttgggtatgtcttcatcatcagcataaaaatggactaatacagggarattaaacttatatcattaaaaagagaggtgatcagggaagcctgaattggcatgaggagtctgaccaggaaatgtagccaaaagatattctctgcattccaagaagaaaccgatgaggccttcgaggctcacagtggaaagggttagagaggaagattcagccatgtacgaggtgtgagtttggagagaaaaacacagattagatgtatcttcctgctgaagccatacacaacacaccagctggctccttttccaatccatgctctatcagctaatccaacaatcatattttgttattct

SEQ ID NO: 150757 - DNA, 601 bp, Human
gcttttgattttaaaggctcataggtagaagggacttaccttgtctcagatgagactttggactgtggacttttgggttaatgctgaaatgagttaagactttgggggactactggggaggcatgattagttttgaaatgtggagacgtgaaatttggaggggccaagggcagaatgatatggtttggctgtgtccccaccaaatctcaacctgaattgtatctcccagaattcccacatgttgtgggagggacccaggcagaggtaattgcatcatgagggccagtctttcccgtgctaktctcataatagtgaataagtctcatgagagctaatgggtttatcaggggttttcacttttgcttcttcctcattttctcttgccgccaccatgtaagaagtgcctttcacctcctgacatgcttctgaggcctccccagacatgtggaactgtaagtccaattaaacctctttttattcctagtcttgggtatgtcttcatcatcagcataaaaatggactaatacagggaaattaaacttatatcattaaaaagagaggtgatcagggaagcctgaattggcatgaggagtctgaccag

SEQ ID NO: 150758 - DNA, 601 bp, Human
tcattttggagctttaaaatttgactgcctctctggatttcagacacttgcataggctcagtaacccctttgttttggccagtatctcacattttgaatagctggatttatccaatacctgtacccccattgtatctaggaagtaactagcttgcttttgattttaaaggctcataggtagaagggacttaccttgtctcagatgagactttggactgtggacttttgggttaatgctgaaatgagttaagactttgggggactactggggaggcatgattagttttgaaatgtggagacrtgaaatttggaggggccaagggcagaatgatatggtttggctgtgtccccaccaaatctcaacctgaattgtatctcccagaattcccacatgttgtgggagggacccaggcagaggtaattgcatcatgagggccagtctttcccgtgctagtctcataatagtgaataagtctcatgagagctaatgggtttatcaggggttttcacttttgcttcttcctcattttctcttgccgccaccatgtaagaagtgcctttcacctcctgacatgcttctgaggcctccccagacatgtgg

SEQ ID NO: 150759 - DNA, 601 bp, Human
aagtgatatggtttggctgtgtccccactgaaatctcaacttgaattgtatgtcctagaattcccatgtgttgtgggagggacccagggggagttaattgaatcacggggactggtctttcccgtgctattctcatgatagtgaataagtctcatgagatctgatgggtttatcaggggtttccacttttgcttcttcgtcattttctcttgccgctaccaagtaagaagtgctttttgcctattgccatgattctgaggcctccccagccatgtggaaccatataagtccaattaaaccyctttttatttccagtctcaggtatgtctttatcagcagcatgaaaacagactaatacagcaaattggtaccaggagtggggtgttgctgaagagataccccaaaatgtggaagcaactttggaactgggtaacaggcagagattggaaaagtttgaagggctcagaagaagaaaggaaaatgtgggaaagtttggaacttcctagagacttgttgaatggctgtgtccaaaatgctgatagcgatatggacaataaaatccaagttgaggtggtctcagatggaaatgaggaacttgttg

SEQ ID NO: 150760 - DNA, 601 bp, Human
actcttttaagtgaaataataaacattggagacttctagaaggtgggaaggtagaatgggggtgagggatgaactattacctatcaggtagaatgtactctatttagataggtgcagtaacagcccggacttcaccactatgcaatagatccatggaacacaactgcacttgtacccgtaagtcaaaaagaaattttaaaaaaattataaaaaataaacaaaatacccaaaatctattcttttagcaatgttgagatatataatacattattaactataatcaccaagttgtgcagatctytaaaacttcttcttcttgtgtaattgaaatgttatatgctttgaatgacatcttcccatacccaattgctcccccttcccctatctcaacccccaactccgaaaaccagccccgggtaaccaccattttactttatacttctatgagtttgactttttttagattccacatataagtgagatcatgcagtatttgtgtgcttggatggagtttaaaattttacttttgctcttttgagataattctatttctcagttttctgtaataagcatgtataattttaaataccacaaagtaact

SEQ ID NO: 150761 - DNA, 601 bp, Human
tatttcaatatacatttacattgtggatggattaaataaagctaattaacataactatcacctcatatttatcactttttgtggtgagaatattttcaaatctactcttttaagtgaaataataaacattggagacttctagaaggtgggaaggtagaatgggggtgagggatgaactattacctatcaggtagaatgtactctatttagataggtgcagtaacagcccggacttcaccactatgcaatagatccatggaacacaactgcacttgtacccgtaagtcaaaaagaaattttwaaaaaattataaaaaataaacaaaatacccaaaatctattcttttagcaatgttgagatatataatacattattaactataatcaccaagttgtgcagatctctaaaacttcttcttcttgtgtaattgaaatgttatatgctttgaatgacatcttcccatacccaattgctcccccttcccctatctcaacccccaactccgaaaaccagccccgggtaaccaccattttactttatacttctatgagtttgactttttttagattccacatataagtgagatcatgcagtatttgtg

SEQ ID NO: 150762 - DNA, 601 bp, Human
caatgtgatatttcaatatacatttacattgtggatggattaaataaagctaattaacataactatcacctcatatttatcactttttgtggtgagaatattttcaaatctactcttttaagtgaaataataaacattggagacttctagaaggtgggaaggtagaatgggggtgagggatgaactattacctatcaggtagaatgtactctatttagataggtgcagtaacagcccggacttcaccactatgcaatagatccatggaacacaactgcacttgtacccgtaagtcaaaaaraaattttaaaaaaattataaaaaataaacaaaatacccaaaatctattcttttagcaatgttgagatatataatacattattaactataatcaccaagttgtgcagatctctaaaacttcttcttcttgtgtaattgaaatgttatatgctttgaatgacatcttcccatacccaattgctcccccttcccctatctcaacccccaactccgaaaaccagccccgggtaaccaccattttactttatacttctatgagtttgactttttttagattccacatataagtgagatcatgcag

SEQ ID NO: 150763 - DNA, 601 bp, Human
tgctaggtttcatcctatagaagagagacactctagtgttttgacacactctacaaaggggttcttttggaacttcattttctaaactacccttcagggaattcaaaattgctcagctgtatgctgaatttgattccacaaaaaacagtgacaagaacaaggtctcattgtattagctcacagatatttcccttcatttcagagtgtggattcctacagctatgttaaacatttatttaaaaaaaaaaaaggacaggaaggatgtggatgaagtcttaaagggtaggattatgagaggtgttttttttttacttatttaaaaattttatttttaattgatgaataattgtacatatttatggggtacaatgtgatatttcaatatacatttacattgtggatggattaaataaagctaattaacataactatcacctcatatttatcactttttgtggtgagaatattttcaaatctactcttttaagtgaaataataaacattggagacttctagaaggtgggaaggtagaatgggggtgagggatgaactattacctatcaggtagaatgtactctatttagataggtgcagtaacagc

SEQ ID NO: 150764 - DNA, 601 bp, Human
gtggactcgttgtgagatatatacatgtgcacacaaacacagagtgaatctaatctgtaacaaattccttagggaaattccatcacatcccattaacacggtcccaaaggcaggagctgggctgatcttgacatatttaatatctttgaaaaaattctgaaaccataatcatctcaaaatggtatacaaaagcaagtctatctgggagttacatgcaaacacattttaccttagttctagcttacataattctttaatcatcataattcctagtgcttctcttaaaacttttgaccttaakaggatgattgacagttaggaaagggagaacaccgctcaatagggttttgacagttaggaagggagaacactgaggaacaagttctcagtgtgtttttacacactcatttaaaaggcaacagtttaataattctaattcatatatacttctattaatgcgatcaataattcatagaaattcctcagcagcatttttagtgacaacagaaagggtaaaatatttcttctcttccctttgccttcctttcctcacttagtcatgcctggagcctggagagcacacaatttcaagaaaacagtt

SEQ ID NO: 150765 - DNA, 601 bp, Human
aacaataatcattaaggttaacaggaacactactaatatagatgtagagatatgcatacccacacagcaggctctgtgtgaagaactttacatgcattaactcatttaaccctcacaataaaaccataaggtagatgtcattattactacccccattttacagatgaggaaactgagtcactgtaagcttatgttaacccagctagcctttggcagaaccagccttctaacataggcagtctaacttgagagctttttgctataaaccactcaactttactacctccagatactatttacygaagacctgctatatgttaggtactatcttacagcttttacaacattagattttaatgacatttacgccatatgcagtggatgctattattcccagacaagaaaacaaaagcctagaaacattaagtaacttgttgaagtcacaaagagagttagtaagacttaggctatggcttaactcaggtctgcggagctacaaaggccactttctgcttactgagttatctgctgatgaatcagagaaaaaatgagtgttgagaactcaatagctttctcaaagctgccccaggaaacaaactaa

SEQ ID NO: 150766 - DNA, 601 bp, Human
cacaaaggtttccaacattttgaatgagtttctatcatctaaaaagtataaagtttcattttaaacaattgagatttttcagtttctttagaaaaatgaagattggcaacatcaagctggcattcccatatggccattcctgacttgagtggggaagcagctgctccctttagaagggcataggtcttgaatttactgcacctcctaacatttcctagtgtacccccagccttagtgtcaagtgccagctcccatttaccctcctgaggttttcctctacctctctgctttcatcttttaygctactttgcctctgtaggcatctgagttagcagctgctggtctttactgttgagtggtatcctctgcaaactggtacctctctacagggctgcatgcaaggtagcaacacctttatccacacaacgttaggtcatttgtcagcactgcaagtgcaagtatggaatgaaaaaacagtcaaaactgcaaatgcaagtgtggaatgaaaaaacagtcaaatcacaactaagggctggcctaaccagtaagctgagcacatccttggaggacagcctcttacccagaagttgactgcatgaat

SEQ ID NO: 150767 - DNA, 601 bp, Human
taaagaagactcactgaaattaactagctattgacttggtctcaagacattacagtctaagagaaacaccagcactgcacagtttagaaaagcatagtttttctttgaaactaccatttattgagttggcctactgcaagccaggcacggcgttcgaccctctatatacatacactctcttcctaaatctatagatccatcgtcatatattggatactgactttggtcatgatctgtgctttgtgttttatgttatatcacttaattgtcactcaaactccatgagttttagtatctttcyccatttttcagttgggaaaatggtggctcagacaggataaataacttgctcatgtttgtaagactagtcgtggagctgggatttaaacccaattgtagttccaaagcttgtgttcagaacctgcctttttgtgggctgcttcttttccctccaccttctattatttcttgttcctattctcttctgtatactatctcttcttttttctatataaattcttttttcatctttcactcacagttgtaggttttacttcttaacacagcagagtgtatcttctgggctcagtcttcacttttc

SEQ ID NO: 150768 - DNA, 601 bp, Human
gtttaagctactgttagtaagttttctgttatattcatctaaattcatgctactatacatgtctttccatctttgttttccttatagcactttgcacagggccaggttattaatgcatgttgagttggaaactcccttgccttacaacatatttgcacaaactctcacatgcacatttccactttactctaccacacaaccaattttccttcccacttgcttgattcctagtattaagatgatttgtgtttttcctccttcccctgctgtggagatggtgtattatttttcaaccattcaratatgaaagcagcttactgggatagaatgccaaccccaatttattcatggtgttcattgtaaaattatgacttcagagggacctagccacaccctctttaggagccaagctttccctgctaatatgcaggaagcccaccatgcttgctgagctgtgaaaatccagatggtgggaagcaggtgagtaatgaatgccatgctgttccccttaaaatgcacacagcttccccaggctgaccaaatctccaacactaaacaggtttgaatcaacccaaggacatgtgggttgataaagattgcc

SEQ ID NO: 150769 - DNA, 601 bp, Human
aaaagccagaaacagctagaaaggtcagatgtagttaaagtgatttttaaaggaaaccctgggtagtgtgaagtttgccttgctccaaatctatttgtgctgatttaatttccacaagatggtggcctggtaaccccatttctagctcaataggcactattaaggctgagtttattattttttttttaaatcaatctcagcatcctacaaaagttctagactggtaatttcatacataaagtattatttacctgaataatagatattgacttaacaatgatacgcatgtgaggctaatgawtgtgaggcttacggaaacagaggaatctcctagttcatccctagtctcttgcagtatcatgctaggctggagtctatgcaatgccagagaattgagttgaggcaggcacctggattattaggtgatatacaactcacataggagggtgactgttttgataaaatggagactcagtttagacttaggatctaaactcaaagtctacagatggaatatcttactgaccaggtcactagcactgacctctcaacatcaatcatagagatggaaatgcaagggtaatgcaatttagttttcaga

SEQ ID NO: 150770 - DNA, 601 bp, Human
gagaagggtgctgagaaaacaaggtcataagggcagagaagtgagggcaatttgtactctgtatttctaatcagagaaaatgcacaggcaccaggaactcagatcacagataattgctgaaggaatgccagcctgccaagtctttcttctatgctggttacccctggaggaacatggacaggtaaattacctatgattggatttattagggctatttttagaaaaatgtcagaggttaattcccccacaattattcccctgcagggctccaacaattgctaccaagagtgcaaatgagttaaaaaaaaaaaaaaaaaaagaggcaggggaattatgactatggcctttgacaggaacattctgaagataatgtctaggtaaggaaagcaaaggggaaacagtgaggtggaaaactaaggcaattacccctgagtaattctgatctcaaatcttacttttatatcattatttcaggattttctttgtatgcctgatttattcaggtaagtagtgtaaaattctccacttcacatataactgttcttttccatgtatgaaaaggctccttatggtcattcattgtgcagaagttaacaaaaat

SEQ ID NO: 150771 - DNA, 601 bp, Human
ctatcttcattttctcttttgtacagtaattccaattgtcttccattaacttttgcatgttaacctatttggcctaagggggattctcaacctcaatattagtataaaaaagaaaattacataagaacatgggaatttttcttagaagaatcattttgagatgctgttggcatatgaaacagtatcccaaatgggaagataatatccttgttaatcaaaaaactatttaaaaactcaattaacagaatattatgctatataattaatcttcattgcatttcactgattttttcccatcccyccgccaacaaagtagttaataaatccttgagttttttttttttttgagatggagtcttgctctgtcgcccagggtagagtgcggtggagtgatctcggcttactccaagccccgcctcctggattcacgccattatccggcctcagcctcccgagtagccaggactacaggtgccggccaccacacccggctaatttttttgtatttttagtagggacggggtttcaccgtgttagccaggatggtctcgatctcctgacctcatgatctgcccgcctcggcctcccaaagtgctgggat

SEQ ID NO: 150772 - DNA, 601 bp, Human
aaagcaagctcataagggagttttcctgggggcaatggggagaggaagaggtaaggatggatagaattgctacagaagctggctcacataaacgtttggcgtgcataaatcccatgtcatttgaaggcagagctcatatttcaaaacaaaaacatacattatgctgggacaaatggatttccctgataatgggctcttaaatctatagcttataccttaattcagctcattcaataaaagcatttattgagcattgaataataagagtgcaacatacacagagcttacaatgtaactaagcattttacatgaaaaattggtttaacagtcataactctggaagtaggtgctattatctctattttagcatctcacctcactaacacattgtccttaccatgtcctaaaaggcccttcatgacctgccctctccactttctccacctttctgacccccctgtccatcctctccctgctcactcactgtgctccagacacatggcttccctactgctccaggtacacattaagctcactaagcctcggggcctttgcacttgctgtgtcttctgtctggaaagtcctttaccctctttttcgt

SEQ ID NO: 150773 - DNA, 601 bp, Human
aatccgtttttaatgccactttcctatgagaacttttctggtctccaaaaaccacagctaattttttcctccttttatcaaattgcaactctccaacactttctcaatgcatttatcttactatatttagtgccataatcatttgtatattagtcttacaaatcctctttatcaggctatgtatttctgaggaacaggaaggaagccactcagactgagtagagatcatatattgaggaccagccatagaggaagggttttccatccttgcacttcttcctcataagtccacgagcagtasgtactgtgttcactgttttgcagatggagaaattaaaattaacttgcatgttgaaagctcgaaaaggttaaatgactattgggaaatttgggtaagtggcagaatttgaagccaggtctgttagattattaagtttgtgttctgaatcacaagactgcaactcgccatctggattctcatccctgtaccttcagtacagaaggtgctcaagacattttagataacgtgaacaacagaggctaagattatagtaacgtctggcagtggccatgtgggcaagtcttctgggacaaaaggaaa

SEQ ID NO: 150774 - DNA, 601 bp, Human
aaacccctgcacattcagagcatcaagcctggatttatgccaagtccacccagaatgataaggtggacttacatggaggttctccagagctgaaagcataggctgatcagaggaaacagagtcgccaatgcttgtgagctcagaagcagctcaactgaagaccatgtgcccattaggacagggtaaacacctaatagtctagcatggtggtcagcacagagtctatattcaaaaagtaactgctgaataagcagatgtatcaataaatgaattattaaacaaataaacaagtgagctaatyaagcatacaatgaccatcccattttggctttcaaacatagggcaagaacctattttcctcacatctacttcactgtctcccttcttacttttggtctttagcagagctgctggtgtctgaaatcacatattttacacagttttacaaggctgttggggctagggctatcccaacatgtgcctgctttactgctcacattgaacatgttcataactgagctcatcatccagtcctaaaccactttaccttacatctagagacccttcccttaaaagatcgctttgagaaatccgtttttaa

SEQ ID NO: 150775 - DNA, 601 bp, Human
ggcgtacaggtttgtagccgaggaccaacaggcaatgtagtctaggtatatagtaggctataccatctaggtttgcataagtatactctatgatgttttcacaacaatgaagtcacccaatgatgcatttctcagaatatattcccatcattaagtgatatatgactgtcatatgcccaaggtcactagcggaaagtaacggagccagaattctaacccaggctggactgactcaacaataatactcttcactacgctactttccagcctccaaaacccctgcacattcagagcatcaagsctggatttatgccaagtccacccagaatgataaggtggacttacatggaggttctccagagctgaaagcataggctgatcagaggaaacagagtcgccaatgcttgtgagctcagaagcagctcaactgaagaccatgtgcccattaggacagggtaaacacctaatagtctagcatggtggtcagcacagagtctatattcaaaaagtaactgctgaataagcagatgtatcaataaatgaattattaaacaaataaacaagtgagctaattaagcatacaatgaccatcccattttgg

SEQ ID NO: 150776 - DNA, 601 bp, Human
tgtctcatatatataggcccactatcagtagggggtaataatagccatgatgacgatgatgttattaatactaaaacaacagaagggaactaacatcattgagtgctttttgtgagccagcactacacaggctaagctgtttcttacacaaaataacttattgaatcctcacaacaattccaggaagcagtgactatcatcatccccgttatatagatgagacattggaggcacaaggtattcaaatatagccacatgccacatgatgttttggtcaataacactggttccataagattayaatactgtatttgtactgtgtcttttctatgcttagatatgtttatatacacaaataccattgtgttataattgcttactattcaacacaggaacaggcgtacaggtttgtagccgaggaccaacaggcaatgtagtctaggtatatagtaggctataccatctaggtttgcataagtatactctatgatgttttcacaacaatgaagtcacccaatgatgcatttctcagaatatattcccatcattaagtgatatatgactgtcatatgcccaaggtcactagcggaaagtaacggag

SEQ ID NO: 150777 - DNA, 601 bp, Human
gtggggtctacagatgtcatctgagaaattccatccacatagcaaacaagggcaaggtaaagtctgggcagaagttcacggtataaactctacgtggcacttaatccagttgttttctccataagattgccatgtctcgaggggcaaaagacagtcttattcccaatatattgccagtacggtgtttgccacttagtaaatctcagtgagtagtttgtagaataaatacaacagtataaaaagtataaaaagaaaaataactgaattgtctcatatatataggcccactatcagtaggggktaataatagccatgatgacgatgatgttattaatactaaaacaacagaagggaactaacatcattgagtgctttttgtgagccagcactacacaggctaagctgtttcttacacaaaataacttattgaatcctcacaacaattccaggaagcagtgactatcatcatccccgttatatagatgagacattggaggcacaaggtattcaaatatagccacatgccacatgatgttttggtcaataacactggttccataagattataatactgtatttgtactgtgtcttttctatgctt

SEQ ID NO: 150778 - DNA, 601 bp, Human
agcatataccgaaaattaaaacctggggcagtaaaggctgatcctgactcaaccaataatttgcactaaatctggcctggggttccccctcctcccagaatgagtattacgacataggtacctcagagggagcaagaaagcctaaaggctatagacagacagaacgtgcttcattcccagttctgcctctttctagctgtgtgatcctgattagatacctggcccctcagagccagttaccctcttttataaatgggataatcacatccacaccactagaaagaaagaaatggcaatgcayatcctgtatgcctcaaaggatccttgggagcatcaaatgagatgcccaacatgaaagcccatctaccctccagatgcatcgtggaaactccttcctaatcccgtctcctccctttgtgcttcttctgaactgccatggttatcttctgtgcttttctcaggacagttatccttctccatgatttctcaaagtgtggtccagggaccacctgcaccagaatcacctgggcattttctgggaggggccttgtcaaagatgtcatttcttagagtccaactcaaaccttctaaaccagcatcc

SEQ ID NO: 150779 - DNA, 601 bp, Human
tatgggaaggaataatgataaccaagtgtggctttgttttgtcacttctatcttaatctctaaccttataactcctgaactcctatctttgttgtctgctttgtctgctttgacgatcttatgtttccctcataggatgcttttcttagatgctctttgaatttggagagcctatgatttaaaaattcaagctttcagaagtttctaaacatctgtatatttggttttgaactggcaagataattggacagagttttcgctttgtatctggatgttttcgcattaaatagtcagtgtccttatttaattgaatgttgcagaactctcactccctgaaaataatgagaggaagtgagatcacagagtagagaagaaaatgttgagaaagaactcaggcagtttctaaatacacaatgggattgactgtaatgttaggcaggggcaaatgaagtacatgccgtcaccatttttttttgtttgtttgtttgcggttcaggattgctttatttttcacattaatggtatcatgctatgatcttatactttttaaaaaactcatccctccctccctccctccctccctctgtctgagacaaggtct

SEQ ID NO: 150780 - DNA, 601 bp, Human
ggtgaacatcctgtcttcagtgcagaacatttagctatctgggcaaagtagggctgttccaaaaaatgacctgtacagagaagcgagggcttgcattgctcatggggaaaaaagcgagttccttaacaagacctatggtgcccagcatgatctggccataagctgcctcaccacctgcatcttactggtaccacacatcccctgcactcagcttcagccacctgggccctccttccacactgtgtttttctgtgctacctcctacctgatgggctttgtgcatgtcaccgcctctgcctaraacattctttctgctcctcttcttactttcctcctgctgtggtttaaatattaattgctcaggaaattatcctctgctctccctgaaaagatcaaattctccccatcatctgctctcctgtacaccattcacctttcctctagaggccccattacactgtcggctttacattaggagcattttatgcatgctttttccaacccaaagagatggctagctccatgaaggcaggaaccatatctttcatgttcacttctataactccaggactaatcatagtacctggcttacagtagggac

SEQ ID NO: 150781 - DNA, 601 bp, Human
taatcatagagagggaaaagagaacaaatgtgcagttcatttaaaatcactgtagttgaacatcaaattatggtacctgacttccacctattttacattctatttagtatttattttgcctctaatctaggaatacaattatgtactgaattgtatcacatatgcatttaatatgtgaattcaactatatatgcttagaataatatgaaaaaaggaaagaagcaaatttaaataatgggtcagaggtcccagggagtatgagatgggggaggggagttaatttgctctttctttagaccartggtctgggtggatctcatctctgagcatcgtgggatgttgaataagttactaaggtttaaggaagtatatttttcacaaatggcccctcatattgtttgcatagtttatattctacattattctttatatcctatatatttatatgtatatattattctatatagagttaataaaaacaaacaaatcttatgggtgatttatgggatttttcaagagtatttttaccaaacctggtgcttgctttatggggcgactttggaacctaacctctgtaaaactgccactttaatgacccttt

SEQ ID NO: 150782 - DNA, 601 bp, Human
ggaaaactaatcatagagagggaaaagagaacaaatgtgcagttcatttaaaatcactgtagttgaacatcaaattatggtacctgacttccacctattttacattctatttagtatttattttgcctctaatctaggaatacaattatgtactgaattgtatcacatatgcatttaatatgtgaattcaactatatatgcttagaataatatgaaaaaaggaaagaagcaaatttaaataatgggtcagaggtcccagggagtatgagatgggggaggggagttaatttgctctttcttyagaccaatggtctgggtggatctcatctctgagcatcgtgggatgttgaataagttactaaggtttaaggaagtatatttttcacaaatggcccctcatattgtttgcatagtttatattctacattattctttatatcctatatatttatatgtatatattattctatatagagttaataaaaacaaacaaatcttatgggtgatttatgggatttttcaagagtatttttaccaaacctggtgcttgctttatggggcgactttggaacctaacctctgtaaaactgccactttaatg

SEQ ID NO: 150783 - DNA, 601 bp, Human
cctaaaaagaagggaaaactaatcatagagagggaaaagagaacaaatgtgcagttcatttaaaatcactgtagttgaacatcaaattatggtacctgacttccacctattttacattctatttagtatttattttgcctctaatctaggaatacaattatgtactgaattgtatcacatatgcatttaatatgtgaattcaactatatatgcttagaataatatgaaaaaaggaaagaagcaaatttaaataatgggtcagaggtcccagggagtatgagatgggggaggggagttaatytgctctttctttagaccaatggtctgggtggatctcatctctgagcatcgtgggatgttgaataagttactaaggtttaaggaagtatatttttcacaaatggcccctcatattgtttgcatagtttatattctacattattctttatatcctatatatttatatgtatatattattctatatagagttaataaaaacaaacaaatcttatgggtgatttatgggatttttcaagagtatttttaccaaacctggtgcttgctttatggggcgactttggaacctaacctctgtaaaact

SEQ ID NO: 150784 - DNA, 601 bp, Human
gtgggagatggtggtaggaatctactgaacagtagattctggataattggatttttctgtctaataaaggctattggtcagaagatgaacaaatgagttagggaggtggagaagacaatggcaatgttctgaattcaggcatgagggtgggagagaccgtaaatcttctcttcctcaatggctgagctgaatttgaatgtagtgattctagaaaataaattgttatatgaagtggatgaagatgaaataactccagagaagaaggtttgctggttccaaggagagacagcaggaataggcrtgtgcacacacacacacacacacacacacacacacacacaaaggagataaaaagtaaacaggatgggatgagcaagagaagagagtatctgagaaaagaagcagaaataagactctatagaataaaaagatgccaagctttcagaaataagaatggagaaaaagaagaaagcagggaggtgaagtaatattctagtctgggctctttagattttaagaacagaaaccttcctaaacttacttaaaaaaaaaacccaaaaggattactgaagtacagaaaaatattacagatcatcaagac

SEQ ID NO: 150785 - DNA, 601 bp, Human
aaaccaagtactaacttctacaatagaccagcaataagtttcagttcatgaagacgttttggattaaaaggtacttcatatacaaagatatatacatatatacataaatatataaaatatctatgtttaatatctatatttcaaagacatataaaatatatatttgaaagacttatcccctatggccagctgtaagaataataaatgcataaaagctgcctggggaattaatgtatatattttaaattcagtgcgtcaaaaatggtttgcatggcaaaaaatttcatgctctttgtgtcaytgacttcttttggcctgactataaaaaggagaggaaagatacctttttctcagaagataaactcgctaattaccaactcatgcagaaacctgtaattctgccagttttatcttattttttccccagacacttactttttatgccaatatcactatttctcaaagtgtgtttccctgttcactgcctttcctgttatttcctttgatgttttacattgtgtaatgccacaagaaaaaaagagacatcttaaaataccccagtagaggaaaatttcaattaacatttatagctggggagagt

SEQ ID NO: 150786 - DNA, 601 bp, Human
aaggacactctcctggaacacagtccaaatctagggtgcatagaagaaaccaagtactaacttctacaatagaccagcaataagtttcagttcatgaagacgttttggattaaaaggtacttcatatacaaagatatatacatatatacataaatatataaaatatctatgtttaatatctatatttcaaagacatataaaatatatatttgaaagacttatcccctatggccagctgtaagaataataaatgcataaaagctgcctggggaattaatgtatatattttaaattcagtgcrtcaaaaatggtttgcatggcaaaaaatttcatgctctttgtgtcattgacttcttttggcctgactataaaaaggagaggaaagatacctttttctcagaagataaactcgctaattaccaactcatgcagaaacctgtaattctgccagttttatcttattttttccccagacacttactttttatgccaatatcactatttctcaaagtgtgtttccctgttcactgcctttcctgttatttcctttgatgttttacattgtgtaatgccacaagaaaaaaagagacatcttaaaata

SEQ ID NO: 150787 - DNA, 601 bp, Human
ttttctgacttttctatattgactatgaggttttagcatctcttccatccaccaagggaattcagtcatgattatataatgttaaggttgcttaggaaaagtagccaggggaatgattggtcattggatagagattaactttattgagaatttaaaaagctgaaagctctcctggttaggagttttgcaaatagctccgtcctcattgtcatgaaaatcttgaacaatatggacgctcatccaattatcaaagcaacctggggggcagagtctggcattgtgtgtacccattattgaaggrtaattcagtgtaacaaaccaaatagagtatgtacaatgactgtcaaataaaataaaccactaacaaattaaattacttttcattttcagtaggaagaatgccagtcatttttcattttaaaaaatatgcatcttaattccattttttaaaaacgtgaaaagaagcatttaaaggcctcttgtgctatctatactgatgtttattttctatagatatatttctcctggtcctggggcattttccctcaaagaattagtggagcgttaaacctcgctttggtcaaaaaacctgtttcttcca

SEQ ID NO: 150788 - DNA, 601 bp, Human
ttcttcattcctaacttccatgttctccttcctaaaatcagatcttctcaggagtacccacagcctaggttctccttcttcctttttcaaaagaaagatatagaagatgtactttaacttatcctgaatcttaccaaggtgtactatgcaattcataaacattcctgagagggacatttgcatgatacttttaatcaaggccgcatagacgcccccatccccagatcattatgagatgcatttctaataaaatgttactttttatatttattcatcatttgtcagaattatatgtttatgytgttttgatgtattgtgttctattaatagtcaaagcaacaactaaacccagaagataattttaaagtcttacagtcatatattcataaaagaaaaagtctatttacatctatatttgtcatagaaatgatcaaaaaaccttttaacatgatttaggggaaatgcaataaaaatagatgtttgaagaagaaaaaataataatatgaagcttttgacttaaaaaaaatttgttcacatattcttttagtgggtattggtgagtatccagtaatgaggtatttaaatcccactggatgcaacc

SEQ ID NO: 150789 - DNA, 601 bp, Human
ttgttagtgttcaacagatgctccccattcccctctccaaataattgagattacatttagactgacagtatatatcaaggtcatggggtttggtgggttctgtatcatcaattaggaagtgcacataggaaggttataaccacacactggccccagataaggccttcaacaaacatttattgagcatctactacatgctgagaagttgccacacagagtatccttgagaagcttagaggaggtaggcaatatgtaaccccctccttcttcttactcaaaccaccccttttgggaaggctgyttgacctagaaaagacaaagatgagagcggaagtcctgggtgtccacctcatcctaggtatacggaaaccctgaccctggtgctctgggaccacaggtttgaggcccagtggagaatctgagggtgaatatgttatcccatcttgaggcactagacggtaaatctctcagaggggcttggaaattccagattccggcctcgcttcaaatttatcaccttgccttttcactgggcttccttcaagaaacagccttcatgactttttagtaacaactgggacccagacttcattttcaagga

SEQ ID NO: 150790 - DNA, 601 bp, Human
gtgaaaaggcacagcaaggggaggccatggggaggactcccctcaatgcgccttcatgagaggagtttttcacagagaaaaaacaacagctgtgtttaccatggcaacctccagcagctcagtaaattgacagattcaaggcaagactcggagaagagagaagagatggccagataggagataaagaacagaaaagatgaagtcatggagaaggaagaaaagagagatgtctgtctgtaggatgtggatggattttagctgtttagtaactctaggtcaaatctcattgaggtgaacagayaaacctttgaataccattgcttgttacgtacaagcataatcaattatgttatggaaggagcatccacattctccttcctaaaatcagatctcaggagtacccacagggtaggttctccttacttttgcaaaagaaagatatagaaaatgtaccttaacttatcctgaatcttactaaggtgtactatgcaattcataaacacttctgagaggggacatttgcatgatacttttaatcaaggccccatagacgaccccatccccagctcattatgatacgtacaacataatcaacattatg

SEQ ID NO: 150791 - DNA, 601 bp, Human
gctggagaggagtgagtaaggaagcatggcagttggagaagatgttggatcagtagtcagggccggatcaccaccttcactgtgcgggtgaggaaagctcagggaggtgtggctacctgtgagtagctgcctgatatgggactctatcctccctcaccattccttctgtctctgctcacccgctttgagtcttcctccctcaggttcttattatctttcccgcctctcctcttgggaaataccagatcatctttcacttcccagaacgcatttactaacaaaatgaatgttgctgtcattwggcttatttggtgaccacaccagcgattcttcacaatcttccatgacacctaagtgggggttggcgggtcacagtgccttgcttcagagacatgcaattaaagcagagtagagccctagaaaacaggaagcccctgaagcctccactttaaaaaacatatgtgaaaaggcacagcaaggggaggccatggggaggactcccctcaatgcgccttcatgagaggagtttttcacagagaaaaaacaacagctgtgtttaccatggcaacctccagcagctcagtaaattgacagattcaag

SEQ ID NO: 150792 - DNA, 601 bp, Human
ccatacagatttatgaatcctttaacagagaaagaacctgaactctagggtcttatcctattgttgataaaatcacctctaattttaattcatgacatataaatgcctctgtatgaaggaattgattcagagtcccaatccagagctagccctggcctcccacttgtaataacaatatttccctaactttattgttatgattaaagagtctcataggtgccagtgtattttaaaaggggcaagttctccgcaaatgctaggtgttgcatttctattccatattttctcccagcccactcgyacctgaatactcttaattcaggccagttgattcttgatcacaaagaaaggatactaaaactttgattggttatttcaaagttccataggttaatcctcaggtcatcagcggacatgtaggtttcatagtcgctgttgacagatatggagttgatgtgatatgtgtgtgcgttggcaaatactcttcgtggggtggcctccaccatcaggtccatgggtctcaggacaggcacctgggatgcaagagaaacaaatcacttcagaaccaaagatcttccataggaaaagagtgtgcatgcta

SEQ ID NO: 150793 - DNA, 601 bp, Human
gtacacactgaacacatgtctccacacctctttgccaagttagttcatagtcttcctctttcagatcttaactaattcttcagcaaagccttccctggtctatagcaggatttttaaaaatgcattcatagaaccatattccctgtcttcacagaaattatctcagtttgtaattatatactcagtgtatttgatgaacattactctgaaagcggcaaatttgttttttcccattttcatgcctggcacaaactaggtgctcaatttatcatcgttgagggctagtctttatttttactcratatgggcctatttaatagatcccatgttggacaaggtaagaactcaggtcagttcattcttagtcctgcaaaaagagttcaaaggattctaggtataccatagttttcataaagaagcaacatcttttaatataaattttcatttattgctattgtctcttgccctagaaaactactaatctattaatgacttgttatagtcctgatgtagttagcctattaagacgaaagtttgactgcttatgtgggaaactgttacacaagacaaggacagactggctatggatggaagggagaga

SEQ ID NO: 150794 - DNA, 601 bp, Human
ttgtttattgctaaagtaatttaccaaaaaataacttgtattcatgtattatttgtattaaaaataatatcaataaaagaatatcgtaatgcaaaaaaaagtggattaggaacctgaacttcttcccttaggaaagtttcaaaaaaaaaaaaaaaaaaaaaaaaagaagaagaagaaagattcttgggtaaatcaggagttttaaattgtttttggctttggcttttaaaatttcttttatttccccctgaacccacattgttgaattagctagcattaagttaaaactgtgatgcgaatmcaatgtatagacagcaaaattggtagtaagatttttggtcattttattttccccaaatctctacaatgaatacatattaaacaaagaaaacaataagcattaaaaaatagcagtttccctggcttaaaatcatctgtgagagagctgcgagaccaggaacctcatcgcgatgggtaaagtttgagataatattgtgaaaaatactgtgattgtaacaaaatggggaccagagattgggattcagttttgattctatctccattttgctaagagaatttgggaaagtcattttatctctct

SEQ ID NO: 150795 - DNA, 601 bp, Human
tgggcctcatctcatcagttgaaggcctgaagagaataaaaacgctgaccctcctgcaagggaaagagaactcctctgccagactgccttcgagctggaacattgtatttttccccccttgcttctggaattgaatggaaacactggtttttcctgggtcttcagcctgagggttttgtttatttatttttttgagatagagtcttgctctgtcgccaaggctggggtgcagtggggcaatctcagctcactgcaacctctgtatcccaggttcaagcgatgctcctgcctcagcctcctragtaactgggactacaggtgtgtgtcaccacacctggctaatttttgtatttttagtagagacggggtttcaccatgttgcccaggctgttctcagactcccagccttgggtgatctgcccgcctcagcctcctaaagtgctgggattacctgtgtgagccactgaggccggtctctgatggcttttagattagaacaccaccatcggctctcctgggtcttcagcttgctggctgcagagcttgggacttgtcagccttcataaccatgtgatctcattccttatgataaatctcttaa

SEQ ID NO: 150796 - DNA, 601 bp, Human
gtgtttctgtaaaggtgtttttggaatagtttaacatttacattaatagactgagtaaaagagattgtactgcctattgtcaatgggcctcatctcatcagttgaaggcctgaagagaataaaaacgctgaccctcctgcaagggaaagagaactcctctgccagactgccttcgagctggaacattgtatttttccccccttgcttctggaattgaatggaaacactggtttttcctgggtcttcagcctgagggttttgtttatttatttttttgagatagagtcttgctctgtcgccraggctggggtgcagtggggcaatctcagctcactgcaacctctgtatcccaggttcaagcgatgctcctgcctcagcctcctgagtaactgggactacaggtgtgtgtcaccacacctggctaatttttgtatttttagtagagacggggtttcaccatgttgcccaggctgttctcagactcccagccttgggtgatctgcccgcctcagcctcctaaagtgctgggattacctgtgtgagccactgaggccggtctctgatggcttttagattagaacaccaccatcggctctcctgg

SEQ ID NO: 150797 - DNA, 601 bp, Human
tgggtgtttctgtaaaggtgtttttggaatagtttaacatttacattaatagactgagtaaaagagattgtactgcctattgtcaatgggcctcatctcatcagttgaaggcctgaagagaataaaaacgctgaccctcctgcaagggaaagagaactcctctgccagactgccttcgagctggaacattgtatttttccccccttgcttctggaattgaatggaaacactggtttttcctgggtcttcagcctgagggttttgtttatttatttttttgagatagagtcttgctctgtcrccaaggctggggtgcagtggggcaatctcagctcactgcaacctctgtatcccaggttcaagcgatgctcctgcctcagcctcctgagtaactgggactacaggtgtgtgtcaccacacctggctaatttttgtatttttagtagagacggggtttcaccatgttgcccaggctgttctcagactcccagccttgggtgatctgcccgcctcagcctcctaaagtgctgggattacctgtgtgagccactgaggccggtctctgatggcttttagattagaacaccaccatcggctctcc

SEQ ID NO: 150798 - DNA, 601 bp, Human
catgtattgcagttgcgatgctatatttgtttctgttctctaactaatgcatcttctctccttagacagtgtggttaatgttatgtattagcttgactgagccatgggctgcccagatatttggctagaaattctgggtgtttctgtaaaggtgtttttggaatagtttaacatttacattaatagactgagtaaaagagattgtactgcctattgtcaatgggcctcatctcatcagttgaaggcctgaagagaataaaaacgctgaccctcctgcaagggaaagagaactcctctgccrgactgccttcgagctggaacattgtatttttccccccttgcttctggaattgaatggaaacactggtttttcctgggtcttcagcctgagggttttgtttatttatttttttgagatagagtcttgctctgtcgccaaggctggggtgcagtggggcaatctcagctcactgcaacctctgtatcccaggttcaagcgatgctcctgcctcagcctcctgagtaactgggactacaggtgtgtgtcaccacacctggctaatttttgtatttttagtagagacggggtttcaccatgttg

SEQ ID NO: 150799 - DNA, 601 bp, Human
agcaacccacctgcctcagcctcccaaagtgctgggatcacaggcataagccaccatgcctggctgtggcctcactttctatactgtccctagcctacttgtatccatccactgatcttttttctctattctttgaacacacaagtttcctcctctgttagggccttcacacttagatgttggctttctctttggatccgtctgataacaggtcttaattcaaaggctttgccacataccactacttcctgaccctgctaattttcttacagcttttttatcatgtctgaaatgacctcgkttatttgtacatttgtgttttctctcatccctccccacaagaaagtatggtccttaaaggcagaaaccagcaggtgtttaatcaatcttagttgaataagtagtttttggtgttctcttgaagagctacaggtggtctggctcaaacctcaacttcatcacttgctctttggtggccataagtgtatctttcccccttttagctagttgcctcatctctaagatgtgaataatggcagtatgtacctcatagggttgttatcaggattaaatgagctcatgcatgtatacttggcttact

SEQ ID NO: 150800 - DNA, 601 bp, Human
gattataggtgtgtgcaaccacacccagataatttttgtatttgtagtagagatggggttttgccatgttggccaggctggtctcgaacctcctggcctcaagcaacccacctgcctcagcctcccaaagtgctgggatcacaggcataagccaccatgcctggctgtggcctcactttctatactgtccctagcctacttgtatccatccactgatcttttttctctattctttgaacacacaagtttcctcctctgttagggccttcacacttagatgttggctttctctttggatccktctgataacaggtcttaattcaaaggctttgccacataccactacttcctgaccctgctaattttcttacagcttttttatcatgtctgaaatgacctcggttatttgtacatttgtgttttctctcatccctccccacaagaaagtatggtccttaaaggcagaaaccagcaggtgtttaatcaatcttagttgaataagtagtttttggtgttctcttgaagagctacaggtggtctggctcaaacctcaacttcatcacttgctctttggtggccataagtgtatctttcccccttt

SEQ ID NO: 150801 - DNA, 601 bp, Human
attcgatggcttgggcactgcctgctctgttaattgctgctaagcttgaatgggatagagcagcttcagacatgggggtgaggtgggggtggtggtggtatcagtgaattctgctccttgcagcaaggcttttggcttttctccagagtgggaagtgtgtgtctgtgtgtgtgtttgcaatcctgccatcaggcaaaagcattttaataaaggaccttgtctttttaacctaaccaagctcccctgaaataaatactgttaattatacctcagatcaatactgaaccccttttggaagatrtgccaaatctcaggggctttaagattcattgcagttgctgtctcagctgatgtctttggacacattccatcagggacctggggaatgagccacaggtttattagggagctctagtggcttacttaccaggggttggcaattaagtttgtagatgagggtgaagaatgagagtggattttatgttctgtgtaatggcagaattaattctatggttgaaaatggtcaggctggggaatccagccagatggggattgtataaaatggactcttgtgaaattatccttctggattttagaaaaa

SEQ ID NO: 150802 - DNA, 601 bp, Human
aagccctaggtcagcattccaatattactctctacttcattctgctgaaatgctccattgaggtctgacccatctactactcatttgcaccagagttgaataactcctacctccagggtccaggcaggtagtgaaatagatgacacattcatgggtagcaatagggaacagtagggactgtggcaaactagagtgtccacaccctataaaaggggcagtttccacctgaggtcagcagttcgaagccagcctggccaacaaggcaaaaccccgtctctactaaaaaaaaaaaaaaaaaaaatacaaacattagctgggtgcagtggtgtgtgcctgtaatcccagctcctccagaggctgaggcaggagaattgcttgaacctggtaggcggagattgcactccagcctgggtgacaaagcaagactctctcaaaaacaaacccaaaatacaaacaaacaaaacaaaaccataaaggggcaatttccactctgctccggctgaatgcagccatgcagaaatggggctccagcacagccagactaatttgtaaggcctaaattttttgaggaactctaattttttcatgttagcaactaact

SEQ ID NO: 150803 - DNA, 601 bp, Human
taaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtkcacatgtaccctaaaacttagagtataataaaaaaaaaaattaaaaaaaaaaaaaaagaaaaaaaaaactattagaactgaaaacaaattcagtaaaactgcaggatacaaaatcaagatacaaaaatgatctcaacagcaaataatctcaagaaattaaacccatttacaacagctacaaattaaaaaccaaggatttaacttacttacccagagaagtaaaaggtctctacaatgaaaattaaaaaacactgatgaaagaaaaggaaggggacacaaaaaatggaaagatattccaca

SEQ ID NO: 150804 - DNA, 601 bp, Human
aaggctttgcatatggacattgaaatttcaattttgtataatttttatgtgtcataaaacactattcttttttgatttcttcaactatttgaaaatgtaaaaatactgttctttgctagagttgtaaaaaagaaaagttgtgagtcagacttggctgtatgccatagtttgctgagccctgataatggtgtttgaggggtaggagggggcatcctatctagacaggggaatcagcatgaataaatgcctggggtgatcaatgcatttttgtgggacagtgggcccctaggactggtagcamcatgagatcatgtagaagggctggaagatgagatttctgcttaaactgcaaatttctttcctaaactacatctctcaggatggtacatggaatgaacttaggagtcagacatattggggctagaacctgggcttcatcatctccaggttggattgtctttgtcagttttccttatcttgttaagacgcaacttatctttaaaatgtagacatcaatatcttatttgcctggttataaaaatgaaaagagataaaagcaaataagacatgtagcacaggacaggcatggtggctcacacct

SEQ ID NO: 150805 - DNA, 601 bp, Human
cagggcctagtgatcagccccttgcctctatctccaggctcatccttctgcctttgtgattcatattcaaggtgtaagcaccctgaacacacctcatttctcttgacaccaggcctttgaacacactgtgtttttaattattacactgtaagttctgagatacatgtgcagaacatgcaggtttgttacatatgtatacatgtgccatggtggtttgctgcacccatcaacctgtcatctacattaggtatttctcctaatgctagtcctccctgagccccccaccctctgacaggccccrgtgtatgatgttccccttcctgcgtccatgtgaacacactattttaagagcatgcatttcctgactagttcatggcagttaagactcagtttaagggtcacttctttgggaaaacctttctcacctggctggaccatctcttgcagagatgcacactcaattccttgttcatcatctgacttttccaccagatggtaagctgcatgagagcaggaccatttgtttacctctatagtatccattccacatgaagtgctctgtccatatcaattaaattgaattctagcctctccacatgta

SEQ ID NO: 150806 - DNA, 601 bp, Human
actcttcatcctacccatccttccatctgcacgctaccatcaccagaccaaattgccatcatctcctcttatctaaattgtctgtttggcaaactgcaaagtgaaacacacagtaaaaagtaaaactcacaatgttatttcctggtgtaaaactttaatggtcctccattgtacccagtccacaggcaaaacagcctactgtatattaccagggcctagtgatcagccccttgcctctatctccaggctcatccttctgcctttgtgattcatattcaaggtgtaagcaccctgaacacayctcatttctcttgacaccaggcctttgaacacactgtgtttttaattattacactgtaagttctgagatacatgtgcagaacatgcaggtttgttacatatgtatacatgtgccatggtggtttgctgcacccatcaacctgtcatctacattaggtatttctcctaatgctagtcctccctgagccccccaccctctgacaggccccagtgtatgatgttccccttcctgcgtccatgtgaacacactattttaagagcatgcatttcctgactagttcatggcagttaagactcagtt

SEQ ID NO: 150807 - DNA, 601 bp, Human
taaagaaaacacctacatgttcccatcacaaaattcacaaacctacttcatctatataagaaaactactctccttcctttgatagatgaattatctttgcatcttaccatctacagccaattctgcaatggactccatcccctctggcttcccccaagggctttgctccttcagcggtctctctctaatggtctctctctctagtggcttattcctatcagcagaaaacatgctgtaataacttccttcagccagaatcccatttcagctacccttccatttctctgttctccttcagagyaaacttgttgaaacagttgtctgtcctcataatgttcccatcttcagtttcttgaactcactccaattggacatttattcacactgctctactgctgttcctctgtcattcaggttactgataatctccacttactaaatccaagttcgtagtcttctgtacttgattcagcaaagcatttggcagttgatgacttatttttccttaagacagtttctctatttggcttcctagtcactcctctcatctcactggctagtttccccaaatctctcttgccaaatcctcttcctattctca

SEQ ID NO: 150808 - DNA, 601 bp, Human
agaacttaaaactcatcctatttgatgttctttcttcatgttcctagtatgacttttctatgatcctattaatttgtgcatgggattttggacgccagactgagtgtcccagtacagtgtttctcatatttatttgtgggagtccagtgtcatatagttagtggactgctatgaggcaaacaaagagccaactctattggtccgttcttatatttcaagtgttgacaaactttttctccaaagggccggatagtaaatattttaagctctgtgggccatatggtctctgtgacagctactmaactctgccattgtgcatggaagcagccatagaagatatgtaaatgactgtacatggctgtgtcttaataaaatttacctacaaagacaaatagggggctggtttggaacacacgttgcagtctgccaacccttgttctatggaaaaacttgaaaatagctaatcatacttaagtctgcagccttttattcacggaaatgtgattgagatctgtgaatgcatgtatgaaaatgtataatagtagcattacctgtctccttgcccaggggcaggcattattaactgatctttcattaacta

SEQ ID NO: 150809 - DNA, 601 bp, Human
acctctagagcttggagcaagagagaacttaaaactcatcctatttgatgttctttcttcatgttcctagtatgacttttctatgatcctattaatttgtgcatgggattttggacgccagactgagtgtcccagtacagtgtttctcatatttatttgtgggagtccagtgtcatatagttagtggactgctatgaggcaaacaaagagccaactctattggtccgttcttatatttcaagtgttgacaaactttttctccaaagggccggatagtaaatattttaagctctgtgggccrtatggtctctgtgacagctactcaactctgccattgtgcatggaagcagccatagaagatatgtaaatgactgtacatggctgtgtcttaataaaatttacctacaaagacaaatagggggctggtttggaacacacgttgcagtctgccaacccttgttctatggaaaaacttgaaaatagctaatcatacttaagtctgcagccttttattcacggaaatgtgattgagatctgtgaatgcatgtatgaaaatgtataatagtagcattacctgtctccttgcccaggggcaggcatt

SEQ ID NO: 150810 - DNA, 601 bp, Human
aggatagcccggggcttgctgttttccctcgaagcctcaagggtcacatcacgcttggtgtttctgtcgaacatcctgaagaagttgttgtaggagcctgtcatgatgacactgcaaggcagagagcaaaggcaatgacatatcttcactgtcttttctttttggagcaaatgataccatgttatggccagcttatgacaccataggttttattaaaaacaaaaaccaaaaaatgagaacaggctctgcagtgtgattattggctttttgttttttttttgtgttttttttttttttttttgaatcactgaaagcaataggatttttggctgggtttggaaatgagggatggtgagaactctccttgtaatttgcttttgctcaatagattctttttgcttctttggctcagaaaaggtgtccactggttttaatgatcccagtcctacctacctcccatcaggaatgtgagactagaatgaggtttgtcgaagtagacacacttttgaaaacaataagcagttgtacgtgtttaaggtttggccactgtcaacagggttcctgggccgtctggcctctaaggcttcatggcatcagtgca

SEQ ID NO: 150811 - DNA, 601 bp, Human; identical to SEQ ID NO: 23280

SEQ ID NO: 150812 - DNA, 601 bp, Human; identical to SEQ ID NO: 23281

SEQ ID NO: 150813 - DNA, 601 bp, Human; identical to SEQ ID NO: 23282

SEQ ID NO: 150814 - DNA, 601 bp, Human; identical to SEQ ID NO: 23283

SEQ ID NO: 150815 - DNA, 601 bp, Human; identical to SEQ ID NO: 23284

SEQ ID NO: 150816 - DNA, 601 bp, Human; identical to SEQ ID NO: 23285

SEQ ID NO: 150817 - DNA, 601 bp, Human; identical to SEQ ID NO: 23286

SEQ ID NO: 150818 - DNA, 601 bp, Human; identical to SEQ ID NO: 23287

SEQ ID NO: 150819 - DNA, 601 bp, Human; identical to SEQ ID NO: 23288

SEQ ID NO: 150820 - DNA, 601 bp, Human; identical to SEQ ID NO: 23289

SEQ ID NO: 150821 - DNA, 601 bp, Human; identical to SEQ ID NO: 23290

SEQ ID NO: 150822 - DNA, 601 bp, Human; identical to SEQ ID NO: 23291

SEQ ID NO: 150823 - DNA, 601 bp, Human; identical to SEQ ID NO: 23292

SEQ ID NO: 150824 - DNA, 601 bp, Human
ttacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacgtgagtatccagccgccgctgatccgggcgagggggagtcgttggcgacgggcagcgcccagcgcggctttctcagagcgaccccctccggcgcgctgcggcccttgtcccgtcccggccgcctggcgctcgccagctgtcagcctcctggtgggtgtggccagggtgcccacctccctgccgcgcggtcagccaccgacgtggctttgcccgggcggttcctccgcccgtcggtgggctgcatgctttcctggctgcgcgggcgaggccctggagacttcccggggcccggccctcgccgatcgggcagccgcagcccagccgcgccgcggagccctgcgcccagtccccaagagcccaccccgcgcggctgccttcctgccgcccgcggctgcagttagcccgggaggaggaagacggcgtggaactcgttcttctcgcccccctccgccgactcccat

SEQ ID NO: 150825 - DNA, 601 bp, Human
ggctaacacttttatgcagataagtcccagatggaaatcaatcttgccattacaaagtaaatgtgaaaatgtcagtttgcctaaaatgataatgcagtctggaggtgttagttgaagtgagaaatcttgagcttattcttcatttttttcagttgttttgcttttgctagctataaagaatattttctgctactcgtgtgtggttttaatttagtataacttcaatactaatggtctgtttaaaaattctacatcattctttaatccagattaaattctagttgatcctcccgaatgggaraaaatgccattaactttacctgtttgttaaaatatagtaccagcctttattgaaggagtctttgtcataaccattttgccagtgtcatccatttgcagtgtaaaaaaggtatgttgcaatagtaaaacaattcaaaaaattatttttccatatctaaacttaagcaatattaaaaatagtgggtttcctggctaatccatgtaatcggtgtatactactcgtatagtgtataatttaactatctattgaaaaatgcatttaatttagaaactcagaaatctgtctttcccttgtccaaaa

SEQ ID NO: 150826 - DNA, 601 bp, Human
taatcccagcacgttgggaggcctagatgggaggattgtttgagcccaggagttcaagacaagcctgggcaacgtggcaaaaccctgtctctatgccaaaaatacaaaaattagtgagtcatgttagcacacacctatagtcttagctgcttaggtggctgaggtgagaggatcactgagctccggagatcaaggctgcaatgagctgagattgcgccattgcgctccagcctgggtgacagaggagaccctgtctcaacaaatttaaaaaaatatatgtttttattgaggtatagatgacaaaaaaaaattacatatatttaccgtgtacatgttatttttgtatatgtatatattgtgaaatgggtaaatcaagctaactaacatgtctatcaccactattccctctttattagcttttaatatatattagttttctgaaattttagattgcttctgaggttgttaatatcaggaatagttccttgtaatatgcaatactgaacctgtgtcacaatagatcttaatttcaggttttccttatatcaaagtatcctcgaaaaacccaaatgcttatacgttcacagtttttatgtggagt

SEQ ID NO: 150827 - DNA, 601 bp, Human
aggggacatggagtgggctgatactaagttgtctgtcaggaattctcactagtttatagaaataactttggttaatgattgactaacattgttgagatgcagggagtagtttatagtgtgtggtgcagcattattaggttattttctagttacttgtggcagtataaagcagtttcaatagataaatatttctcatagctcaaaggagagaagtaggatgtgattgctgtcacattttaatgcctttctgggccagatcatttaaaaggacttgcattcctcagataaaagtttctttctygatgccgtattttgtttatccgtttgtcagtggaaacttgggttgcttccatcctttggctattatgaataatgctgtgaacatagatgtactgatatctgtttgagtgcctgcttttactttttataggtacatacccagaagtggaattgttagattatatggtaattttatgttttgcttttttgtggggaagcggcacatcattttccacagtggctgtaccattttacattcccaccagcaatgcacaaaggttctagtttctctacatccacgttattttttgttttttgaaaa

SEQ ID NO: 150828 - DNA, 601 bp, Human
aactgctgtgtaaataataatgattacttttattactgcttgttactttctacttctaagtggaagatcatgtagtcagtcataggactatagaacacaccagagattgttctcaaatactctttgtgttttctcagaatgaattatctcttttattttattttttttccaaaaaccccagtgtttaaattatatgggccctgttttggtaaaaggcaaaaggtttgtaagatctgaagagaaaccagagtatgtgggccctgttttggaatgaacttgctgcttataaaatggaaagtcytcaaacactcttccacagaaaagttctgtaagaagacttttataggagaaagtatggctgtaaaagttgccccagcttctttcattttctctgagaaattagctaaccttttaaaaaaaatcttaattaaaatatagctctcacatgctataagattcacccatttaaagtatataatacagtggcttctagaattatatcatggttgtgcaaccatcgccacaatctaagtttagaacatttttgtcaaactaaatgaaatttagtaactattagcagtcactcttcaatccccactcc

SEQ ID NO: 150829 - DNA, 601 bp, Human
tgagcttttggtatcctatctaaaaaatctttgcctactccaaggtcaaaatcttgtaactgtgtttcctttcaagagtttagtagccttaattcttatacctaggtctgtggtccatttcaggttagttttgtgtatggtgtgaggtggggatccagttttattcttttacatgtggatatttagttgtttgagcaccatttgttgattattctttccctattgaattgccttggtactttactccaaggtttcctcccagattttatcttgttcttggagttcttagaccttccagctrccaccatggttgactctctaaatatttcaaactcagtctgtcaccttctcagctttttgttatttcagtaatagagtgtttgccattgaaattgggaaatattttaatatgtgtctttgttcattttttgcttctataacagaatacttgagactcagtaatttatagtgaacagaaatttatttggttcatggttctggaggctgggaagtccaaggtcaaggagccacgtgtggtgagggccttcctgctgcatcataacatggtgaaaggcatcacatggtatgcacacgtgggcaa

SEQ ID NO: 150830 - DNA, 601 bp, Human
tcatatattttcttgattctgtgattttgtccacattttacttctgcccttcatgtaacttcatactccccattctctatatttttgaattctacctattctttaatgcccttcctcagtatttgtcacttttctttgaagatgacagtcttgctgctcaaaatcattgttcctcttgacttcttacagtatgttatttgtactactcttatgtcagaaatcgccctctaccttttattataaagttattttctatatatgtatgcttatatatgtgtgtgtgtgtatgtatatattttacatctatctatctatctatctatctatctatctatctatctatctctgtctctgtcacccaggctggagtgcagtggtgcaatctcggctcactgcaacctccacctcctgggttcaagcgattctcctgcctcagcctcctgagtagctgggactacaggcatacaccaccatgcctcaccactttttttgtatttttagtagagatggggtttcaccatgttgatcaggctggttttgaactcctgacctcaaatgatctgcctgcgttggcctcccagagtgctggaattacaggcgt

SEQ ID NO: 150831 - DNA, 601 bp, Human
actgtgcatatttatggggtacagtgtgatgttttgatctatgtatacattataaaaggatccaatcaagctagttaatacatccagcatcttttttttttttttctagagatagcatcttgccctgtctcccaggctggaatgccctgatgcccaggctgatgggcagtggtgtgatcattagctcactgcagcctcaacctccagggctcaagggcctcaagggatacttttggctcagcctccttggtagccaggactacaggtgcccaccaccatgctcaactaagtttttaaaacrtttttgttgttgttgtttagatggggtctcactttgtagcccaggctggtatgaaattcctggcttcaagcaatcctccggcctcggcctcccaaagtgctgggattacaaacgtgagccactgcacctagcaacgtatctataatctcaccaacttattatttctttgtggggagaatgttaaaaatacattcttctggaagttttaaaatatatattattattaactgtggtcaccatgcagttcagtagatcacaaaaacttattcctccagtctgactgaaactttgtgccctttg

SEQ ID NO: 150832 - DNA, 601 bp, Human
ttaaaacatttttgttgttgttgtttagatggggtctcactttgtagcccaggctggtatgaaattcctggcttcaagcaatcctccggcctcggcctcccaaagtgctgggattacaaacgtgagccactgcacctagcaacgtatctataatctcaccaacttattatttctttgtggggagaatgttaaaaatacattcttctggaagttttaaaatatatattattattaactgtggtcaccatgcagttcagtagatcacaaaaacttattcctccagtctgactgaaactttgtrccctttgatcaacatttttgctttccccgttcctccttttattcccaccaccagccgctggtaaccaccgctactgattttcttagttgagtattgccagcattctaagaagattccaagtggcagcagttgaagttcctatgagaaattctttcactatcaatgtaatgaaacatagttaaaggttagcacagttgacctcttccttgataagcagtaatataatacagaaagataacattccttaaaagaaaacttcctatgagattttattgtccttagaattgtagagctgacttt

SEQ ID NO: 150833 - DNA, 601 bp, Human
gtatgaaattcctggcttcaagcaatcctccggcctcggcctcccaaagtgctgggattacaaacgtgagccactgcacctagcaacgtatctataatctcaccaacttattatttctttgtggggagaatgttaaaaatacattcttctggaagttttaaaatatatattattattaactgtggtcaccatgcagttcagtagatcacaaaaacttattcctccagtctgactgaaactttgtgccctttgatcaacatttttgctttccccgttcctccttttattcccaccaccagcygctggtaaccaccgctactgattttcttagttgagtattgccagcattctaagaagattccaagtggcagcagttgaagttcctatgagaaattctttcactatcaatgtaatgaaacatagttaaaggttagcacagttgacctcttccttgataagcagtaatataatacagaaagataacattccttaaaagaaaacttcctatgagattttattgtccttagaattgtagagctgacttttcagataaggcccagaggtagtacttaaaaataagtcagtgttaatgcatgcttat

SEQ ID NO: 150834 - DNA, 601 bp, Human
ttttaaaatttctccatatattttaaattcccatgagcttctttatttctgaatttcactcttttataatatactgttattttatagttgtattatcttttcttacttctcttatattaatgatatatatttttaaattttcttctttttacttggtttgtttcctctgagttgctttttcccctattttatgtttaactttttaaaaaaatttatttattttttattttttattttttattatactttaaattctgggatacatgtgcagaatgggcaggtttgttacataggtatacamgtgccatggtggtttgctgcacctatattagagttgtcttcagctgtccaataatccttgactgactgctcctttctaaggatagggtactgaaagctgattggaagctctcaatccatgattagaggttgcctgtgcgatctttacttgaggtaatcaagctaggcagtttaggtagtgtaggaattggaattgtgactacaactccccaaatcgtcatgacttaacgtaatacaagtttgtttctcacttggataaagcccagcgttggtgttcttggtcaactagaacctttcatgt

SEQ ID NO: 150835 - DNA, 601 bp, Human
ttccctctcaccaatttaggattaaattttctgagaatactttaacacttatttaaacactttcaagattttgttgttgttgtcttcctttcccattctcctcatccttgtgtgtttatgcctttaccaaaaaagccctttaatattgtcttagctggggtttgggcaggcaacaaaggcagatgtgtgtttaatttaccatcttaattagaacacagcttgcacttttaacttctgtaccatactgccttaactttattgccttttttatgtgtaaggtaacccagattttggataatayaaatggttgtggatcctgtcttctagattacaaatttatttattcaatacgcttttattggctactctacatcagccactttgctgagcatttcaaatacaaagctcaggttccggtgttagaattcagactactacaaaggaaatttgagcacattgttataagtgtatgataggaatagaaacaatactaaggaaccatggagaaaaaagggactaattttaattgagagtcaggaaagacttcatagaagtcataatgttctagctgtgtcttagaaagggtgttgctagagaatgg

SEQ ID NO: 150836 - DNA, 601 bp, Human
tggggtttgggcaggcaacaaaggcagatgtgtgtttaatttaccatcttaattagaacacagcttgcacttttaacttctgtaccatactgccttaactttattgccttttttatgtgtaaggtaacccagattttggataatataaatggttgtggatcctgtcttctagattacaaatttatttattcaatacgcttttattggctactctacatcagccactttgctgagcatttcaaatacaaagctcaggttccggtgttagaattcagactactacaaaggaaatttgagcacrttgttataagtgtatgataggaatagaaacaatactaaggaaccatggagaaaaaagggactaattttaattgagagtcaggaaagacttcatagaagtcataatgttctagctgtgtcttagaaagggtgttgctagagaatggagtgtggaagttgttcccagacggaagtgggaaaatgtgaagaaggtgaatggtaagaagttcaatgtggctggagcagatcataaaggggagaagaaagagatgatgaaacttcagggattagtctggcttagattttggagaacgttttatgg

SEQ ID NO: 150837 - DNA, 601 bp, Human
catatgaagtgctactagtgatgttggaagtgctcccaagcagcagagaaatatcatgacgctacaagaaaaagttgaattgcttgttatgtaccttagatagaggtctgtggctgtggttgcccagtattcaatgaatccagcaaaaggactattgtaaagaaaataaaattcatggtcaggcacggtggctcatgcctgtaatcccagcactttgggaggccaaggcaggtggatcacttgaggtcaggagttcgagaccagcctggccaatatggcaaaaccccttttctactacaartacaaaaattatggctgggcgtggtggctcccatctgtaatcctagcactttgggagaccgaggcgggtggatcacctcggtcgagttcaagaccagcctggccaatatggtgaaacctcgtctctactaaaaatacaaaaattagctgggcatggtggtgggcgcctgtaatcccagctacttgggaggctgaggcaggagaatcgcttgaacccaggaggcggaggttgcagtgagcgagatcatgccattgcactccagcctgggcaacagagcaaaaactatctcgaaaaaaaata

SEQ ID NO: 150838 - DNA, 601 bp, Human
tattggacaatccccctggcatcccagaaccccatgagttcaacaccaaaggcattgaagtggtcaccttgcccccagtcacaaagtttgtaattcagcctaaagatcagggtcataaggacctttagggctcattacacttggtatttatggaaaggattttcaacactatgcaagagaatcttaatagaatatcatgcaagtctggaagggtgacatcattaaagatgtcattgttgttatagaaaaagctgtgaaagccatgaggcctgaaacagtgcattcctgctgaagaaaaccktgtctatatgttgagcatgacttcacaggatttatgacacaaccaatcaaagaaatcatggaagagattgtgaatgtagcaaaaaaggtgggagaatgaagggtttcaagataagggtttcagagaaatctaagagcgcatagcacaacagagtaattagcagaacacattttgatggagatgagtgcttctgaacaatgccagatgataaggaagtagacttagaagaagcagcgccagaaaacaaattgacattagacaatctggcagaagagttccagttattcaagactgctttga

SEQ ID NO: 150839 - DNA, 601 bp, Human
tttagtatcttagctcagttttcttgcatttatgtcaaaacaatgtaattttggaagagatcttgacggtaaatctatccaaaacttaagaagtgtcattcttcttttttttctggttgataatcagtcttaagctgtgtaacttactgtgacgtatggagttaaatctagtaagcacttacaaatgccccatgatctaatttccgcctacttctctgactttatcatttactaatcttttcttatctactggccttttttctcttccctgaacatacatactttgttcttgatgaaatgkccttttagtacttactaccttagcctgaaatgctcttctctaaattttttccaagccaactccttatcattagatctcagcttaaatgccactcttgcttaatattcagcctgaagtagggaacccatcaatatatcatcattgtattttgattgtcagtgtaacacttgccactatctgatgatgttctgatgtgtgtgtttgttgcttcttccccactaccagtgcttggcacatagtagttactcagagaatagtttaatgaatgaatgaactgaaattaagcactggcttctttta

SEQ ID NO: 150840 - DNA, 601 bp, Human
atgtaagttacagcaaggagcttaagactcgtgggtttcttaacacatgtatccaaaactaaccctaaaccctacctctccctgtctcctgaaaatctttcataatgtccctggaactcaaggtcagtcatcagcaaatttctttttatcttcagcctcttctgttaatattactttacattttgctctaaattaaatcttgcttccctgatgatactacgtgcaaccctttgaagtagtggccattttctctcctgcttctttctgcctttgagcctggaggtgtaatcttagcttctcrttgcattttccagaccattctttcttctcaaacacctccaaattttatcttatgttatcagactataccaccttctatccatttagttatagtcatcactcatctccatctctccttcattggagattttgttaagaattgtgaagggtctgagatttgctctacttgcaaactaagaagttaacctgccataatttcatggatgctggcagaaggcaggagatttctgggccagagacaaaggaccttattactaatagcaaaaacattagctaaagtgacagcatttgcttgcacgaa

SEQ ID NO: 150841 - DNA, 601 bp, Human
aagagagcattatatttttacagaaaaaaaattaatatagaaccatgctttctatttctctgtttcccatgactgaagagagtggtagacatgcacactatgttccaaaacactgtttttatttacctgagcctagccactagaattacaggaagaaaaacaggagaaagtgtaccatttcaaatttagtctcttattgaagagaaatgttgctattaagaaagaccaaaacaaatgtgtcttttcctagaggtaaatcagaagtattttatgcttgcgtcctgagattaagtcatcaccrttgattattattttgatgctgttgttgatcttcttatgagaaagtagttctatctccaaaggggattagatggggagttttcaaagaacaaacatggtattaatatatcatatccaaagtaaattctgtcatgtactcgtggaaagtagaaactatcttttgtgttttgcaaaattttttatccatgcttcacacgttgatcacttgttttgatattagataacatacagaagaaaggatttcaggaggactttgtcattttccgattactaaagtaggctagagctgtttttacaatac

SEQ ID NO: 150842 - DNA, 601 bp, Human
aattttatatgacacatttatgtgataagaaatagtcttcattggggaaatttataagccaagaatacttaagtgaggaaaggtctctgatcttcccagcatcacctggcaaattatggcgaggtaggtacttctgaccgactgaatatacagtggtgtgccgatgaaggcccacccaattatggttctcatctatcatgatggtaggcctgaaagcacacttggtggtggggtgacagatacactgtttaagccttgggctatgtaggtttgggtaccacctgttttttaaaattgcctrggaaaaccgactgtccagcacttggaaattgtgggaatttgcaactctcctgttggagatgaaccaactcttggtcccagaggaagatgagtttctggtgcagttcctcctgctggagcaagagggattcctggcctagcgagcttattttccaggcactcaagtgaatgcccaggatcattttaggaaaattctgcctcctacattatactgtattaccaggttatttaaaactttctgttttcagtaagatttgtttctcatgtatttttgggcaacccccagtttttttaaaatagt

SEQ ID NO: 150843 - DNA, 601 bp, Human
tgggcaagaataccacagaaataatgttatgtccatagtgcatcatatcaggaggtatatgatgtccatttgttccactacttgtgatatttgtgatgatcacttggttaagtttgagtccaacaggtttatgcaccataaagtttcattttcccatggtgctagtatttttatggggaatatttgagactatgtaaatatactttttctagtcatatatttgttaattcatcttaatatctattgatcattcttacctaaaagaattattaatatttatggtgtttaccaaatggtgggktttttttctatcatacctcaatatttaatagttgaaattctcctgtgaggaaaagctttgtaatatatatatatttttattgtactttaagttctgagatacatatgtagaaggtgtaggtttgttacataggtatacacatgccatggtggtttcctgcacccatcaacccgtcatctacattaggtagatgtaggacagcattatcttctaatgctatccctcccctagccctccaccccctgacaagtcccggtgtgtgatgttcccctccctgtgtccatgtgttctcattgtgca

SEQ ID NO: 150844 - DNA, 601 bp, Human
gaggaactgtggacctttggaggagaagaggcagtctggcttttggaattttcagactttttgcactggtttttcctcatctttgtggatttatctacctttggcctttggtgttggtgaccttcagatggagtttttgtgtggacatccttattgtccttgttgatgctattcctttctgattgttagttttccttctaacaggcccctctgctgcaggtcttctggagcttgctggaggtccactccagaccccgtttgcctgggtatcaccagaggaggctgcagaacagcaaagatygctgcctgttccttcctctggaaggttcgtcccagaggggcacccgccagatgccagccagagctctcctgtatgagatgtctgttgacccgtgctgggaggtgtctcccagttaggaggcacgggggtcagggacccgcttgaggaggcagtctgtctcttatcagagctcgagcactgtgctgggagatctgctgctctattcagagctggcaggcatgaacgtttaagtctgctgaagctgtgctcacagccaccccttcccccaggtgctctgtcccagggagatgggagttttat

SEQ ID NO: 150845 - DNA, 601 bp, Human
aatttttaaatatctcttaatttttagaagttcatatattatggttactcttaagttatcttaagtattctaatagtgtaggcaaattttcctttacttttcagcttaaaaagtcaggtggatcacgaggtcagaagtttgagaccagcctggccaacatggtgaaaccccgtctctactaaagatacaaaaaattagccgggcatggtggtgcgcgcctgtaatcccagctacttgggaggctgaggcaggagaatcacttgaaccccaggcggggaggggagtggaggttgctgtgagytgaaatcacacctttgtactccagcctgggtgacagggtgagacttcgtctccaacaacaacaacaagaaaaatcccattccaattggatattcacgtttacatagatttataaaagcctagtctgttaagtattcttacaataccacattttttaaggcttaagtatttaaatatcaactatacagagtctttctaaacttaacatgaaaatattaatattataggttcacatcataatttctgttactttaaatttttctgggttaaaaaatcacttaactagtaaggcaaccatttt

SEQ ID NO: 150846 - DNA, 601 bp, Human
tcacacaatcacaaggcaaagtcctacaataggccgtctgcaagctggggaagaaagaagccagtagtggctcagtccgagtccaaaagcctcaaaaacagggaagccaacagtgcagccttcagtctgtggtcaaaggccagagagttccctggcaaaccactggtgtaaatccaagagtccaaaggctgaagaacctggagtctgatgtttcagggcaggaggaaccaaaggaagcaatcagtatgggagaaagatgaaagccagaagactcagcaagcaaggttatttaaccttcttytgcctgctttgttctagccacgctggcagccagttggatggtgcccacccacattgagggcaggttttcctctcccagtccactgactcaaatgtcaatctcctctggcaacaccctcaaagacacacccagaaacaatactttaccagctatctaggcgtccttcactcaagttaacagctaatattaaccatcaccgtgttgaatacttttgttaatttattttgttctccttaaattttatcatttgatttaggtggatgaaatactttaaagaatggtgtgaaaagcctgtgtttg

SEQ ID NO: 150847 - DNA, 601 bp, Human
cccagtccactgactcaaatgtcaatctcctctggcaacaccctcaaagacacacccagaaacaatactttaccagctatctaggcgtccttcactcaagttaacagctaatattaaccatcaccgtgttgaatacttttgttaatttattttgttctccttaaattttatcatttgatttaggtggatgaaatactttaaagaatggtgtgaaaagcctgtgtttgtagttagttctttttctatttcttcacttaaaaggaagttttgaatgagattttaactgttaacagtagatttwtgtgggtgctgtaagtatggacagttcaaatttttgctttatacttttctgtattttccatattttctaaatgatcacttcttactacattagaaataatatattatttgttgttgatgtgggttctggaattagatttttgagatttgaatcaggactctaccattaagtgttagtggttaaccttttgctttagattactcttctgcaaatggttgatgataaaagtagttgccttatgggattactgcaaaggctcaaataaaataatatacttaaagcagtcggaacagtggtaat

SEQ ID NO: 150848 - DNA, 601 bp, Human
atatctgcactcccatatttgttgcagcactgtttagaatatccaagatttggaagcaacctaagtgttcatcagcagacgaataatggataaagaaaatgtggtacatatacacaatggagtacgagcaaaaagaatgatattgtcatttgcagcaacatggatggatagaactggagatctttatgttaagtgaaagaagccagacacagaaagacaaacatcatatgttctccttacttttaggatctaaaagtcaaaacagttgaactcatggacatagagagtagaaggatagttrctagagacttggaagggtagtggagggttggagaaaggtgaagatggttgtggagatggttaatggataaaaaaaatagaatgaataagacctactatttgatagctcaatagggtgattatagtcaataatcattgaattgcacattcaaaaataagtaaaaatgtataattggattgtttgtaacacaaaggataaatgcttgaggggatggataccccattttccttgaagtgattatcatgcattgcatgcctgtatcaaaacatctcatgtaccccacagatatatatacctatt

SEQ ID NO: 150849 - DNA, 601 bp, Human
gaatatccaagatttggaagcaacctaagtgttcatcagcagacgaataatggataaagaaaatgtggtacatatacacaatggagtacgagcaaaaagaatgatattgtcatttgcagcaacatggatggatagaactggagatctttatgttaagtgaaagaagccagacacagaaagacaaacatcatatgttctccttacttttaggatctaaaagtcaaaacagttgaactcatggacatagagagtagaaggatagttgctagagacttggaagggtagtggagggttggagaarggtgaagatggttgtggagatggttaatggataaaaaaaatagaatgaataagacctactatttgatagctcaatagggtgattatagtcaataatcattgaattgcacattcaaaaataagtaaaaatgtataattggattgtttgtaacacaaaggataaatgcttgaggggatggataccccattttccttgaagtgattatcatgcattgcatgcctgtatcaaaacatctcatgtaccccacagatatatatacctattgtatacccacagaaattaaaataaattatagctaga

SEQ ID NO: 150850 - DNA, 601 bp, Human
tacataggagcaactatagcaagaagcctcttgtttacattttacccctttccccataggatcacctgtgaatagtgggatgactattcatttcaataaactagggatagtcctggtttatagctgttgttccaggctgttattacattataataatgttgcatactattatataatttattattaatagctgttcctttttacttttaatactaccccatttaggataataaattacatggtccctttatcttaagttaccactgaaaagggtggtgagaatagaaatgggaatagaatmgtcagtgacaactatgcaagttggaatttaagagattgatttttgaaggtttgcatcagagatcatcaggatcatctcaatgatttactgggatgcactggactcagaagttgctatatgcatgctatggtttattatagtgaaaggatacagagtaaaatcagcaaaggcacatgggatgaagtctggaagactccagttgcaagctgtcaggtgttcctttctactggagttacacaggacatgcttaatttcccccaaaatatgtcataatgtgtacagagtattcccaaccaggga

SEQ ID NO: 150851 - DNA, 601 bp, Human
taggtatgtcatgcctgcatgactgaccttggctacttaagcttcagatcctcggagaaaaagcaggcattcactataaatcacattattaacatgaagtacctgctcaaattggtacagcatggcccaagacctccagcatacaaaaacactctaatcagacaactttctgaaaggttggagcttagttctcaggagctggccaagggctagtcctgaaaacagtccatttatgggaatgtgcagagtttgagcaacgcaagcctgctgaggtgactcttcccacgaggtcatacaagtyattcagtttagagtttggacccaggtaagtctgattccaaagtctgtgctttttcgctaagtagtttttagtggtcttttatactgatttgataattaaaaattactggctgcattagatatagtagggacttggactgtgccttacctctcttgatggatatttcctaatgagctttcttccccctcacattaaaataaggaggcttagttgagtatttttaagtgcttttgtaagaaatggtgctaagactttctagttttagtccttttcaaaaaaagtttgttttctatacttatg

SEQ ID NO: 150852 - DNA, 601 bp, Human
gggaggctgaggaaagaggatcacctgtgcctggggaggttgaggctgtagtgagccatgattgtgccactgaacttcagcctgggtgacagagtgagaccctgtatcaaaaaagaaaaaaatttatgttttggtacatgattaaaatttttagaaagctgtgttttaaaatgactgctgagaggtcatcattagcttatgtaaatacatttaccatcttttaagaaaattgaggactctcttgtgaaatgtgatggtaagagtaaggttcttatattttttttactagagaaagagaatraaagtttttaaggaaattaagctgtactcatctgcaacttccatacatgacacaaaatgtttttaaaacttctatttctcattagtatgcattcattttagaaaaatcagaaaatacagagagaaaaatatgtgaaaatcatccctatcccagagattgcctagtgttaacattttagaatatgtatagtacttgattttacatctttaaaacaaataatctttaaacaaatacatctttaaaacaataaagatgggatcatacaatatgtattttgtgttagcctgttcattttacaca

SEQ ID NO: 150853 - DNA, 601 bp, Human
atcccagagattgcctagtgttaacattttagaatatgtatagtacttgattttacatctttaaaacaaataatctttaaacaaatacatctttaaaacaataaagatgggatcatacaatatgtattttgtgttagcctgttcattttacacaacactatatcactattttagaacctgccaaaattagctgtctctcttttctctgggctaagatcttgttttattttttcaaggcaaggagacaaaagttttaggataccaaaagacagagatcaaataagtgtttcctttctattcrccaagacaatgctaactttgctttcagccctttgatgaaaattattttcaacttaaaaatatagatatatttttttaaatttcaacttttaagcagctctggaccttccagcagtagggatcttctgactggctcagctcacattttcttttttttttctgagatggagtctcgctctgtcacccaggctggagtgtagtggcgatctcggcttaatgcaagctccacctcccaggttcactccattctcctgcctcagcctcccgagtagctgggactacaggcacccgccaccacgcc

SEQ ID NO: 150854 - DNA, 601 bp, Human
acacaaccctcagactgcttctgggtcacaactgagtagatgaaaagagaaagttgtagagaatatcccttttgttatcagtcaggatgagctaatttatgctgcagtagcgaacatggaaatgttagccacttaaaacaaaaaagggttatttcccattcacgcagtatgtttatcatattccacatgctgtcattttgggatccatggtaacaaagctgccactatccagaacattgttagtttctatgtcagagagaaaaaaagttttcattgggtaaatttatctgcttttcagggyatcacagatgataattgtaccaagtattttgccactacaaacatggatcagtaactttccagcctccaatgtaacagtttctatgtggccagctgcccaacctgtaaaccactgtcacacattttcttttattgtggttgttactagtttctttttataaatctttacatgctaataactgtatcaatcacataggctagtgtagtcaccctgaagtagtgggacagacccacccctactcacaattggtttggatgtagagactaacaatgtcacaggtgccccaagaggataggaaaa

SEQ ID NO: 150855 - DNA, 601 bp, Human
tgcagcttgcttctctgacagagatcagtgagagatctcattataaaaatatgtgtctaataattaatgttgattcactgttttaaatttttatatttttgtttgtttgctcttaccaacacagtttcatttatcactgtcatatgtatatcaggcaccagtctcttttatggttttcctaacttaatttctcattctttccttcctctaactttcaattctttattttcttgcagaactgcgaaaattaatgtatataatatgttctcatttgtgtaaattagatatgcatatacacacktataacaagtatgtgcacagcaagttttctaggatacctaagatatagctagctgagtagctttggataaagggacctaaaaacggatgcagagtgtggtagagactattgttgttcatacataagtttctgtatgaacttttagtcatttgcctatattctttttttttttttttttttttaagttacggtagttttcaaaacactgtcatgtctggtttggtttggttggctaggaagattaatttatataaatttgtcttcagaatttgtgcatgaggtgtccatgcttccaaaatg

SEQ ID NO: 150856 - DNA, 601 bp, Human
ctcttttatggttttcctaacttaatttctcattctttccttcctctaactttcaattctttattttcttgcagaactgcgaaaattaatgtatataatatgttctcatttgtgtaaattagatatgcatatacacacgtataacaagtatgtgcacagcaagttttctaggatacctaagatatagctagctgagtagctttggataaagggacctaaaaacggatgcagagtgtggtagagactattgttgttcatacataagtttctgtatgaacttttagtcatttgcctatattctttttttttttttttttttttaagttacggtagttttcaaaacactgtcatgtctggtttggtttggttggctaggaagattaatttatataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccgagtagctggaagt

SEQ ID NO: 150857 - DNA, 601 bp, Human
tttgcctatattctttttttttttttttttttttaagttacggtagttttcaaaacactgtcatgtctggtttggtttggttggctaggaagattaatttatataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccsagtagctggaagtacagacgtgaggcactatgcctggctaattgtctgcattttttgtaaaggcagggttttgccatattgccagtgatctgtccacctcgtcctcccaaagtgttgggattacaggtgtgagccaccatacccagcctccagggatattttttaaattatgaataaatttgcgtgaaatcttacaaagaaatttaaattgagtaatacatatttaactcctaaaaagagtttgttgaaaaaaaaattaccgtataatacctagtggttctatgctaagcacttacataa

SEQ ID NO: 150858 - DNA, 601 bp, Human
gtagttttcaaaacactgtcatgtctggtttggtttggttggctaggaagattaatttatataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccgagtagctggaagtacagacgtgaggcactatgcctggctaaytgtctgcattttttgtaaaggcagggttttgccatattgccagtgatctgtccacctcgtcctcccaaagtgttgggattacaggtgtgagccaccatacccagcctccagggatattttttaaattatgaataaatttgcgtgaaatcttacaaagaaatttaaattgagtaatacatatttaactcctaaaaagagtttgttgaaaaaaaaattaccgtataatacctagtggttctatgctaagcacttacataaattatttatttaattgttatggtaatcctatgaggtgcctat

SEQ ID NO: 150859 - DNA, 601 bp, Human
atataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccgagtagctggaagtacagacgtgaggcactatgcctggctaattgtctgcattttttgtaaaggcagggttttgccatattgccagtgatctgtccacctygtcctcccaaagtgttgggattacaggtgtgagccaccatacccagcctccagggatattttttaaattatgaataaatttgcgtgaaatcttacaaagaaatttaaattgagtaatacatatttaactcctaaaaagagtttgttgaaaaaaaaattaccgtataatacctagtggttctatgctaagcacttacataaattatttatttaattgttatggtaatcctatgaggtgcctatattatttctgtctctatttcgtaaataaggtaacagactcagagagctgaagtaactg

SEQ ID NO: 150860 - DNA, 601 bp, Human
tttttaattgaggcagggtctcactctgttgcccatgctagagtgcagtagtgtgatttcagctcactgcaccctccacttcccgggctcaggcagtcctcctgggtcagcctcccgagtagctggaagtacagacgtgaggcactatgcctggctaattgtctgcattttttgtaaaggcagggttttgccatattgccagtgatctgtccacctcgtcctcccaaagtgttgggattacaggtgtgagccaccatacccagcctccagggatattttttaaattatgaataaatttgcrtgaaatcttacaaagaaatttaaattgagtaatacatatttaactcctaaaaagagtttgttgaaaaaaaaattaccgtataatacctagtggttctatgctaagcacttacataaattatttatttaattgttatggtaatcctatgaggtgcctatattatttctgtctctatttcgtaaataaggtaacagactcagagagctgaagtaactgctcaagggctacaagtaataagtggtagagtctgtattcatacttatctaattttggagtctccatttctaaccttaccacatt

SEQ ID NO: 150861 - DNA, 601 bp, Human
tgaattgttgattttttgatccaataataccttatgaaaagacagaagttatatttttactccccaatggaagacatcatttttagtcattgtaagatgtatttattagaagaaatctgaatattacatgtgtagaggatttgggggtaaaaacactattaaagtacccacaatttaaaaaattctacctttttccaatctagagcctgttagaagtactgtactacattgcttcattaagtaccatgagtgtaaaataataacctaattattgttggctaagaatctggcataaaaggcycttataaatcatattttagtattaaacttcacataataataataataatggtagttaatatttactagtcatttactttgttttgagtactgcattggattaccttgcttattcctttcaacagtcctatgaaggtagtactattgtttttgttttatagcccattaagctcagacttaaggaggttatataactgcctagggcttcacagtagtgatgaaagtggattatgagcccttactccaagttgtttttaccactcatacttttaacatagacaaagtggtatttgaaacaaaa

SEQ ID NO: 150862 - DNA, 601 bp, Human
atggggggaatggtattggagacaaatatgaatgagattgttacacaaattgatgcacaaaataagctggaaaaatctgaggtaagaatggaaaatgctgtagttaagaaggttctaagcatgatgacagattacgcatgatttgtagttttcactgtttgtccttcagtatcaccctttaggttcagccgttatgcttattcagtttttaaaaaatggaatatacacgtagtatgctaaaggttctgtgactgttctctacccaacagctttgtgtattcttcttttagccacagtcatrgctgccttgggtaataagcacaattccaaatcttattgcctaaaagaattatctgaataatggaatctaatatttgctttgtaaaacttcagtcggtaattatcaaggaaatcttagaactaatattttaaagatatataaattttgtgttacaaaactacttctggaaagggaaaggacaggaaatggaattcttacagggaagtaagtaatgtttcaagttattaataaatgcaaaataaatattttgaatgtttgagttcacattcaaaaaagaaattcaataccttaatcttttaa

SEQ ID NO: 150863 - DNA, 601 bp, Human
tgctgtagttaagaaggttctaagcatgatgacagattacgcatgatttgtagttttcactgtttgtccttcagtatcaccctttaggttcagccgttatgcttattcagtttttaaaaaatggaatatacacgtagtatgctaaaggttctgtgactgttctctacccaacagctttgtgtattcttcttttagccacagtcatagctgccttgggtaataagcacaattccaaatcttattgcctaaaagaattatctgaataatggaatctaatatttgctttgtaaaacttcagtcrgtaattatcaaggaaatcttagaactaatattttaaagatatataaattttgtgttacaaaactacttctggaaagggaaaggacaggaaatggaattcttacagggaagtaagtaatgtttcaagttattaataaatgcaaaataaatattttgaatgtttgagttcacattcaaaaaagaaattcaataccttaatcttttaattctaaatctttccctaagatttcactgacaagttagttaagtcacatattttagacattagtacatatatatccatggtctttattgcattcta

SEQ ID NO: 150864 - DNA, 601 bp, Human
atggaggaaaaaatgtataaacttacgaagttagattatgcacttactaattagaaaaacatcactgagaattgatgattgtggtgatatcacaaagcattgccttttagccactaaatttttacttactctctcgatgtgtttgagaagaagtagcaacatacaggtggctttatagtatcttattttgagattgtgggctatgtcacaaaactggggtaccgtttttggtccctctatccatgttattttgtccctcatatagagaatacatagtagtctcattctcaccattggtcaraattattgccagtttctgtgttacagtatgtaatttattactgctattttccagcaaagaaccattaatcacttgggtctgttaactttattgctagaactgttaattggccttttttaaaaaaaatcaagtttctgttttcaaagaggagagaataagaaaagtggctctaaggtactgatggtggaaggtcagctcatgagctggttctgcctctctaccttgacatacacatttgtcttgtacttctacaaaattatggtgagaacccttgaggtcacttgtaatggtcaaaactag

SEQ ID NO: 150865 - DNA, 601 bp, Human
ttttcaaagaggagagaataagaaaagtggctctaaggtactgatggtggaaggtcagctcatgagctggttctgcctctctaccttgacatacacatttgtcttgtacttctacaaaattatggtgagaacccttgaggtcacttgtaatggtcaaaactagtaatgataaatccatgaaagtcattagtctgctctctttttttcatgcaggcaaatcctatgtttgaaattaaagctataattgaagataatccgtacaaaatgactaataatttggaaggttttttaaatttttgarcactctaattttgttaaaactgtgaaacaccatagttattgctgtctagagaattgtcatgagcttatctaaatgtttataattgcagtattaaagcactgccattaaaacaaagcctattatatatccccagattaaaagttattctacctcgtgttgagggattttttaaactattgacattttcttttttgctcaaaaacatgctttcaaaatctgccattattttgttaatgattttgagtctgaaaccatttaatattgtgtttattaatgttggtgttctttcactttgctgtt

SEQ ID NO: 150866 - DNA, 601 bp, Human
aagcctattatatatccccagattaaaagttattctacctcgtgttgagggattttttaaactattgacattttcttttttgctcaaaaacatgctttcaaaatctgccattattttgttaatgattttgagtctgaaaccatttaatattgtgtttattaatgttggtgttctttcactttgctgttaggtcaaaattatgaatgtgcatatagcaacttccagcaggaagggtgggtaaaggttttaatacgtacagtttgttccaactaccatcttattatgctgtattcaaacttgaaaaaaaaaaagatattttaagatggtaggatggtattttatgtcttagatgaaataaataacaagattactctattactttccttttcccttcaagaaagttgattgtttattgcatgaggaaaagggagctttcagggtcttcgaaatacattttagtaatgctgctttttcagttttgcttgcacatattttgtttatttttgggtctggcaatttaaaaacaaaatcaaaaacaaatcatatccatccattactatctttgtgattcaagtgcttgaaatttccaagagtatgtctg

SEQ ID NO: 150867 - DNA, 601 bp, Human
tattattatttttattttaattaacaaaggtaggattacataagaaaagaaaactaaaattatgaaaagggaccttaaagctagtgtttctaattttatggacattgccatatataatctaatcaaagtggaagattcgtttttgttgtctatttttgtacaaaatgatgccactgaactcagatgtctttgttgactttgctttattatatagcctgaataaaaagtaatgaaatgtaattggtatataaattaaacctcaaatatgaaggctgttaacgtaggtgagaaaaatgatatrtatgcattttcttttatttgtaagcatattttcttttaaaattatttcacaaattacaaatgttcctactaataggaaagccaaatattatgcactagtggtacttactggaaattttagaattcatttatttatatttactacctcttgcatttatgcttttctttctctaaatttgtaaactgtaagctgaatatatgttgctgaatctatgctatatgacaaaacatttttaatcgttatatttttactaatgcatcaaagggttggaatgatcctcttcgtgtagtttcatcttta

SEQ ID NO: 150868 - DNA, 601 bp, Human
ttctcatgactttctgttctgctgcctgaatctattcttggagaattacaatgccaaattggaattttaagcttatctcatgggcagtgagaaatcaccagtagattgtaaaattaccctgaattgctcagatttgtgtttaggaccaattctgagtgtcacagtgtttggatacatcatagaggtaaaaggagttaaggagatccattctgaaattaaggggatagtgtggtatacccaggtgagataaaaggatatgagttaggacagagacaacaggacttaattgaaaaatgtgtakgaggtggaataataacaatagcatatatttataatttacccacattagttcatcttatcctcaaaactaccctatgatgcagttactgttaatattattttatttaataaatgtgaaaactaaggccttgcaagcctatggcttcacccaggggtaggatcaggcaccttaactctagagcccattctcctaaccactgagccatgattgtcttacaattttgatactgcaaaactggaagaattgtctggctattatctaagctgttcataagctgaacaagtagatctgagggtaaga

SEQ ID NO: 150869 - DNA, 601 bp, Human
gcgaggctgaggtgggagaatcgcttgaacctggggggtggaggttgcagtgagccgagatctcaccattgcgctccagcctgggcaacaagagcgaaactccgtcacacacacacacacacacaaaaaggaaaggtaataaaaaattttatcaagtaacttcatccacaaacatagtatagccctttttaactgataagaagaaggtgacactttggttttcctttttgaaatctgttcttgggtttcaaatgtcagctgctacattaaaaacagcaggcataatatatatatatatatwttttttttccaaatacaaatgcacgtactcttgtgtctcccatggcatctaatatacctgccttaatgacctcagcccacttaactgatttggtgaacaattctgcatctgaggctgtatatgtgaggaaaaattaaaggattggaaatgaaagtaaaataactatagtataaaggatcatatgttcaaagcatgcaggcctaatattataggaagtcccaaacatataagtgaattgcattcctagaactgacacatttgtcttttctctgttgcattcacaatataattacatttcag

SEQ ID NO: 150870 - DNA, 601 bp, Human
gaggtgggagaatcgcttgaacctggggggtggaggttgcagtgagccgagatctcaccattgcgctccagcctgggcaacaagagcgaaactccgtcacacacacacacacacacaaaaaggaaaggtaataaaaaattttatcaagtaacttcatccacaaacatagtatagccctttttaactgataagaagaaggtgacactttggttttcctttttgaaatctgttcttgggtttcaaatgtcagctgctacattaaaaacagcaggcataatatatatatatatattttttttttccaaatacaaatgcacgtactcttgtgtctcccatggcatctaatatacctgccttaatgacctcagcccacttaactgatttggtgaacaattctgcatctgaggctgtatatgtgaggaaaaattaaaggattggaaatgaaagtaaaataactatagtataaaggatcatatgttcaaagcatgcaggcctaatattataggaagtcccaaacatataagtgaattgcattcctagaactgacacatttgtcttttctctgttgcattcacaatataattacatttcagtcacattg

SEQ ID NO: 150871 - DNA, 601 bp, Human
tatattttttttttccaaatacaaatgcacgtactcttgtgtctcccatggcatctaatatacctgccttaatgacctcagcccacttaactgatttggtgaacaattctgcatctgaggctgtatatgtgaggaaaaattaaaggattggaaatgaaagtaaaataactatagtataaaggatcatatgttcaaagcatgcaggcctaatattataggaagtcccaaacatataagtgaattgcattcctagaactgacacatttgtcttttctctgttgcattcacaatataattacayttcagtcacattgtcttagatacagttggctgtttctgggctgtctttcaagctggtttgtaaattcctgagggtctaggacagtgtcctaattctccttagcaactcttgcaccacctactgtacttcatcttccacgatggatccttgacctagctgagctgtagttttaaagtcattagtctagaatgagcagaatggtcatagtcaatgcagtttgtgctgcaagtagcagaaacccattcaagctgacttagcaaaaaggagacttagtgtgaggaaataatagtaccctgatac

SEQ ID NO: 150872 - DNA, 601 bp, Human
ctaaatcctgtctggtaggtagaggcaaatggctatgtctgtacaacacaagaaccacaaatcttggccacatgggcagtttgcttgccacactccactgtgtaaggaagagactagagatctatgatgaagattgcctggcagccacagacacagttcaataactttttgtgaacttaatcttttttctcctgcctaaccatttccgcatttattacgtgtttgcacattcatcttcacttttgtggttttaattttgagtaaaatttaataaagttgtttctttttttaaaaaaaaaaaagggtcacaggagtgccaggaagtagaattctatcaggcaccaaagcaccatgtatgagtctctctttgtctttctcctgctcctcttcctgtcttcccactctctcccttccccatccctcttgtcctttcttacagcttctccttgtatgtggcccaaacctgactgcctcagcccccacatgcctccttttcctcaaatgaccctgacccacaagggtctcaattccaagttccaagaacaaagattctattagcttactttgccaataggttgtcttcctcctagacccaagaaga

SEQ ID NO: 150873 - DNA, 601 bp, Human
ggttgtcttcctcctagacccaagaagatagggatagggctcaaagaggggagccgttgggtaagtagatcacgacaaatcttctctaccacaaactgaggacacatacaatgtcatatcatggttgggatccaagctcagtttacaatgcctatatgctccataatattgcaaaatatttgcaatgagaaaaagaaaaatgtgaaattttaaatttaagattaaaactgcataatggtgtccccttccccccaacccccaagatttttaaatggttgcatggtattctgagtgttttatratgatgtaactatcaaatgtaaattttagttcaatatctgaaagaaccatgaacaataataatagagcttattcagtgattaccattgccagactctgtgttttatgtatactacctcattcagactttgcaataatcctgtgagaatagattctgttattttgcccattttaaagatgaggggctgaggcagggagattaagtcatttataaaagttgcaaggctggttagagtcacagatcgtatttgaatcctatactctgaacctctctgctaccctgctcttattagagaccttc

SEQ ID NO: 150874 - DNA, 601 bp, Human
atggttgggatccaagctcagtttacaatgcctatatgctccataatattgcaaaatatttgcaatgagaaaaagaaaaatgtgaaattttaaatttaagattaaaactgcataatggtgtccccttccccccaacccccaagatttttaaatggttgcatggtattctgagtgttttataatgatgtaactatcaaatgtaaattttagttcaatatctgaaagaaccatgaacaataataatagagcttattcagtgattaccattgccagactctgtgttttatgtatactacctcaytcagactttgcaataatcctgtgagaatagattctgttattttgcccattttaaagatgaggggctgaggcagggagattaagtcatttataaaagttgcaaggctggttagagtcacagatcgtatttgaatcctatactctgaacctctctgctaccctgctcttattagagaccttcaattttgctgatctagagtaatctaaatctagaatggaatgtgagtgattatatctctcattggaaatattcaaatagcctgaagcaccattctgcaggtcagttgcagaggaaattgag

SEQ ID NO: 150875 - DNA, 601 bp, Human
ctctcctgacagttgtgatattcaacctggtttggaaactgcacttggtgatcttttattcctaccattatcctctaggacaacatggtaaatgaaggtatcaggttgggagtcggaagaatgcatttaattaggtacttttaaggtcttccaagattgttagcattgactgtttttgtttcagagaatttataataggcaactgtatgtcagtttgaacaattataatccctgttgcataacattattcaatttataaagatctgtcacatactgaatcaaatttaaactaatctccatmaatatttattgagcatgtgctagttatgacgtacagcaataaaaaatataggccttgttcttaaggggtagttgagatgggatagactgcctagcagtacagagcagcatataccagcgccagatgagtacggtaggtggggagggctctggggtgaaggagaagccatcctttatacagctatactctgaatttatgtaggaggaatagctaaggccttgataggaggttcaggaagtttgcgggaaggcagaattccatgtgggagttatgctttgccaagccttgtgttggtgagga

SEQ ID NO: 150876 - DNA, 601 bp, Human
agtgattcattgttttttatgttctgtgatcaagcagccttcatataaatataaaggagagtaaatgtcatttccaaaactaattatcttggtgctttataagacataaagctaggcatttcatcccatattttatagaaataaaagttgaattttttctttgagagttggtggcttaaagggggagtcaaattaccaggaaggtgatcataaatacatagacttttggactaggatgttattttgccttttattcaagatattttgctcttcttttaaatgtgtctaacaatctgtcccwgtagttttatatttgcatttctactaactagacacttaagatgtcagttcctcccttagctagtttacagagtttgagctagaaatttggtatgcttacaaactattaaatacactgtactttgtctcttcgtattggagaaactattaaaagaaaattctgttgtctaatgttcttgcccatgaaggaggttccatagctttagaagtcaataactctatttatgtgtatgcagtaagtgcagctttctttccagtgttaaaacaacccacctcaggtgtccctgcattatttatatgt

SEQ ID NO: 150877 - DNA, 601 bp, Human
tatcttcatacttgaattactcaaattttgagctccatggttatgattatgatatgccagttgatttacattataacaacagatggtaatggtgcaggttgaaataaaagatcattaagataaatattttagccttcattggctccctgttgcataaaatttgtcagaatgaaatagaatcatggcatttcagaattggaagagtccttagagattatctcatccagtcccttatttgacagaggagaaaacagaaacccagagagaatgctgcttgccaaggtcgtacagctagttagtrgcaaagctaggaccaaaatctaggtctgctatttaccaattcattgctttttctgctgtctctgtgtgagatttttaggtactgttccatctaattactccccaatgtcagcaccaattattctaattaacatctattcattctggaacatacacactttcaccccattatgaatctcagttggttaaactttgtatctggctttcttttaggttctctactcacatcttttaatcttgaagactagaaaatataactggatctaccacttgtttggaaaatttctctaccaagcaataa

SEQ ID NO: 150878 - DNA, 601 bp, Human
aactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgaygtcatcatagccaaagagggaactagcgtttcaattgagtgtcttctcacagccagtcactatgaagatgtccattggcacaattcaaaaggacagcaactggatggcagaagcagaggtaattggtcagggtataattaatcaaggttactcatttcctgttctgtcttcttattttttaacacgttaaacaaaaagtctcaaagataaggtgccaaggtgaatagtttaaaacatttgaaaggtctggagtgttgtacctatcagaaaatgcaaagtaattataattgtttaaccaga

SEQ ID NO: 150879 - DNA, 601 bp, Human
ttggattcaagtggtgtcgttttcatagctctaagttcatagaacagaagcttatggaaaatggctatattcataactacatgttttcctctttttgtattagtgaagtgatggcttttaaatatattaatacctataggattgagataagtttggatgatgatgaaaatggacaaaatccagagtgcttactaatttatgtgccactaaaataatccagaaccatagaatcttggggatgaaagagattttgaagattgggcactcaagtaatgcttaacaagcagtccgctaacctccyctgggacacctcctctagtcattggaatgcatccccacactgcaggttagcccatccttcccatctctgaatggctttcatagttaaagcacagagtgctttgggaatgtatcacaaaagtaggaattatgcagtcagagccaagttattgaaggatgtgaatcaagatgcgtagtcaatatgctttgcttttcttacacttgtatacttctatatacgtgttccctgaatgaaaataccttcacgtgtggaagagaggcagtatgttttaggttgaaaatggaagcataggcatcttaa

SEQ ID NO: 150880 - DNA, 601 bp, Human
tcagttactcttgccagaaaatcaacaaaagtttcttaacaacaacaacaaaaaattgatatgtgcaaggcataccagattaggcagttacttcaacaaatgcattaaattgctaggattttttaaaataatttcttcttgttatataatttcactatggaaagtgagcaaacacagttagaagaaaataaaaattactcataaaaatttaaaatactgttattttaaaccattgttttatatttctgagacataccctcatagtatatgaaaatgtattggttgcaatgtgatgtagacrgacacatatgtataaactataagctttttttatgattagtcatttagcattttatagacatacctgtttcacagaaaggcttttgaagtctagcagtgaaaaggaagctatgttaattattagtgtcatgaaggaagatcttgatttccttttaagatccaagctaattaaattctgactctggacctcacagtctgccctttttttacatgatttaaacaaatggtagaatctaacaaatcagctaagttaaagtactttgataaagaggtggaatatggataaggcagcgggcatatt

SEQ ID NO: 150881 - DNA, 601 bp, Human; identical to SEQ ID NO: 36555

SEQ ID NO: 150882 - DNA, 601 bp, Human; identical to SEQ ID NO: 36556

SEQ ID NO: 150883 - DNA, 601 bp, Human; identical to SEQ ID NO: 36557

SEQ ID NO: 150884 - DNA, 601 bp, Human; identical to SEQ ID NO: 36558

SEQ ID NO: 150885 - DNA, 601 bp, Human; identical to SEQ ID NO: 36559

SEQ ID NO: 150886 - DNA, 601 bp, Human; identical to SEQ ID NO: 36560

SEQ ID NO: 150887 - DNA, 601 bp, Human; identical to SEQ ID NO: 36561

SEQ ID NO: 150888 - DNA, 601 bp, Human; identical to SEQ ID NO: 33771

SEQ ID NO: 150889 - DNA, 601 bp, Human; identical to SEQ ID NO: 33772

SEQ ID NO: 150890 - DNA, 601 bp, Human; identical to SEQ ID NO: 33773

SEQ ID NO: 150891 - DNA, 601 bp, Human; identical to SEQ ID NO: 33774

SEQ ID NO: 150892 - DNA, 601 bp, Human; identical to SEQ ID NO: 33775

SEQ ID NO: 150893 - DNA, 601 bp, Human; identical to SEQ ID NO: 33776

SEQ ID NO: 150894 - DNA, 601 bp, Human; identical to SEQ ID NO: 33777

SEQ ID NO: 150895 - DNA, 601 bp, Human; identical to SEQ ID NO: 33778

SEQ ID NO: 150896 - DNA, 601 bp, Human; identical to SEQ ID NO: 33779

SEQ ID NO: 150897 - DNA, 601 bp, Human; identical to SEQ ID NO: 33780

SEQ ID NO: 150898 - DNA, 601 bp, Human; identical to SEQ ID NO: 33781

SEQ ID NO: 150899 - DNA, 601 bp, Human; identical to SEQ ID NO: 33782

SEQ ID NO: 150900 - DNA, 601 bp, Human; identical to SEQ ID NO: 33783

SEQ ID NO: 150901 - DNA, 601 bp, Human; identical to SEQ ID NO: 33784

SEQ ID NO: 150902 - DNA, 601 bp, Human
taaacgggcgttggtttaagctgctaagtgtgtggcagttcatcacacagcaacagaaaactaaattggcaagcagtttatcttgtgctgcgttctgactcctcagaataacttcctctaagagaaaatccccacaggctgggcttctggcccagcagcgtggctggtttgactcactgcagcgtcctctgtggacacatggcaggagtccttcggtccatgagagggagctaaacaagaggctgcccttccagaggtggaagctgcagggcgttcagccacaaagggttagaaagttccyctctctctcaggctggagatccatttgatggtgccacaaagcaagagtccaccaaaataaggagacctaacatgtcctggccagaggcctgtgcatggcacagagcagagcccgagactgagcccaccagctcggataaagttaccttcttgcgcggccgaagcttgtcccgccattccttcaggttctggttatggctctcatccagggccttcagtttctgggtttcgtgctctaccaggaggtggcacttttcattctggaacagattccaggcagaacaggtgagaaatcagaaga

SEQ ID NO: 150903 - DNA, 601 bp, Human
tagtgcaatcatggctcactgcagccttgacttcctggcctcaagcgatcctcccatctcaggctccagagtatctgggactacaggcatgtgccactgtgcccggctaatttttgtattttttgtagagatgaggtttcactgtgttgcccaggctggtctcgaactcctgggttcacacctataatcccagcactttaggagtggtggcgggtgcctgtaatcccagctgctcaggaaggttgaggcaggagaatcgcttgaacctgggaggtggaggttgcagtgaaccgagatagcrccactccgtctcaggaaaaaaaaaaaaatccgctggtctttctcgcacttggatgtaactttgctccagccatgatcctgtaacatcatgcattggtcacttaaaaaatattggtttactgagttatgcagatcttccaaaagttgacacatttcattatacaatatttaaaaaaaattatatctccaccaggcacagtggtgcacacctgtagtcccagctagtcgggaagctaaggcaggagaatcacttgaacccaggaggcagaggttgcagagagccacgttcccacgcctgtaa

SEQ ID NO: 150904 - DNA, 601 bp, Human
ggagggaggcctcaattcaaggactcccaaggccatcacacagctgagatgggcagttgcctcctgtccagaccacagttacagtaagcagaactgatgtacgatggcagaacaaacctcaggacttcaggacccgtgggcatgagattaagagtaacttgggcagttctctcctcagagagtttaggggaatgagtatgtccttggcctgtactatgtgctggcaacttctgacataaccttgcagtattgatagcttcactgtacaaataaccacactgaggtcccatgttttttgggtttttttttttttttttttttgagacggagtcttgctctgtcacccaggctggggtgcagtgatgcgatcttggctcactgcaacctccgcctcccgggttcaagccattctcctgcctcagccccccatgtagctgggattacaggcatgcgccactgtgcccgactgatttctgtgatggttaattttatgtgtcagcttggcaaggccacggtatccacctgtttggtcaaacaccagctagatgtcactatgaaggtattttctagatgtgattagcatttcaatcagtaaactctg

SEQ ID NO: 150905 - DNA, 601 bp, Human
taacacctactttaaggaaataaatattatctacattttacagcccgaaaagccagggttcaggagggaagatttgacttgtttgaggccacattctgtgtgaacactgacccaagcaacacttcattgactctaccagatattccgtacttactcgaaatacatctgaatttttctaaaaatactccacaatgtacaatcatctccctgcctccatacaaggcagggggttcacaggctgctgactgtaatgcaagaatgtaaaagaccatttattctcgaatgaaaatcatcacctccrggtcattgttccagcagaaacccaagcagctaatgacagaagaattctataaagaattctgcaaagaggcagcccccacaggcaaagtccaatgctggcttcccaactgcacactcgtggtgcctcccctgagcccaggcccctctttgaagcgatctgagacataaggcaatagctagaggaaacgcgatcattcattttcaaactctctcaggataggccaagggtatagaacccccaggtaagagaaccaggtggacgttcatttcctgattgcagaaccaacctatgtcagcagga

SEQ ID NO: 150906 - DNA, 601 bp, Human
ctttatttacaaatataggtggtgggccagattaggacattggcagtggtttgctaacacctactttaaggaaataaatattatctacattttacagcccgaaaagccagggttcaggagggaagatttgacttgtttgaggccacattctgtgtgaacactgacccaagcaacacttcattgactctaccagatattccgtacttactcgaaatacatctgaatttttctaaaaatactccacaatgtacaatcatctccctgcctccatacaaggcagggggttcacaggctgctgacygtaatgcaagaatgtaaaagaccatttattctcgaatgaaaatcatcacctccgggtcattgttccagcagaaacccaagcagctaatgacagaagaattctataaagaattctgcaaagaggcagcccccacaggcaaagtccaatgctggcttcccaactgcacactcgtggtgcctcccctgagcccaggcccctctttgaagcgatctgagacataaggcaatagctagaggaaacgcgatcattcattttcaaactctctcaggataggccaagggtatagaacccccaggtaag

SEQ ID NO: 150907 - DNA, 601 bp, Human
cgggcggatcacctgaggtcaggagttcaagaccagcctggccaacaaggcgaaaccccatctctactaaaaacacaaaaattagccaggtctggtagtgtgtgcctgtaatcccagctacttgggaggctgaggcaggagaatcacttgaggcgaggtggaagttgcagtgagccgagatcgtgccactgcactctagcctgggtgacagagcaagactctgtctcaaaaaaaaaaaaaaaaattttttttacatcactatgttggccaaacataccatgcctgtaagccaattccagcwcataggctatcagtttgggacctctgctctaggaataccaacaatttaataataatagctactactttttgagcacagaatggtttagtaacttgcccaaggtttcacaactagtaatggaggagttaggacttcatcccacctgtgtgactccaaagcctgggctgtttaagcattattctgttctacccaccacatatatttctcaatacaaccttcttacgccagagtcagcgatcttttttctgttatgtgacagatagtaaacatttttggctttgcaggacatatttggtctct

SEQ ID NO: 150908 - DNA, 601 bp, Human; identical to SEQ ID NO: 33785

SEQ ID NO: 150909 - DNA, 601 bp, Human
tgcacatagtcagcgttaggccgttttggactgtcttcttggggcctccctcccacataaacagaacagcccttgggtattataccttttggaccccagttcacttgttaccaaacaaagatttgcaagatttttctgctctatcaggaagtacatctgtagattgtcgtcacatgcttttagatgaatttcccttgagaatttttatctttcttaaataggcattctgtgctgatctgtgtatcctcttgaacacatatcatttttaatatataacactgctagctgcttttataagttkttctgtcctttggacatgtgatactgctatatatttaagatgcagcttcctatggtgtttttgctaatcttgttttgcttcatgttcagtaatatttcttggcccctgttaatatggtttgattttgtgggagtaaatctaattcattatgtatttggaaggttcacagaagagtgtaaggagttcatgaaaagaaggtgctttaaattgttggaaatacatggtgaaaaacaaatactggcttacaatacactgagttttaaaagtagcatttatttgctcttctctaatcatttactg

SEQ ID NO: 150910 - DNA, 601 bp, Human
ctgaacgttttgttccattttcttctttcattagtacgtggagatggacatgtgaagaaaggtggaaggttaagattggtgggttttatttgtattcatgcttttattaggcagttaatacagaatatattatcggctgacatttttatatagtttacagtcaacactaaaactgtttaccttttaatcaaagaaacaaaatcggcagtctttcagagtttgtcttaaatgtttaataaatacttaaattctgcagggttacataaagttggatatctttggtggggtgggaagttttgcttttaccacagattagtaggaactgtttaagatattagcgatggtagagcttccagcagtcttagcaaaatgacgttagtaggtgtcacctcacttttacagtattcctaatttatgaccagaactggcaaagctgattagcatgagctcattgctctttgttttaggcttatcgttatctcctttaggagggaaaaaaaccataaaattaagtagaaattgactacttgtgttgtattacattttttgaaaattacaaagaatgagtaaactttacaaaataaaatttatctctaactca

SEQ ID NO: 150911 - DNA, 601 bp, Human
ggcccttataaagaggctttacccttgcccttcagccatatgaggacgcagcattcctcttctgcccatggaggatgcagccctcacaagactaccaaacctcgtaaaaatgccctgtagtttatatttaatggagtttgcgcctaatggcatcttacatataatgtcaactattagtgtggttcctatgccactagggtttgagccttagaaaatctcacacgacaaccaccagaattaagaacgcattcttttttaactgtttattatggaacattttaacatcaaaaggaaagaaaayagtatagtgaatttgtacgaattcgttgcccacttcagcaacttgtttcatctatatttccacttagtcttccgttcactctggataattttgaagtaaattccagatattattttatttataaatatttagtatttatctcttaaatgtaaatgttataaaaaaccgctgcaataccaatgacagacctaaaaattgaaggtaattatttcatatccccccaaaaaacccgataggtattcaaatttttatgcttgtctcatatgcattgctgctggttgagatgtctggtaaggctct

SEQ ID NO: 150912 - DNA, 601 bp, Human
taaccagttttcaggctattgaaaaaggaccattgtttgtttgtttgttttttcccccaataaagacttatttcaaatgcatgattttaaatatatatgatgttttgattcattacacattttctctcttatgaagttaaaattgtcccatctttggccaatgggagcctcttcaaattggctcctaagttttgtttgctgatgtgacaagatgtttcaggaccatcttgtataattcctgcctcaggtctggaatcagccatttctctaaagagccctggttccttttagtaggaaacawtacaggttgctaggcatatccaccgggtgggttgtcgtttttgtgtctctttagtggacaaatctgggggaaaacacacacacgcattttaatgagaaatgatatcgtgactttatattaaaattcatagttcaaatttaggattatagatatttcattttactttttcaattatatatttgtggatatctgtttcatgaatctaaaaatgttagttcttatgtggacataattacttactttgtaatgctaatggtattagcacagtatatgactaccaaatgtaatttagtatttttc

SEQ ID NO: 150913 - DNA, 601 bp, Human
cttgtcttggtcctgaggatgtatgctattagaaatctacagacctactactgtattttaaagtcacatgaaacagttcctctccatgtggatatgctatcagcttgaaacctggaatcatttgtttcattttgctttacatttgtaagacttaaaaaccccaacttgcttcaattttaagtaaaacttagcataattccacagtaataactaaaaaatagttaaaagttaaggtatggttaaaaaaaatctagtttttgtgtttgctttctccaccctgtgcctcccctataggaaaacttttttttttaagtttttggtttaatccttctgcttttaaaatatgagcaattctattgattttcccttctgttttcatcttcttctccccgagataaacaaaaatgtaataggcctcattttctatctttgcttgttttatttcaaagaatattctggagatcagtatatagcagcacataatagagttctcattgctttttacagttgtgtattactctgttttgtgtaacagagtaatacacaaatatatatataccagagtaaaacacaactctgtctctatgtgtgtatatatata

SEQ ID NO: 150914 - DNA, 601 bp, Human
tagtgtaggaccctttcagccttctttctattattaaaataaacctcagttcccttagcatccacaggatatccatcaggcattgctgctaactgatacctgataggaggtatttttagttaatgttgtgtggaatatggaaaaataatccattcagcaaatgccagtctcactgggcatggagagcattgtgtattcttaaatcagcgaatgaaacaaagatgtttgccctcatggagcttatgttctagtggaggagacagatagacaaaaagaatatgtaaattgtaccatttcctagaaggtaagaagtgccttagagaaataagattggttataggagaggatgcaggtttatgtgaactgaaagtaaaacaccatcattataaacaaaaactggtttgtttttgtttttgttttttgctttttgactaaggcagcatttggataagcagataatcaatgagctgttgtttggttacagacatgaaaagcttccatacatagacatcctgtgatgctggcagcatttcctgtctttttcatttcattgtagaaactaaggcattgatttcctatctataaaatgaggctgacatct

SEQ ID NO: 150915 - DNA, 601 bp, Human
atgcaggtttatgtgaactgaaagtaaaacaccatcattataaacaaaaactggtttgtttttgtttttgttttttgctttttgactaaggcagcatttggataagcagataatcaatgagctgttgtttggttacagacatgaaaagcttccatacatagacatcctgtgatgctggcagcatttcctgtctttttcatttcattgtagaaactaaggcattgatttcctatctataaaatgaggctgacatctgtcccgcctgcctcaccatgtggcttacggttgataacacacacayatgagtgtatctaataggtgaagtttttatgaactgcagtgctgttatttttactagtttcggaacaggaacagaactttgcatttgtgacttttctgcgttatactcagatgctattttcatttgggtacttcctgtgatgttggaaaccaacctaaatcttggggaatagaattaaacagacacctgtgtagttgattttaagctccttgaggtttagcgaccatgttcctctgaactatacttcatcctttctaagattttttcttcatacctccctgaggaggagtcagcagaaag

SEQ ID NO: 150916 - DNA, 601 bp, Human
taagcagatgaacttggtagcaagtcttaggatactgctcactagtgctaccagcctgggagaaatctttgtagttgaaagttggaaaagtgtagtaggggctgtcaaaacttctgcacagagctgcctttggttctcaggtctggggtgatcagaatggccgtgcgcattgtgcaaactactgacttccatgcaactttcttagattggcagattttggattctgcttctcacacccgtggtggagcatgccttgcttgacttgtgagctacggtgacccaggagggaggagagtgtcaygtgggtccctatggaatcaaacatcatgctgcatttcaaacacattttaaaaattcagaactgtggtcgagaaaaaatgttagatgctggctttctctttacccaaagtgaggggaatgttttaatttaaataataggtactgtatttttaataattcaagtttctgtaatatgtgttgatctatgataatttcagtcaaggagattgactcttttgaaaagcatgaaagctattgggaaacgaaaaatattgaaattgttaatctgtcttatcttggggatgagaggtattccaaaaaa

SEQ ID NO: 150917 - DNA, 601 bp, Human
ccattgttgatgattctaataccgtgacacagaggcctgggtgatcagaattgggtgctgcttttgacaatgcatttctgcctacttggcaaacgttagttctttaaaaatagtctgttgatatgtagcacgaagtttgtggggcattaaaaatccttattagctatatattgggcgtagatttgggaatctctatcaaaattgagactccattggtaatgggaatttttagcatagatgccaaagaacaccaagagcaagcaatgttgtgttttctggagagtccgcaagtggggagtcrtgagttactaggagctggcctgtgtgtatacttgaggaatttagaatctgtttctgctctggaaatgtattactcgagtttaatttgtagatctagctgacaactggtggaggaaatttcctccctatattaatgtattagttctttctcacacttctattaagaaacgtttgggactgggtaatttataaagaaaagaggtttaattgatttaatggctagggagccctcaggaaacttatgatcatggcagaaggcaagggggaagcaggcacatcctcacatggttggagcaggagg

SEQ ID NO: 150918 - DNA, 601 bp, Human
tgtagatctagctgacaactggtggaggaaatttcctccctatattaatgtattagttctttctcacacttctattaagaaacgtttgggactgggtaatttataaagaaaagaggtttaattgatttaatggctagggagccctcaggaaacttatgatcatggcagaaggcaagggggaagcaggcacatcctcacatggttggagcaggaggaagagggtggaggtagggggtcaggtgccacacacttttaaacaaccagatctcatgagaactccatcaggggacagcactagggrgatggtgctaagccgttagaaccccccccccgccccccgtgatccaattaccacccaccaggcctacctccaacattgggggttacagttcaacatgagatttgggtggggacacagagccagatcacaccaattaatatctccatttaattgttgcagttatattctggaaaatataataccatgctgatataatctaaggatacagtcatgcctggaataggagatttggtgtgtgttgcaggttggaggggtgcctatctatgaggaaagggtgagtcctcaggtgtctcttttatt

SEQ ID NO: 150919 - DNA, 601 bp, Human
tgatcatggcagaaggcaagggggaagcaggcacatcctcacatggttggagcaggaggaagagggtggaggtagggggtcaggtgccacacacttttaaacaaccagatctcatgagaactccatcaggggacagcactagggagatggtgctaagccgttagaaccccccccccgccccccgtgatccaattaccacccaccaggcctacctccaacattgggggttacagttcaacatgagatttgggtggggacacagagccagatcacaccaattaatatctccatttaattgttscagttatattctggaaaatataataccatgctgatataatctaaggatacagtcatgcctggaataggagatttggtgtgtgttgcaggttggaggggtgcctatctatgaggaaagggtgagtcctcaggtgtctcttttattccagaaaggcacatactgaagggcatcagtggcagccatggtagagtgagaggaggtgtttcctaagagactaaatgaggatgtgtgagagaaaactcggccataatatgggctggctagatagtaaccttaaggaacatgttacaagagaatgat

SEQ ID NO: 150920 - DNA, 601 bp, Human
cagatctcatgagaactccatcaggggacagcactagggagatggtgctaagccgttagaaccccccccccgccccccgtgatccaattaccacccaccaggcctacctccaacattgggggttacagttcaacatgagatttgggtggggacacagagccagatcacaccaattaatatctccatttaattgttgcagttatattctggaaaatataataccatgctgatataatctaaggatacagtcatgcctggaataggagatttggtgtgtgttgcaggttggaggggtgcctayctatgaggaaagggtgagtcctcaggtgtctcttttattccagaaaggcacatactgaagggcatcagtggcagccatggtagagtgagaggaggtgtttcctaagagactaaatgaggatgtgtgagagaaaactcggccataatatgggctggctagatagtaaccttaaggaacatgttacaagagaatgatgtaagatggtaacagcataatgggtttcaggggttgtggtaaaggtaatagatctaccacagcacgtggttcacagcactcaacctgtgtaggttgacacaagcg

SEQ ID NO: 150921 - DNA, 601 bp, Human
taaacatgaggctctttggtaaaaatgctaaaataactggttaataagtcacatttcccaaagaacagtgtctcttaggtggtggaagggcttgggggcccttctccagtaggcagctgtttattaggtgctcataaataggacccaggtttggggatgtttacaagtcactgctgtcttaatgatgactggcttttaacttgataaaaatagatggattgaaatgctgtgcactcccagcccagtccatttgccattttcattacttaggaagccgctgggtgggagcagtttgatcacrgaggaaggcgaatagttaatccttctgtaaactgtgcaagctcagcgtagcttttggttttgttgttctcccgcttattcctgttgttaagcctggagtcattcaggattccttttaagcttctttcaagtagaggggctttgtagttcgtgtgcatactgtgtaaggccatgttaggagaaagacaggcttcaagggaatttatcttgatatggtgaagactgatggttacagtgcggtctaccaaacagcaactagtaaaacaaataaaacatattgccaccgttttacaatctcctg

SEQ ID NO: 150922 - DNA, 601 bp, Human
catacaggcatttttttggggtgttgatgtgatacaccctcttactgatgtagatgtcatatgtactttgcatttgtaaaacgtgggaagctagttagtctgatagtctgaatcaagatatagaagggaatggggtgtgtgagtgtgagttagttgggagggggaaggagggcagggttaggggagtgagcctatgtaagagcatgaaattggttttaattttgaattaattttatttgcattacttaatgatagcaattggttttccaggtttttaatttagactagttttttggggggrtaattatccaaagcagaaaaatgtcaaatgtcttttctaccctaaggtacatttatgtttggggaaaaccacatatgcgtattgagtaccataaggtcctaggtatatttccaaaaaagaccttgtaggcagtcgttacctggttactgtctggtgcaggcatcagcagcctgcatagactgtcagagacccctgtgtaacagtgagggttgcagttgttccttactgtagggccattcggaagcttctatcactgaagttgtaaccaagtgcgactaagtatttttttaacctgtgttt

SEQ ID NO: 150923 - DNA, 601 bp, Human
tgcagttgttccttactgtagggccattcggaagcttctatcactgaagttgtaaccaagtgcgactaagtatttttttaacctgtgtttaaggacaccttaactcttgttgctcattctttattgcagatttgcattgtatgtgtttcccatgtagtcagtggttgagatttaatacaattagaagctggcactttttttttttaagtgcaataatgtggagaggaagaacatagtgactcccagcactgccttgacgtgtgtcagaggccagcagtgttaagccagcgttgctaccacrtaaaggcttagtacagttgtggaactagattaaaaccacagagcctgccagaagggtgccaagaactcccagggacgggtggatggtatggaaaaccactgagatagcttcagggccagggatagggtaaagggaataaaatggaacataagaaagttctcatcattgccagccatgctagtggggggtcattttcagcacctggggtgctgggagtcctggggtaactgccgtccacaggtctcagactgtccccagtctgggttttgttgcaggctgtcagggttttgtactcacccg

SEQ ID NO: 150924 - DNA, 601 bp, Human
gattattaaaagtccagcagggccgggtgtggtggctcacgcctgtaatcctagcactttgggaggccgaggcgggcggaccacgaggtcaggagattgagaccatcctggctaacacggtgaaaccccatctctactaaaatacaaaaaattagccgggcgtggtggcaggcacctgtagtcccagctacttgggaggctgaggcaggagaatggcgtgaacctgggaggcagagcttgcagtgagccgagattgtgccgctgcactccagcctgggcaacagagcgagattccgcctcaaaaaaaaaaaaagtccagcaaacgagagaggaatgggcctatggtaggattgtaggcataagtgctggatcaggagtcatccctcttctacctctgctgccttctgatgtttcttttgccaaccagcacgccggaccagcccttcttgttttctcttttggttctaggtcacaactctttctccttcacctttgtctttgcatttaatcttccccctccatgttttccttgaggcatattaatattaatctgcttcacatcatgataaggtgaggttaagatttcttgccgaggccaggc

SEQ ID NO: 150925 - DNA, 601 bp, Human
ggcacctgtagtcccagctacttgggaggctgaggcaggagaatggcgtgaacctgggaggcagagcttgcagtgagccgagattgtgccgctgcactccagcctgggcaacagagcgagattccgcctcaaaaaaaaaaaaagtccagcaaacgagagaggaatgggcctatggtaggattgtaggcataagtgctggatcaggagtcatccctcttctacctctgctgccttctgatgtttcttttgccaaccagcacgccggaccagcccttcttgttttctcttttggttctaggtyacaactctttctccttcacctttgtctttgcatttaatcttccccctccatgttttccttgaggcatattaatattaatctgcttcacatcatgataaggtgaggttaagatttcttgccgaggccaggcacagtggctcatgcctgtaatcccagcactttgagattctaagggaggaggactgcttgaggctgggagttcgagcccagcctgagaaacttagcaagagcctgtctctatattttgttttaaaaattagccaggtgtggccgggcgcggtggctcatgcctgtaatccc

SEQ ID NO: 150926 - DNA, 601 bp, Human
tttgtctttgcatttaatcttccccctccatgttttccttgaggcatattaatattaatctgcttcacatcatgataaggtgaggttaagatttcttgccgaggccaggcacagtggctcatgcctgtaatcccagcactttgagattctaagggaggaggactgcttgaggctgggagttcgagcccagcctgagaaacttagcaagagcctgtctctatattttgttttaaaaattagccaggtgtggccgggcgcggtggctcatgcctgtaatcccagcactttggaaggccgaggygggcggatcacaaggtcaggagttcgagacaacctggccaacatggtgaaactccatctctactaaaaatacaaaaattagctgagcgtggtgtaagtcacctgtaatcccagctactcgggaggctgaggcaggagaatcacttgaaatcggaaggtgtaggttgcagtgagctgaggttgcaccactgcactgcagcatgggcaacaagagcaaaaccctgtctcaaaaaacaaacaaacaaaaatcaccaggtgtggtggcacacgtgtaattccagctactcaagaggcttaagat

SEQ ID NO: 150927 - DNA, 601 bp, Human
aataaatataaagatttcttgcttagactgtaattgactaaaactttgtcactgttaaattgcaatgtagtacagattatatacaactctaggactgttcagaatcacagcagattattgcaatgaataaaacattgcctctatccttagctctgtcaaatgagcctctgccagctttcttgccaactcttgaatattttctaaatttttataaattcattcatatcccatcatctgttatttgatgggcagtggggttaggcttaggcaagatgaatgatagggtggtctggttggagcrgcattcatcgtttaataggcagcccacacgtaattgaatttagagtgatgttacacttaaaagggttttgatgcccttgagcaagacgtttgtgtaatagcaagtagtagaaaacctccacagagtttctggcatggatgaaaaagaatggggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaat

SEQ ID NO: 150928 - DNA, 601 bp, Human
ctctgtcaaatgagcctctgccagctttcttgccaactcttgaatattttctaaatttttataaattcattcatatcccatcatctgttatttgatgggcagtggggttaggcttaggcaagatgaatgatagggtggtctggttggagcggcattcatcgtttaataggcagcccacacgtaattgaatttagagtgatgttacacttaaaagggttttgatgcccttgagcaagacgtttgtgtaatagcaagtagtagaaaacctccacagagtttctggcatggatgaaaaagaatrgggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaatacacgattctacagttttgggtattccagctgacatatatgtgttgctataatggatttgtctttcattgtactgataatgcttctttcatctacatttatttttatggggccagaaccaggtatgttatgttttctataaatagattac

SEQ ID NO: 150929 - DNA, 601 bp, Human
aataggcagcccacacgtaattgaatttagagtgatgttacacttaaaagggttttgatgcccttgagcaagacgtttgtgtaatagcaagtagtagaaaacctccacagagtttctggcatggatgaaaaagaatggggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaatacacgattctacarttttgggtattccagctgacatatatgtgttgctataatggatttgtctttcattgtactgataatgcttctttcatctacatttatttttatggggccagaaccaggtatgttatgttttctataaatagattactttaactttgaaaacctgtgactgagcattgcaaattgcattatgttaaaactatataaaattggttcatcttctcatacgtgattttttttcccttaagacaaatatggtctctttagaaggccttaccaaagtagttgatccttctcagctaactcctgagt

SEQ ID NO: 150930 - DNA, 601 bp, Human
tgtgtctgttatagtgggttaatctccatcttcttggaaagaaatctcatttctttagctctcatgaaatacacgattctacagttttgggtattccagctgacatatatgtgttgctataatggatttgtctttcattgtactgataatgcttctttcatctacatttatttttatggggccagaaccaggtatgttatgttttctataaatagattactttaactttgaaaacctgtgactgagcattgcaaattgcattatgttaaaactatataaaattggttcatcttctcatacrtgattttttttcccttaagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgagga

SEQ ID NO: 150931 - DNA, 601 bp, Human
tgtttttattactaaagcttttaatgtatctgtcagtgttcttttgttttaagtagcaccttgtctaagagactggaataccttcttttcaattactggaagaccaggttactgtcactgggattctggttcaagtcatggtagcaatgctaattgatgatagtcatctatattttcttaaatgttttcattgcaaatgtcttaattgacatccttgtccaagtaacatctatattgaaccttaagggagatgtcatagttagtttttcccaccttttttatagtaaattttatgtttttrcaatctgcacaggtgtctatgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataag

SEQ ID NO: 150932 - DNA, 601 bp, Human
tttaatgtatctgtcagtgttcttttgttttaagtagcaccttgtctaagagactggaataccttcttttcaattactggaagaccaggttactgtcactgggattctggttcaagtcatggtagcaatgctaattgatgatagtcatctatattttcttaaatgttttcattgcaaatgtcttaattgacatccttgtccaagtaacatctatattgaaccttaagggagatgtcatagttagtttttcccaccttttttatagtaaattttatgtttttgcaatctgcacaggtgtctrtgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataagattttctggtaggtcctgc

SEQ ID NO: 150933 - DNA, 601 bp, Human
cggcctgggcaacacagcaagaccccatctctaaaaaaaaaaaaataattaaaaaattagccaagtgtggtggtgcacacctgtagtcccagctatttgggaggctgaggctggaggattgcttgagcccaggagttgcaggcaacagtgagttatgatcacgccactgcattccagcttgggtgacagagcaagaccttgtctcaaaaacaaaaatacaaataaagcaatatgaagacagggtttttgtttaagttaattcagaaagatgccatttaattaaaatacagtcaactaggtrctacaatttaggtagtttcaaagataagattttgcaatataatttttagtaataaatgccatcaaagttttacgtctgttctagaatttaaagtaagagaatttctggttcgaatcgtcaaacctgggcatagataaaaatttgtttgtaaaaaattactgtcagtttttttagaattttctgaaacttttggcaagagaccattcagtctgctatgccacatactttaaaaactagaaatactaaaatatgtgctagaaatgaacagaaaaatatattctctcttccccctttcttcag

SEQ ID NO: 150934 - DNA, 601 bp, Human
aggtcaacgttgttccctcattttaaatgatttgccttctagttatgctcaacctgttttcataaactcagtctggaaaggaccagaagcttggacatcctaagttaagtttccatcatagtcacctctttgaatcacatccagagtgttcatgtggaatttaaatctgattagggggacataaggctcaaatatgtgactccatggttaatgagcttactaacggcagccgccttctctgtaaggattacagctcttagctgcaccgtccggccctgccctctctctccatgggtggtgktgtgctagcatttgctgtggctttataaacataactctgaagttaaagctagatgagaatgatgtttcatagatgctataacttccatagatgtgtcagccagtctgttttgtgtcatctccagtgaaggttgtgggatcacagtatccgtttgcaaatatgtggacacacaaccacagtgttaatgttgttactggtagatgttgcttaggggctccagccttcgcttgtcttggtcatgtggtatatccacaggacagaccctttatattaagacgctttcacagcagataccattag

SEQ ID NO: 150935 - DNA, 601 bp, Human
agaccctttatattaagacgctttcacagcagataccattagaattaacatttttataaaacaaagtgacttgattttgctacagcttaaaatatctttttactgtgacctcaagctgcactgcccattgtgatggcctgtcaccatgtgtggctattgaagctactcagagttaaatagcaagatgataaaatcattttaaaaaatagaattaaattaaaatgtagttgcttattcactgtatcgggagcaacatgtggccaatggctgctgtaattgacagcacagatacacatttctrtccactcgggtagtgcttgcagaggcttacctgcagagtgaaccacacatccgatcaccttaatttatctatgactttaggccttctgtactttgataataaccaaaaataaagtaacagtgtttgtatagttctttaatatttagagaaccctttaacatgaaatctcatttcatccttaaatcagcctggtggagcagatgggactgtagtattattgtcctgataatctgtatggggagggatttggccatgtttcccaagctagaactttcgctgaggtctatggctaggtctttc

SEQ ID NO: 150936 - DNA, 601 bp, Human
acaaagtgacttgattttgctacagcttaaaatatctttttactgtgacctcaagctgcactgcccattgtgatggcctgtcaccatgtgtggctattgaagctactcagagttaaatagcaagatgataaaatcattttaaaaaatagaattaaattaaaatgtagttgcttattcactgtatcgggagcaacatgtggccaatggctgctgtaattgacagcacagatacacatttctatccactcgggtagtgcttgcagaggcttacctgcagagtgaaccacacatccgatcaccktaatttatctatgactttaggccttctgtactttgataataaccaaaaataaagtaacagtgtttgtatagttctttaatatttagagaaccctttaacatgaaatctcatttcatccttaaatcagcctggtggagcagatgggactgtagtattattgtcctgataatctgtatggggagggatttggccatgtttcccaagctagaactttcgctgaggtctatggctaggtctttcagttcctgacataataacaaactgtttcacacttgcattaatattcttataaaagttcac

SEQ ID NO: 150937 - DNA, 601 bp, Human
cttaattgaattagcttttttaattgggccttccgcacttgcctttcactcttaactgtgatggatttcgataggatctccctaggaaatttggcagtgatttctcagctgttgatgatcctggagatggagggtgtcagtggaggagattgagccagggttgggatggctgccgcaggaccgttgatgatcctggagatggggggtgtcagtggaggagattgagccgggattgggatggctgccgcaggaccgttgatgatcctggagatggggggtgtcagtggaggagattgagccrgggttgggatggctgccgcaggactgttgatgatcctggagatggggggtgtcagtggaggagattgagccaggattgggatggctgccgcaggactgttgatgatcctggagatggagggtggcagtggaggagattgagccaggattgggatggctgccacaggactgttgatgatcctggagatggagggggcagtggaggagattgaaccaggattgggatggcagctgcaggaattgatgatcctggagatggagggtggcagtggaggagattgagccaggattgggatggctg

SEQ ID NO: 150938 - DNA, 601 bp, Human
aattgaattagcttttttaattgggccttccgcacttgcctttcactcttaactgtgatggatttcgataggatctccctaggaaatttggcagtgatttctcagctgttgatgatcctggagatggagggtgtcagtggaggagattgagccagggttgggatggctgccgcaggaccgttgatgatcctggagatggggggtgtcagtggaggagattgagccgggattgggatggctgccgcaggaccgttgatgatcctggagatggggggtgtcagtggaggagattgagccaggrttgggatggctgccgcaggactgttgatgatcctggagatggggggtgtcagtggaggagattgagccaggattgggatggctgccgcaggactgttgatgatcctggagatggagggtggcagtggaggagattgagccaggattgggatggctgccacaggactgttgatgatcctggagatggagggggcagtggaggagattgaaccaggattgggatggcagctgcaggaattgatgatcctggagatggagggtggcagtggaggagattgagccaggattgggatggctgctg

SEQ ID NO: 150939 - DNA, 601 bp, Human
ttagcccaggcaggcaggctgcatgttctcagtcaccaccctctgcggcctctgtgccataccacgtggtagctgcttgatgatgcaactttagatgggttgacgagtaccacccttgcccatgccttgttcctctggcccttgagaccagcctacctttgtgataatagttacgttcctggaggtgaaggcgaggggtgtagagaggaattctgtgtccttacttttctgcaaggttttctccctgagtaagaagcatctatatctacagtgttctatgttaatatgaaagattatcgcaaggcttctgtaagagtttcacagcacctggaagagtgctggacagtgtagatgtttaataaatgctttctgtgtttaaatctaaatcttgatccaaacacatccaaacttgtcaaagttgttgggaagaaagtggccatttgcatttcattctgatatttcctgttgtgcttcactgcccagctgtcactctcatatccttgggcctgcctgtcttgacatcctagtgtccctgagcgaattaaatggacatgtgatttgctgctacagttttgtgtctcataaagatgttttggtcagt

SEQ ID NO: 150940 - DNA, 601 bp, Human
tgtggggttaggagtacttataagcagggcttgctttgcttttttttatttccttttccttgcctctctcttcctgtccttccttattccctttcttctctcctcctctcttcattttctctacaattttttttctttgaacagggtttatagtttctagtctctgatcatataaatttgctttgggaaactttcccagcatttttcttccaagacgcaagcacctgctctgctgtgctttaattagacctgcccgtgtcactcctgtttgtgctttagcaacaggaacgcacctgggccycctgaacactcacttgcttcagcttgccagctctgagcttatcttgttggctacagttgatcacaagagagtgaagcagtgtaaacgtcggagataagttgtagtcatttttaacattttaagtaagccaactcagctaccagtttttcaacaaactgaatttataaaaatgattttcatctcagtgtgcctgtgttgcctcacaagcctcaatgccaggtgtttggattgcaaggtgagactgcatagtaagcagccacacatccaccaaagggccactgctgcagccacggagcacaa

SEQ ID NO: 150941 - DNA, 601 bp, Human
aataactgctaaagctccagctatctcattcaagttcttggcggcaaggaggaggaagggacaaggggatgagcatacctgccagcttagcccctaaacagctttcctggaattcccattcaacattttttacttttgtatattggccactcatatatgtaagcaaggctgggaaatgtggcattacagctggagtgttgctgtttctgactgtaggggtttggctatcaaggagggcaagtggactttggggaagcagctgtcagtttctggcacatgttcaccaaatcataggctctgrtgtacattttccaacagtaatgcaaggagtaaaatgtagaggaaatatttgtaaggaattctttttagggttaacaccatgtgaaatgtatgacttggagcagtagctctcagttctaagagatgcagcactccaatgatataacacaaattttatgacacctgctttatgatcctgaactaaaatgcatacgtagtttaatctacctttgcatataatttatatgtgtacataaaaattatatgctacattgtaagttggagacaaaggtgatttatgataaaatgtttttcagtctat

SEQ ID NO: 150942 - DNA, 601 bp, Human
tctgcagggtcacttgccaccaggttttggtttaaaggctctcagtgttagcttttcccatttacctattccctgtgtgctcttttttattctaagggtttcttctaaactgggcttgtgtctgttaaaagtgcccctgaacttgctcctctttttttttttttttttgagatggagtctcactctgtcgcccaggctggagtgcagtggcacacgatctcggctcactgcaactttcatctcctggggtcaagccattctcctgcctcagcctcccgagtagctgggactacaggtgccygccaccacgcccagctaatttttgtatttttagtagagacggggtttcaccatgttggccaggatggtctcgatctcttgaccttgtgatccgcctgcctcggcctcccaaagtgctgggattacaggcgagagacaccacacccggcctgcttactagaaactcaaagaggtttttagatttggaagtatctaagctgaaggatcatgtgaagaggccctacctacttaagacacctgcatcccacacctggttaccttatgcatctcacacacactttgtgttgtctgattgtcactt

SEQ ID NO: 150943 - DNA, 601 bp, Human
tagcccatggcctcaggaagttggctgggaaccgccgtgataagcctgcagtagagccactctcaggatctcaggtttccatctccctgagtgtcatgtgaaggtgagtgagttttctgctgaatgggctgggaatttggagagtcgccctgtgttctgatgagactgagattctctgtatgtcattcaccatcattctcatcattcttcacttcatgtgaatctggtaaattcaaaagacgttgaatgggccaggtgcggtggctcacgcctgtaatcccagcactttgggaggctgagrtggcagatcgcttgacgccaggagtttgagaccagcctggccaacatggtgaaaccgtgtctctattaaaaatacaaaaatcaggccaggcgaggtagctcacgcctgtaatcccagcactttaggaggccaaggggggtggatcacctgaggtcaggaattcgagacgagcctgcccaacatggtgaaaccgtgtctctactcagaatacaaaaattagccaggtgtggtggcgcatgcctgtaatcccagctatttggaaggctgaggcaggagaattgcttgaacccaggaggcgga

SEQ ID NO: 150944 - DNA, 601 bp, Human
aagaggctggagccagtggtgaagagggattgagaggacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccatttctcatggctcttctttctctyatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttg

SEQ ID NO: 150945 - DNA, 601 bp, Human
agagggattgagaggacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccatttctcatggctcttctttctctcatctcatgcttaggttagaaawgggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggt

SEQ ID NO: 150946 - DNA, 601 bp, Human
ctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttratgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaatgaaagaaaaatagtagtactttagaaggacgttaccagcagaagataaatttgtaaagacagtagtaaccgaaa

SEQ ID NO: 150947 - DNA, 601 bp, Human
tgggcccctgttgaaggagctcatgcttacctgcgccgaatgccagtgcatggtgcaagggctgtgtgtgacttctgaacagcatcaagctcatcttggtgctttgtgggtgctcactgccatgtatgtgtctttcctctctgcatgctcacagctggcccattgaactttacccatttcacctcatagagttcaaagcccgaaggatctcctattctgtgccttttaacttgatgctgtaggcagtggagggtggatagcaggagtgaacctaaaggccaggaacctggttaggttcccwtgtggacgcctgatatggtttggctgtgaccccacccaaatctcatcttgaattgtagttcccataattcccacttgtcatgggagggacccagtgagaggtaattgaatcgtgggggtgggtcttccctgtactgttctcgtgatagtgaataagtcttgtgaaatctgatggttttataaatgggagttcccctacacaagctctcttgcctgctgccatgtaagacatgcctttgcttctcctttgccttccaccatgattgttaggcctccctagccatgctgatctgtgactcca

SEQ ID NO: 150948 - DNA, 601 bp, Human
gggaactactgggcgcaggtagaggccacctgctgatcttcctggtgggtctagagccagctcctaattaaccttctgcagtagtgagcacagaggaggtgggactggaatccagccatcataggaaccacagccaggatggagctgcagatttaacagtgagaggacaaaggctggggaaagggctggctccctcccacacacccctcatctaaaacatcttcaatgtcagtccgtggtgaatgctagacctcaaaagttcccattcttcccctggtccccaaagcccacaaatgtgtgttgaattctgtgtctgttttatttcacttttaaaagtagtctcacacacaatagaatttgaagctggagccccctcattttccaggtaataaaagcaagccttggaaaagtcgaatggcttggcagaagcaccgagaacctcttggtgttttttctgtgtcaccgctctgggtctgaggaggatgcctaccttctaagctaagcaaagagtaaaatcaacgtgatactgaagaaagaatctttgagtggtgcttttagtcacagggaacaggctttcctagaagctgcaattgcccgtgac

SEQ ID NO: 150949 - DNA, 601 bp, Human
tttaaaagtagtctcacacacaatagaatttgaagctggagccccctcattttccaggtaataaaagcaagccttggaaaagtcgaatggcttggcagaagcaccgagaacctcttggtgttttttctgtgtcaccgctctgggtctgaggaggatgcctaccttctaagctaagcaaagagtaaaatcaacgtgatactgaagaaagaatctttgagtggtgcttttagtcacagggaacaggctttcctagaagctgcaattgcccgtgaccatgaaggaaaacagccacttaagaacggagagagagataggagtttagtcctttaggagggaatcaatggaaagggaaaaggagctcccatgaccactctccagccccactcagctatctcaggcctcccttgcttcgccgcatggcgattagacagctgggggtgaataatgcggtctggggtctccctgagcttggcctccgtgggagagggaaaaataagaccagtgatttcatgagtaaagtacgccagagcactaggaaagaaagtgtgagctagactaacacaggatgagtatatgaattccagtaaactcagaaggattc

SEQ ID NO: 150950 - DNA, 601 bp, Human
taaactcagaaggattccttcatttgtgatttttactttgtaggtaaatttcattagtagcataatattgactatccttacagcactgccaaacaccagcctttaataaaaattaacattatctacgtgaaagtcttcctttatggccacctactttggtttaaccgatctgaaatgatgttgcttagtcaatgagtcatcttttgttgtatatccctaaaataccattgatttgatagtccagaaagctcagaatgtaatatgttcatttctctatcagtttccccagcgatttaaatamaagacagtgactgattaactaaaataaatggaaccaggttgttaattttggttttatagagaatgtgggctggcagggaggaaatctttattttgcaactggaaaaaaaatctgactttgtataaaaaagaacaaattcagagtattttagatttacctttgcttttcatttgtttcatgtattctttaaatggattatagaatcagaggagcttattttcatttttgtgtgcgtaagatgtgacttagaaggggttctcattgttttgacttaaaacacactaattcattatgtattgt

SEQ ID NO: 150951 - DNA, 601 bp, Human
tccttcatttgtgatttttactttgtaggtaaatttcattagtagcataatattgactatccttacagcactgccaaacaccagcctttaataaaaattaacattatctacgtgaaagtcttcctttatggccacctactttggtttaaccgatctgaaatgatgttgcttagtcaatgagtcatcttttgttgtatatccctaaaataccattgatttgatagtccagaaagctcagaatgtaatatgttcatttctctatcagtttccccagcgatttaaataaaagacagtgactgaktaactaaaataaatggaaccaggttgttaattttggttttatagagaatgtgggctggcagggaggaaatctttattttgcaactggaaaaaaaatctgactttgtataaaaaagaacaaattcagagtattttagatttacctttgcttttcatttgtttcatgtattctttaaatggattatagaatcagaggagcttattttcatttttgtgtgcgtaagatgtgacttagaaggggttctcattgttttgacttaaaacacactaattcattatgtattgtatcttgagaacagtg

SEQ ID NO: 150952 - DNA, 601 bp, Human
acacactaattcattatgtattgtatcttgagaacagtggctacagttgacagatgattatctattttctctgtgtgctctttggatgcagaattacctgtaaaaacaaactagcttagtatgttcttggttgctttatgtcagatgtattatgtagtttttcaagtagcaattctagagatgaaactctagttttagaaatattttaaagacagtatttacaaactgaagtggaatgtagtgagcttggagttgagaagacctccatttgaatctcttttcttgggcaggttacttatcygagcctcaatttcttgcttaatagaaataatgattaaagtctgctctctttttatttgtagcttttatttgtgattcagaattcagaatttctcaaagattagaaaagtaacacagtgtacaatactaacacttctagtggcatctggacagcccccccataatcaaatgcatggctatttctatagctgaatgttcaaggacttgcacttattaagtactcagtaaagactatgtaagtaccctcaggttaggttttattgacggatgaatttttagaaccaagttttgaaaaatattt

SEQ ID NO: 150953 - DNA, 601 bp, Human
tatcaggccattgatgagggatctgcccccatgactggaacacctcccggtaggccccacttctgacactggatatcatattgcagtgtgggacttggcggggccaaacaaaccacagcagagagagaaagagagagagagaaatttttaaacaaatttttaaatagtaattactgagaaagaggaatccgtaaatactctacaagaccacaaatactgagtattaggtagtagggacctactacagaaaataattttacaaatagcttatacaggatgccagaactctgcagcgggactsaggaagcattacctgtggccagttcctgttgcatctaatcaagggttggtaactattcgcagatttaccctaactcagttttgctgagcgttgtgacagcgtcatttcctaagaggttacttacccaacagcctgaaccattctgaaacaaaagcagaggtctttcctttttcatctcacctgtatgtcagggcagaagcagtgtagacgggaggatgagccctgaggcaggcatcctggcttctagtgcacactcaggctttcccataaagtcacagagggccctgcctgtgtcttcat

SEQ ID NO: 150954 - DNA, 601 bp, Human
ttaatttaaaaatgttgtattttgcttcctctggccctttctaccaaataatgtttatcttttattttttgaaattgtgcccttatttcaagtctctatggactttccagtaatcatcaggtttgctgcttactggtgacttaatttttctctttacgtaagttaagtaatataccgaatatattatataatttaaaaaaaagtctccttagccctcctgtagatcttacaggcaggtgaactgtagcagaggtgttacttatgtacctctaaattcttttcaagctagaaatatttgatrcttctcttttgcatggtttggcctcatgcccaggagcacattccattaaatgtatccattctcaaggccgagaggtccagaagttgtccttgagacatttctttagccgtggaatggacctgtgttttataatataaaagactgtgggacaaacaactcagcaacgctttgtctgcctcgaaatcaggtggtgaatgtagcaataccttataggactctctttttaatcccaagaaagaaaaataatgtactaaatacatgagttaaaataatatactcaatgcatgagttaaaataatg

SEQ ID NO: 150955 - DNA, 601 bp, Human
agaaaggaccctctgccaggccctcagatgtgaaggtcagtggtttggagcaatgaggaacatgtcaggctctgatactcaccagctgctgcttttttccccctatatctatgaacatggctgatctctctacagtacagttgatcaagggcaaggaaccacaagctaagccccttttattttgccattagcagagccatggctggttggcttcccagattgccccctagaccactgtctttgctgtgtgtgcccatttgttctttagtccaaggtgattttgatctgcatcgtctgaatrtttgtgtccccccaaattcatgttgaaatatactccagaagaggtggggcttccaggagggaattaggccatgagggcttcacccttgtgaatagcattagtgcccttataaaagaggcctgagagagcttgtttgccccttcctccatgtgaggacacatagaaggcaccttcaacgaggaacaagccttcaccagtcactgagtctcctggctccttgatctgggacttcatagtgtccagactatgaagccctacatttctgttgtttataaattactcagtctaaggtgttttgtt

SEQ ID NO: 150956 - DNA, 601 bp, Human
ctgtagttaaacttgaattgccttagtagtgtagctttaagccttataaaattgctaagttaaattggccctgtgtgacttcctaatcactgtcttatacaatacccagtcagtttggtggcccagtggtgcatagataagttgagatttaatttaatcattattgcatgcaatgtttatacatagaaaggtttccacttttaatgtaagagatgattaaagtcctgctgggaaagctgatgtaattatcagcttgtaattatcgagtgtgttaaattagtatccaattacttcttcccatttttttttctcgtttgcttcttgtttcttacagagttttaacaacagaaggggtcttcattggataaccttaaacattgaacatggcaggacattgtttttatggcatatgtacctgtatttcattgtaggtgctagactggatcgagaaccacggagaagcatttctgagcaaacatacaggtgtggggaaatctcttcatcgggccagagcattgcagaaacgtcatgaagattttgaagaagtggcacaggtaaaacaatggcttctattattttatcccataaatacccgtgtggt

SEQ ID NO: 150957 - DNA, 601 bp, Human
agaaataaaaaatacttttcatgcgaagctttttgcaaataactgtcaggaagatactctttcatgttaatgttcctgttttagattttaaaagttatgattaaaacagccagtaaagcccagaaaactcaggttcaaggaagaatctggttttgagagcacagaaggtatctttactatcattagtaaatctttggcatagcatccttcctaagtacctgctctgtgaattcttaaaccaccctcgctcttttctgcctatccccctggattcaaattatctttcagagatgtaacctgycacaaagttattatccaggaagccatttctgtcaacagcttttcgtatgtgccacgtaattatcttgtcttcctggataaaagagtttgtcatttaggaaagcaggagaccttgaattcattcttgatttttaaaagaaaagcagaccagtgactccctggtcatgacttaactcattcatcttttgcaaggaggataactgcctccataacacgtggacatacagaatgtccccacgtgtagcatgctctaaattctgatttgtgacagccgttagagcatgcatatgtacaaaatagg

SEQ ID NO: 150958 - DNA, 601 bp, Human
ggctgtgaacctgtcacatggctgccaacatgattgcctctggattttacgagacttctctcagatgctagtaaacgtgagtgttacctaatattgagtttaaatgtgccagagccaacctggtacgaataatattaaagctaatgtcataggcatgcacctgttaatcagctcatctcatgacaagaaataatgttatttggtgtgtgaaaaataggtaggtactaattataccttgcatatatgttattcttggtagaaatcatataaagttacatgaaagaaactactatgtagcttytgaggaaaaaataatttaaaataaaagttcatattcagggtgactacaaattgagtagggatgtcaacttaccacaccttacttctgtgtaaaaaagaaaattccctgcgtcactgaggaccttcacagaggatcgtaacttattcagatgcagctcttgatgaactggaaatgaggggcccttctgggtaactggggactatgcacatggaagcttgtggtcataggatgggaaaaaggatctggaagagtaggactactggggaaagaggggagggcgaggcctgacttgcctcattt

SEQ ID NO: 150959 - DNA, 601 bp, Human
ctgggcgtggtgattcacgcctgtaatcccagcactttgggaggctgaggcagttggatcacgaggtcaggagatcgagaccatcctggctaacacacggtgaaaccccgtctctactaaaaatacaaaaaaattagccaggcgtggtggcgggcgcctgtagtcccagctacttgggaggctgaggcaggagaatggcatgaacctgggaggcagagcttgcagtgagccgagattgtgccactgcactccagcctgggcaacagagcaagactccgtctggaaaaaaaaaaaaaaaaawgaaaaagtagcttgtctttttcatttaggcaaattcatgaagcttttttagaagttgctaaaggctctcgtgacagaagttagtcttccttgctgccaggtgttccacagtggctctcgtcctcactttatctggagtatagttgtcactgtctctttttgcaataaattcctggccctctgatgaacaagtaatacaaacatgaggtcataacaactcactttaaaaaggtgcaaagtcaaggtgatgtttactgagcattagctcaggaatctctttaagaaacccctggaagaaggt

SEQ ID NO: 150960 - DNA, 601 bp, Human
tctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaarcaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacata

SEQ ID NO: 150961 - DNA, 601 bp, Human
actcctgacctcaagtgatccacccacctcagcttcccaaagtgctgggattatagacatgagccactgtgcccagccctgtttacttgttaaatttctgttttaaagggcattttatgattctctatttcttattttgttactcagcttcataaactaaatattttattatcaaagaaccacaagtctttggtgaggaaagaggtaaacttacctgtatgtattttcgtatgtatttctgacacatttgtactgatcttcgttgttcttattgaataggtagagagattggccaacaatrtattagctagagttttgccaggacagcttaaaagctccagataagccaggcttggagagactggtaaggctttttgggttttgttatcatttgtttgttttcccttccatttgttgaggtacaaaaatcagaaccagaagatcaaggaagggttgagctttctgcttgagagctgtgatgttgatgaacgacaagcagaaagtggaccccatcatctctcactttggttcttggtctcctcgaggggagcactctccagacataggccagaagaagcaaaagccccaaatggtgaaggct

SEQ ID NO: 150962 - DNA, 601 bp, Human
cacatttgtactgatcttcgttgttcttattgaataggtagagagattggccaacaatgtattagctagagttttgccaggacagcttaaaagctccagataagccaggcttggagagactggtaaggctttttgggttttgttatcatttgtttgttttcccttccatttgttgaggtacaaaaatcagaaccagaagatcaaggaagggttgagctttctgcttgagagctgtgatgttgatgaacgacaagcagaaagtggaccccatcatctctcactttggttcttggtctcctcraggggagcactctccagacataggccagaagaagcaaaagccccaaatggtgaaggctttgtaaggaaagacttatttaatctaagcacgttcaagcctctgttctaggacaaattagatccctgggtaccaaaagaacttgataattatatcaccatattgagcatatcagtccaagcaactgtgggaaagtgggctgatgccagaagctgaaaacgcacttgtgctttttaaagaaggtggatttcacgcattactcagagtgaggttaatcctaggcagagttctagagacaatttt

SEQ ID NO: 150963 - DNA, 601 bp, Human
aacatttaatttgtagacaagaaaggaaagtatgggctatctcttagttactagaattagactgttgaatggctataataaaagaatcaaccaagggtgctagcacgagaccaaaactctcctcatcctcccacactgatctccaggtagaagatgtcaggaggcaagcttctgatagtaagacagtcctcataccccacaggtcagtaaggaagtcacgtccagtctggagccacagttagatcagacgtgctgactgacaaaggtagtggtggatgatgctggaccagtcatctcaggyggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggtggacctgaggtcctgcagaacagagatgatgctggaccagtcatc

SEQ ID NO: 150964 - DNA, 601 bp, Human
ttagactgttgaatggctataataaaagaatcaaccaagggtgctagcacgagaccaaaactctcctcatcctcccacactgatctccaggtagaagatgtcaggaggcaagcttctgatagtaagacagtcctcataccccacaggtcagtaaggaagtcacgtccagtctggagccacagttagatcagacgtgctgactgacaaaggtagtggtggatgatgctggaccagtcatctcaggtggacctgaggtcctgcagaacagagatgatgctggaccagtcatctcaggcggacstgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggtggacctgaggtcctgcagaacagagatgatgctggaccagtcatctcaggcggacctgaggtcctgcagaacagactagtttaatccctggtgtcaccgcc

SEQ ID NO: 150965 - DNA, 601 bp, Human
gtcctcataccccacaggtcagtaaggaagtcacgtccagtctggagccacagttagatcagacgtgctgactgacaaaggtagtggtggatgatgctggaccagtcatctcaggtggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgmtggaccagtcatctcaggcggacctgaggtcctgcagaacagagatgatgctggaccagtcatctcaggtggacctgaggtcctgcagaacagagatgatgctggaccagtcatctcaggcggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgct

SEQ ID NO: 150966 - DNA, 601 bp, Human
actgacaaaggtagtggtggatgatgctggaccagtcatctcaggtggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggyggacctgaggtcctgcagaacagagatgatgctggaccagtcatctcaggcggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccaca

SEQ ID NO: 150967 - DNA, 601 bp, Human
tgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggtggacctgaggtcctgcagaacagagatgatgctggaccagtcatctcaggyggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccacagccgaaataattgttgctgcattaaaagctttgcaagtgagactgtcagtg

SEQ ID NO: 150968 - DNA, 601 bp, Human
cagagatgatgctggaccagtcatctcaggcggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccacagccgaaataattgttgctgcrttaaaagctttgcaagtgagactgtcagtgcagaggttggtgagtggatgacgtcagcagtgctggagggagtttctagcgtcatgttgcaggtgtctgttctcatgcagaaagcctgtgagtggttgaattggtttggaaggtgtgtgtatcaaatctagacaagggcctgtcagatacgtcaggtgctagaattcagatcccaacagatctcagcaccaaatcaaccacagaaagtttcattaatcagttttaatatatgagtgttttgaatcagtacagagtaagaatcacataggt

SEQ ID NO: 150969 - DNA, 601 bp, Human
ttgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttgtcctgcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgta

SEQ ID NO: 150970 - DNA, 601 bp, Human
tgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgttttgcctgcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtat

SEQ ID NO: 150971 - DNA, 601 bp, Human
tgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttcatgcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgc

SEQ ID NO: 150972 - DNA, 601 bp, Human
gtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttccggcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgca

SEQ ID NO: 150973 - DNA, 601 bp, Human
tgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttcctacatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgcac

SEQ ID NO: 150974 - DNA, 601 bp, Human
tgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttcctgcatgtttttgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgcacatgagcat

SEQ ID NO: 150975 - DNA, 601 bp, Human
caatggcaacagcttctgttcaccaagtgcttatagaagttgaatacttcacacgtggattctcactccggcttcccagttagagaagatgcatgtagtaaaatgctttcattacatacaggagaaaactgaagatagagtgctccaagaatttcccaaggccacacataggataaggaccccaggagatgtgttgggcccctccttccataccccacctccagacggacaccgattttagcctgggttcaaactgcatcagcttgtaccccactggggagcacagagaggttgcagctgkaacaattcccagcttagggccctgatcctactttcgacttaactggaggcttggtcctttccgagggtccaccaccccagccaggtcctctaggcatcctctgtggcggggtctccctttccaggtagtgaggaggggccttttcatctcaaaagctagcttttcaaggggatttcttccagcagagctgtggggcccatagaggcttgtgggaggcttcccacatcttaatcactcgggttttcaccacagaactccatgtcccttcctagtcatccttctgtgtggatcctggtccat

SEQ ID NO: 150976 - DNA, 601 bp, Human
gtcctcttccacccagccctctggcctgcagatcccctgggcacctctcagcactagagatggccagcaatagctctgatggcctccagggggcagccttgcctaaccctgtggctgccagacctgcttctgtttctcagtagaatccagactgctgtgaacttccataggacacaactctcttgctgctgggcaaagatttatctttttattataaatttgcagcatgcccagaagtacaatttttcctcttaggagtttatggtaagaattttataggcatcctagaggttttttctcrttgctttattcagggatattttaggcatcatgtacaccattttaaaaacttaaaaacagactttccttgagtgatgtttcattatgatgtgtgcccattcatccccagttgatattagaagtgacctttatctaagacttttttctccaaattgaatgagaatatttcctgtaggaccagacagaaaaattccgaaggggcaaatattttaaatggttaaaatgtagccttgctccttctgcctcatttagtttggtccttttttaatgtcatgatcccaggatcagttccttcacggtc

SEQ ID NO: 150977 - DNA, 601 bp, Human
ccccagttgatattagaagtgacctttatctaagacttttttctccaaattgaatgagaatatttcctgtaggaccagacagaaaaattccgaaggggcaaatattttaaatggttaaaatgtagccttgctccttctgcctcatttagtttggtccttttttaatgtcatgatcccaggatcagttccttcacggtctcctcagtacccgcgctggtttcaccagccagcgggaggatgagcacatccagtgtgcggtaaaatatccaggatgttgcggggaatacgctagtttttgggttttttttttttaactaccaggtggaagggaaaacgtttgacccctaaagattcatggcgcttcccctagaattgagaggaagtgatttctatagactctaacagactaattctagcacgttttcctcatactgtactatttttaggagtaaaaagatttaaatgtgggatgatgttaagtttactagaccaagtgacatattttgaacaattggtaggaacccgaatgtgttttgaaaaatatctagagaaggaagattttaaaactgtgatctttcttattattagaagagtttttctt

SEQ ID NO: 150978 - DNA, 601 bp, Human
tttatctaagacttttttctccaaattgaatgagaatatttcctgtaggaccagacagaaaaattccgaaggggcaaatattttaaatggttaaaatgtagccttgctccttctgcctcatttagtttggtccttttttaatgtcatgatcccaggatcagttccttcacggtctcctcagtacccgcgctggtttcaccagccagcgggaggatgagcacatccagtgtgcggtaaaatatccaggatgttgcggggaatacgctagtttttgggttttttttttttaactaccaggtgraagggaaaacgtttgacccctaaagattcatggcgcttcccctagaattgagaggaagtgatttctatagactctaacagactaattctagcacgttttcctcatactgtactatttttaggagtaaaaagatttaaatgtgggatgatgttaagtttactagaccaagtgacatattttgaacaattggtaggaacccgaatgtgttttgaaaaatatctagagaaggaagattttaaaactgtgatctttcttattattagaagagtttttcttagaacaaaaacagtaacagtggct

SEQ ID NO: 150979 - DNA, 601 bp, Human
gaatgtttttcatgggaaatgttagtgcaaattggaagagtccttcatgctatgatctttcctatttataaatgcaactgccatgttcatgagaatttagaggaaaacaaaagaacaagaaagcatcttattgatgataaagcctttatagatggtgcagagcatcagttcagatttgatgaattggtgcgtggcattttcatgtggaattaaatactgatgccaactgtggctgagtattctttctgataccagcttttgggcatagtacttcatcacctggggcttctcttccttaatstataaaatgaaaattttgaactagcttatctctaaaactccattgattaaaattcttgaactgtatgaaatttgataacttagacacaaaaaataggtagataatatgagaaaagttaacaaatgttttatttactttaatattttcagtaaaattaattcttaggaccctgggtaacaggattgaaaaataacttctttgccagcacttttcttattttaaaattggcctgctatattttaaatgtgtactgacctgcaaataacaataaaagtatattttatgtatgtaaatattgct

SEQ ID NO: 150980 - DNA, 601 bp, Human
tgcaggacctcatcaagcgctttggccagcagcagcagaccaccctgcaggtgactgtcaacgtgatcaaggaaggggaggacctcatccagcagctcaggtgggcctcacccctctcctggtccgaacagattctgaaaccctgcctgtgactccccttccccttttactcttgtgagtggtcagctctgcttctctgtccagctgagtgcagagctagtagtgtctgtgaaggcaaaggagagagaaacggctctcttctctcttttcctttcccctcccttctctccctccttacagtttaacttcataatagttttcattataacatcgactaataaaccacataatttaattttaatattttctcttaacatccaactagtaattattgacacttctttataaaccagattaatgtgagcttccaaggattgcgccctcaggctgatctagagcacagcagtattcacctcccaacgtccagattcagtcaggcctgcatggggcggacacccacccccaagtgctcttcaaagcaggatatggaggcagagccaggattggttttgtttcctctggaagcaaattttttttattg

SEQ ID NO: 150981 - DNA, 601 bp, Human
agagggtccctggaggctggaattggatcatccctgggaggctggggtatgctcagccctggaccctaatgttggaaactatagagcaggcagctcgcgtggcaggagcagagcacagcaagcgctgagcggaacagaaggaagccagcacagctttctctcggccttggggtgttaaaacctcgattgggttgcacacagcactcccttgtcctcagcttaggcacaggcatcagcttcaggcagcaagtcttcctctcttcctccctgtcgtcttctcatccttcccactctcctcctktcctcaccctccccttttctctctctctccaccttctctctctcctaccttttctcttccttgcttcctccctttctctttccatctttctctctcttgcccttctctcttctagagtgggaataatcctgacttgtggtcgtagcattttaggtaacaaaaaacacaatttccccccacaaagaggtgttcttagattatccatgattcttacctaaacgtggacttttgcatcttatatgtgaacaggagaaagaatttacaggtgtcttttatctttcttcaacaaaaagagagtgg

SEQ ID NO: 150982 - DNA, 601 bp, Human
aagccagcacagctttctctcggccttggggtgttaaaacctcgattgggttgcacacagcactcccttgtcctcagcttaggcacaggcatcagcttcaggcagcaagtcttcctctcttcctccctgtcgtcttctcatccttcccactctcctcctgtcctcaccctccccttttctctctctctccaccttctctctctcctaccttttctcttccttgcttcctccctttctctttccatctttctctctcttgcccttctctcttctagagtgggaataatcctgacttgtggtsgtagcattttaggtaacaaaaaacacaatttccccccacaaagaggtgttcttagattatccatgattcttacctaaacgtggacttttgcatcttatatgtgaacaggagaaagaatttacaggtgtcttttatctttcttcaacaaaaagagagtggttctgggttctgtgcttaggaggagctctcttttttgataccatgcgagcagaagtcagtccaatcacatgagcacgaatttacctgggaacgtgacgtaaggagcctaagctcccctcagtggtgagcctgctctcctgg

SEQ ID NO: 150983 - DNA, 601 bp, Human
accttttctcttccttgcttcctccctttctctttccatctttctctctcttgcccttctctcttctagagtgggaataatcctgacttgtggtcgtagcattttaggtaacaaaaaacacaatttccccccacaaagaggtgttcttagattatccatgattcttacctaaacgtggacttttgcatcttatatgtgaacaggagaaagaatttacaggtgtcttttatctttcttcaacaaaaagagagtggttctgggttctgtgcttaggaggagctctcttttttgataccatgcragcagaagtcagtccaatcacatgagcacgaatttacctgggaacgtgacgtaaggagcctaagctcccctcagtggtgagcctgctctcctggagtctagccgcttcttacagctggtggctgtgacagcccgaaggcctcctccacatacctctgggctgccctgtgggtcctctgtgatggacacctgtagagcacaccctctcaatatttatttcttgtctctggtttagaattcatcagcagtccttggcactcaggctggggatggcagggctgtgcgtagcctgccctcagtc

SEQ ID NO: 150984 - DNA, 601 bp, Human
cagggctgtgcgtagcctgccctcagtcacctcggtacaggagggaccttctgcccatagtgggccgtgtggcttcccctgggcctgtctataggcctgccctggggagtggttttggtttgtggtgcaagggccagaccagccctgcgcaggactctcctggatgcctttgcttggccacttgtctaagtctccggcactgttttcgttaacaacagaccttcttggctctgctcattctcatcattagtgaataacaagaaaggagtcaaaccctaaacatgtggcatggtgaaacctsttcagatgctctcaaagtcttgacatttagatccacatggagccatgtggagaagaggcacctgcacgccgacctctgccccgtgagggcctgccatgtcctccccaaggtagcagcacagaataaacgggaggccagccacgcctactttcctctctgacttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatc

SEQ ID NO: 150985 - DNA, 601 bp, Human
ttagatccacatggagccatgtggagaagaggcacctgcacgccgacctctgccccgtgagggcctgccatgtcctccccaaggtagcagcacagaataaacgggaggccagccacgcctactttcctctctgacttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatcttaatactataaagagaaaaaaatttytaatatttaaaaaattgtatttatcgtaagtatatgaaagtacttccgctttcattgaaccagattaggaaacaaaaacatacatttttcccccaacaaagccacgaaattacaagtgccctagttagagccagcgtgccacagcctgggggagctcatcctgagcagaggaagctgtacctgcagcccagtctcaggccagcttcagatatggttcagaagctgttagaagatcacagcctgagaacctctgttctctttaatcctgaaaaatgaaaatctgagcagttcaggctttgg

SEQ ID NO: 150986 - DNA, 601 bp, Human
ttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatcttaatactataaagagaaaaaaatttttaatatttaaaaaattgtatttatcgtaagtatatgaaagtacttccgctttcattgaaccagattaggaaacaaaaacatacatttttcccccaacaaagccacgaaattacaagtgccctagttagagccagygtgccacagcctgggggagctcatcctgagcagaggaagctgtacctgcagcccagtctcaggccagcttcagatatggttcagaagctgttagaagatcacagcctgagaacctctgttctctttaatcctgaaaaatgaaaatctgagcagttcaggctttggccaggtttcctctgttatccaggaagatgccacatctgacggcccataggagtatggagttatgtcgatggtagaattgatctgttacccggttaatttattttaagtccctcatatctcttgtgtttcaattgg

SEQ ID NO: 150987 - DNA, 601 bp, Human
ctggtcaacatggtgaaaccccatctctactaaaaatacaaaaattaggcgtggtggcgtgcacctgtactcccagctacttgggagactgagacaggagaattgcttgaaccccagaggcagaggttgccatgaggggagattgcaccattgcactccagcctgggtgacaagagtggaactccatctctgaatgaatgaatgtcttcaaagctataccgaagcacagaggacagtacagtggaactaccgtgtgcctgtcccacagattcagcatgattttgccagactggttaagctkctttggttatggctgtgctatagtattttagagaaaatcattgccagtttattctttcactcctaatggtttttctaaaagatgaggccattttcttacatcccctcaatcaactaaacatctccccaatttgacagtcatttcttattgtcatcgactcccagcgtgttcggattgatgtgggtgcctcaattaggaggcatgtgaggttggctcttgtgtttaatggtcagtttcttaatctagaattgtctctcctttgtcctcctcctcttcttttcatgccatcatttgctgaaa

SEQ ID NO: 150988 - DNA, 601 bp, Human
gtgcacctgtactcccagctacttgggagactgagacaggagaattgcttgaaccccagaggcagaggttgccatgaggggagattgcaccattgcactccagcctgggtgacaagagtggaactccatctctgaatgaatgaatgtcttcaaagctataccgaagcacagaggacagtacagtggaactaccgtgtgcctgtcccacagattcagcatgattttgccagactggttaagcttctttggttatggctgtgctatagtattttagagaaaatcattgccagtttattctttyactcctaatggtttttctaaaagatgaggccattttcttacatcccctcaatcaactaaacatctccccaatttgacagtcatttcttattgtcatcgactcccagcgtgttcggattgatgtgggtgcctcaattaggaggcatgtgaggttggctcttgtgtttaatggtcagtttcttaatctagaattgtctctcctttgtcctcctcctcttcttttcatgccatcatttgctgaaataactagattggttgtcaaaggaaccagatcccacattcagtgtttgttcacttgtat

SEQ ID NO: 150989 - DNA, 601 bp, Human
agctgggactacaggcacatgccaccacgcccagctaatttttgtattttttggtagagatggggttttgccatgttgaccaagctgttcttgaactcctgacctcaagtgatccgcccaccttggcctcccaaagtgctgggattataggcgtgagccaccacccccagccgatttactgtctacttctagtggagaccaaatactttttcttttctttctttttgacttttagcttctcttactatttttgaacaccattaggaatattactggatttttgtatatacggtatattttrcacagttttggtaatttttctctttagatacacaaagagaaaaattatttatcttctctttcggtatctgtggccattgggaaccccttcatctggcttctgtgtccatttatttatttatgtttaatttgtttaaacagctttattgaggtgtgatttgtataccaccaaactcatgcatcttaagtgtttgacgtctctgtcctttggcagagagacatctcttccttccttacttggtacagagtgagaggtggctgcatgtatattttttttgtcttgatcttaaataccttcttt

SEQ ID NO: 150990 - DNA, 601 bp, Human
acgcccagctaatttttgtattttttggtagagatggggttttgccatgttgaccaagctgttcttgaactcctgacctcaagtgatccgcccaccttggcctcccaaagtgctgggattataggcgtgagccaccacccccagccgatttactgtctacttctagtggagaccaaatactttttcttttctttctttttgacttttagcttctcttactatttttgaacaccattaggaatattactggatttttgtatatacggtatattttacacagttttggtaatttttctctttrgatacacaaagagaaaaattatttatcttctctttcggtatctgtggccattgggaaccccttcatctggcttctgtgtccatttatttatttatgtttaatttgtttaaacagctttattgaggtgtgatttgtataccaccaaactcatgcatcttaagtgtttgacgtctctgtcctttggcagagagacatctcttccttccttacttggtacagagtgagaggtggctgcatgtatattttttttgtcttgatcttaaataccttctttcagattatctcagacctcgagtcttg

SEQ ID NO: 150991 - DNA, 601 bp, Human
cctgctttgctttcattggctagacttgtacattactgtagccaagctgtaataggagctgagaagtggttttattgtttaagccctcttccaaagttggggttttacttagaaaaccccagacacagagtggttttattgtttaagccctctctcaaagttggggttttacttagttggagtttttctaagtaaagccccaactttgggagagggcttagacaataaaagtacttctgtgctaagtaaacgagagggcaataggtattatataggttacttgaggtcactgccacacctwactatccagaagacctcccacaatctgtggtttccactgttagaatttacttcctctgagtgtgtgtgcagttgagaagctcatggtttgaacctgatcattgtagcacaatgttattcataccttggttattatgccattcaacactgcagttaagttggaaaaagagttcgtgaaataaattagttcccccttttcaagcatttgccaatttttcagtcctaaaaatgctggaaaggaatgaaaaatatttttcttgattatcagggaattcctggtgtcagtaggttttctaaaata

SEQ ID NO: 150992 - DNA, 601 bp, Human
cttttagaagcatcctagtgagtattaactgaaggtatttccacaaaatcatgaagaacagagtaactgtagccatcctggttcctttctagtcagtggggacactgacaaataagccttcccttttgttctctgtctctagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaaygcctctgtcgctttctacaaaacctcagagcaggtcaggggagaggttcccttccttgaactccactgatactttattttgagcttaatttattggacagctcaatcattgttaacatgttcatcgttattgaaacaatcagttgccagtcaagcagggaaaaggcattctggagttaaaattattcctgtgtaccttagatgtcaaaggtaataagctagaaagtagctgagaagacacctctcttcttgtcatttaaacataggacctgaagcacattagagagagacaggatatttg

SEQ ID NO: 150993 - DNA, 601 bp, Human
tcatccccagagcccgactgaaagggctttccagggataccagtcggcagtggcagatgccaagtctgagcctcaaacttttcctgctcacaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggtaggggcagcgctgcgggacagtgcacccatcagaggcttcctgcctgccaggtgcrcgtggcacagtcatcgcttcccaagggagcctgccccacacctcttgcctgctgtggaatgtaacggggcagtgtcgcatcagtgagaagtcagctgaagaaagaaaaccttaaaatccttttcatgtgcgattgccttgtctttctagttttcacagggaaatagctaaaaatctgtatgagtaaggattggttggaagtcacaataccaggtgatgctggagacagagtgattgagtgattgattaatttggtgaaaaacaatacctatagcttaaaataatcttcctttggagactc

SEQ ID NO: 150994 - DNA, 601 bp, Human
aggctctgcttgttatcaccacccagacccattaaaagtaggggtggtggtcacttttcctccttaccttctcattgcttcagcgttctcacctctctgaccactttcctgttacacttaacactttctgtgtttttttctgaagtccgtcatctgacagagttattgtttagtctgggaggataaattgtaactctttggaaattatatctggtaacttactttgtgctcccaccacagtgattttctttttaagcaagctcccggggtgaaaaaaccatcacagtttccacggtcattmgttataactacgtcaacagctttttaaagcccctgcccccaacatgtccctactgcttaagtttaccaaatgctgaccgctgttaggatttcgaggtggaatcattagaattttcccctttgtccaggatctgtttagtatgaaagaaaaatgaatgccacttagttcatataattaagatagctatttaggtaaaattacaaaacaaaaatacaggcggtcctcaagttacgatggtttgacttgtgatttttggacttgttggtgtcagtgcgctgtgcattgagtagaacctgtaca

SEQ ID NO: 150995 - DNA, 601 bp, Human
cctactgcttaagtttaccaaatgctgaccgctgttaggatttcgaggtggaatcattagaattttcccctttgtccaggatctgtttagtatgaaagaaaaatgaatgccacttagttcatataattaagatagctatttaggtaaaattacaaaacaaaaatacaggcggtcctcaagttacgatggtttgacttgtgatttttggacttgttggtgtcagtgcgctgtgcattgagtagaacctgtacatcaaatgctatacaaccattgattttcactttcagtgcagcattcaatraattacatgggattataaaataggttttgttttagatgattttgcccaactgcaggccagggtaactgtaggcttaaattgagcacttttaaggtaactaggctaagttaaactgtgatgttgagtagattaggtgcaataaactcatttttgacttacgatttttttgacttacaatgggtttatcaggataagtcaaggagcatctgtaatcacaagcctttttggatccctttgttcaactagaattttgtggtgtttgtgtataggatatttaagtacctttttattatgggaatt

SEQ ID NO: 150996 - DNA, 601 bp, Human
tctaaacaatactccctcctttcattactatttattaattgaagaaatacgttcctcggattgaggcatttcccccattccagattggtaattacatcctgtggggtcatttagcaccatccacaatttgtagatttttgttaggttgtgagccttgatcagagctggtttgaaaggcggagggggggcgatggtgggggaagaaagagaggcgggggtgtgagagagagagagagagagagagagtgcaggcgagcttggaaaaccttgccagtggtgcttgtacttcctatgggattaytcaggagacacataatgtctagttctctcttttgtctctgtgattggtaagaagattgatcagtggttcaagtacggtcagtgcagttcatccctctgtacttcccatcagcctttcagctaatggtgttagtacccagtggtaataactgttttttaggaattgcaaaatggtaatactctaattctatcatttcctttggcctcgattagctagaattattccctctcagctatttggttattctaaagtagagtttgtccagaaaaggcagagtaaatgcttgcttgatccttttta

SEQ ID NO: 150997 - DNA, 601 bp, Human
ctaatgttggatgctgtgaagaattaaaatagaagtgttctgtttccctcagagcctacttgggggtgaaaggtttatttatgctcgagtcagtgcactaagttcctgtaagagtaatggtggcagaaaagacagtctaaccccaaggcacaggcaaggaggagtctcagaccacgtggtcagaggacccccaggagcttgaggaagccccgtatccaagagggcgcttagcactgtttgctgctcacttgcccgaaattagtactggctcaggcagagactgtggaaataggagactagraaaaatgcgttatctcatattcattttcatgtgcaatattttcatgtaagtgatagcttaattttttagcagacttcagatttcaaagttttaatttatctcactgtgctagtttacctcttcagtggagtaaaaataacagcatgaccactggtccctgggggatagttggcagtgtctaaaggcattttttattgtcatcaaaaatgatgacaccatattgtcaccataagaatatggtggtatttagggtgataatggtagagatggagaaaagtcaataaatttggggttcatttt

SEQ ID NO: 150998 - DNA, 601 bp, Human
aatggttttccagtgtaataaagttaccgggaaccctttatttgatttgcagtttcagtcttgggaatttttttcttaagttttttgtttgtttcataaacttctagagcaaaacagacttagtgtcaaaaactcaaaaagtgtacaaatacatatgttagctaattccttagctactggtaaccactgtcaaggcttttgtgcaacctgtctgtgcatgtaaatgtaaatatgtagagaaatacaaacatatatttcactcacccatcccactttttaatttgttacaaaaatgggactrtattaccttgcaacttgcatctttcacttaataatatatcttagtcatctttctgtgtcagaatttaaagatctgctgttctttttaatacccagtatagcatttttgaagttaatttgacctgtctctcaattgatgggtcatacattgctgcctattttccactgttctaaccagcgcttcagtgttccaacatctttgtaaaaacagttttgaatagttgtgtaagcactgttcatctgaaagttaaattcccagttcaaaggaatgcatgcaccttttcagtgtcattccctgggg

SEQ ID NO: 150999 - DNA, 601 bp, Human
aacctgtctgtgcatgtaaatgtaaatatgtagagaaatacaaacatatatttcactcacccatcccactttttaatttgttacaaaaatgggactgtattaccttgcaacttgcatctttcacttaataatatatcttagtcatctttctgtgtcagaatttaaagatctgctgttctttttaatacccagtatagcatttttgaagttaatttgacctgtctctcaattgatgggtcatacattgctgcctattttccactgttctaaccagcgcttcagtgttccaacatctttgtamaaacagttttgaatagttgtgtaagcactgttcatctgaaagttaaattcccagttcaaaggaatgcatgcaccttttcagtgtcattccctggggtcatcatactcagtttttctccctccataatagaggatcatgattacctgttcccttactctttccaacactggatcttacccgtctagcaggaaagcagtgaaagatggtctcattgtttgaggttaaatgtgttcctgtatatttagtgactgtattttttaaattgtgaacttcgtatttataggctttactcattcttct

SEQ ID NO: 151000 - DNA, 601 bp, Human
tttttctttttttttaatccacccttgttgattattactccactattttgacacaacctttaatctgtataaaagtccatctacacaaggttttaatagtcttgaaaaaaatgctgattttttttcagccattgtcgaattgcatattataaaattgtgcattatgtcgaattcatattacaaaatacacatatcccacgaatccatccagccggaggtattacagactgacgttaaatttccagtggtgtctttatcgtaagatggtcaaatggaggtgagagtgagaagaggtctggtmgacatgctcactgagacaggaaagcagtgtgattctttatttatcgtgctgtcttgcaatggcatttgcataaaagtctaaataaaaatgaatggaatttcgcgggtgttttaattgattgcaagcaccaacatacatcattttcttttttctctcagatatcttgaatgaactcttccaacgggagaacagggtattgcattactggaccatgaggaagagacggctggaccagtgtcagcagtacgtggtctttgagaggagtgccaagcaggtcagtgcacacctggtgcccagcct

SEQ ID NO: 151001 - DNA, 601 bp, Human
aaaaatgctgattttttttcagccattgtcgaattgcatattataaaattgtgcattatgtcgaattcatattacaaaatacacatatcccacgaatccatccagccggaggtattacagactgacgttaaatttccagtggtgtctttatcgtaagatggtcaaatggaggtgagagtgagaagaggtctggtcgacatgctcactgagacaggaaagcagtgtgattctttatttatcgtgctgtcttgcaatggcatttgcataaaagtctaaataaaaatgaatggaatttcgcggktgttttaattgattgcaagcaccaacatacatcattttcttttttctctcagatatcttgaatgaactcttccaacgggagaacagggtattgcattactggaccatgaggaagagacggctggaccagtgtcagcagtacgtggtctttgagaggagtgccaagcaggtcagtgcacacctggtgcccagcctccccctaaactcccgtgctcacacctgtctccacagagaggctgagcttgacatttccgccatcttgaaaaccactttctaatgacaaacagtatagccttctagt

SEQ ID NO: 151002 - DNA, 601 bp, Human
cagaactgctcagttcccagagttagatgaactgggttcctaggccagggatctggcgccccaccttggtccttctctcctcctggtgacgttccaggtgtagccagcatgttcccaacagccaggtggcatgcagtcacgtttagtaaattatactctcttaacatttattagacagtttaaccatattcaagatcatcggaggcctggttagatttctaattagagatggtttcaggttcttttctcacataactttattatctctcttgaaagacaatccctcagctatagaaaagcraaattgtacataattttgttggcagagaaagataatggaatgtattgttgcattttcctaaagtccgcttattcaccgaaaataaaatcctgaagtgcgtgctgttgcaggtggtgccccatctgccttccagccgttctgcttctgttcactgtcacaatatgcagcacatacccagtgctttcgcagaccggcctccagggctcttgctgatcttgccttggcgcaggcccctcccgcctgctggccacccaccccaggcctcactgctctccttcctatctcccactctagtcattg

SEQ ID NO: 151003 - DNA, 601 bp, Human
ataatggaatgtattgttgcattttcctaaagtccgcttattcaccgaaaataaaatcctgaagtgcgtgctgttgcaggtggtgccccatctgccttccagccgttctgcttctgttcactgtcacaatatgcagcacatacccagtgctttcgcagaccggcctccagggctcttgctgatcttgccttggcgcaggcccctcccgcctgctggccacccaccccaggcctcactgctctccttcctatctcccactctagtcattgcctttcttggcgctcatttttggcttgttctyatctctctttcctcttctgtcttttctgtgcgctgtctcccagcccaggcctccatttctggtctccggattcacaaatcccagttacatccttgacatcactccacagtgactttatgagaagcagaactgcactctcggttccctgtctccgtgtccctcttgtcttacttgttgttagaaacaactaggtgtggtgttctcagttccctcttcccggcgccccgcctcctccttcgcgccccgcctcctccttcgcgccccgcctcctccttcgcgccccgcctcctccttcgctcc

SEQ ID NO: 151004 - DNA, 601 bp, Human
ctcttgctgatcttgccttggcgcaggcccctcccgcctgctggccacccaccccaggcctcactgctctccttcctatctcccactctagtcattgcctttcttggcgctcatttttggcttgttctcatctctctttcctcttctgtcttttctgtgcgctgtctcccagcccaggcctccatttctggtctccggattcacaaatcccagttacatccttgacatcactccacagtgactttatgagaagcagaactgcactctcggttccctgtctccgtgtccctcttgtcttacktgttgttagaaacaactaggtgtggtgttctcagttccctcttcccggcgccccgcctcctccttcgcgccccgcctcctccttcgcgccccgcctcctccttcgcgccccgcctcctccttcgctcctcgctcctcgctcctccctcgctcctgcaccaggtccaggaggcgcagacctctgggtttctcagccccatcctgtcgtatcccgtcccgcttcccactgctgccctggccatgtccccttgcccctctgctccagggcgctccccagggcggctgactcccctctctctgc

SEQ ID NO: 151005 - DNA, 601 bp, Human
cacgtatgtttattgaaacactattcacaatagcaaagacttggaaccaacccaaatgcccatcagcaatagactggataaagaaaatgtggcacatatacaccatggaatactaagaaactcaaactttttattgttgcgacataagtgatactgttataaccatctagaatatcctttttaaaaattttgtaattgtggtcacacttcagttttatttaagaaacttgcctctctgggagggaatgcttctcgatgctgccagccttggtttgtgatttgacctttaaatgaggtgctyggggctttgggctcctctcaggaatgtgtagccctctgactccattcattccttccccttccaggctttggaatggatccatgacaatggcgagttctacctttccacacacacctccacgggctccagtatacagcacacccaggagctcctgaaagagcacgaggagttccagataactgcaaaggtgggttcagagtgtactttgtatagtggcctctaagtcgaaagcgagtcttcaaaaatatcataaagaaatacctcatgagattggagaaaaggatgacccagtgggctgtt

SEQ ID NO: 151006 - DNA, 601 bp, Human
cctccgtgtcctccacctcctcccttcatctgtgtcctttgtccctctgatgtctgtgaatacggccatctctctccttttcttccttgtccttcccattattcccttctacactttccccttcctgtttacttctctaagatgttttctgaggacttgctatttttatgaaacactatttggtgtccccaagttgacctttatgtattcttggggtgttttctttcctacacctgggggtgtttcaccgtctttagatggtgaaaactgttacagtcgtgttgctcacgctcagttcagyctgcagttgtctgtgttttatggttggcagagtctgtgtcatcgcctctgttagtgcttgttcagaggtgtctaaaacttgaggcattttcatttttctcctgaaaataaaaataaaattatgaaatcgaattatctttatggcatatgccatatgtgtgagtaaatatggctttttgaggaaaaatataagaatctgcatattgacctgaatgttgtcccaattaaggcttatacctgcagaggctgagtccttccaagaactcacaacagttttgaggctcttttcaagtcaccatta

SEQ ID NO: 151007 - DNA, 601 bp, Human
cataacaggaatttttcaatcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggcwgggcgcaggaccaggggacagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtg

SEQ ID NO: 151008 - DNA, 601 bp, Human
caggaatttttcaatcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggctgggcrcaggaccaggggacagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgt

SEQ ID NO: 151009 - DNA, 601 bp, Human
tcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggctgggcgcaggaccaggggayagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgt

SEQ ID NO: 151010 - DNA, 601 bp, Human
tactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggctgggcgcaggaccaggggacagtagctgcccccagaggcrcaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgtgtgagacatgggatcttgct

SEQ ID NO: 151011 - DNA, 601 bp, Human
tgtgtgttagacatgggatcttgctctgttacccaggctggaatacataatagttatgcacattatatgatctgtatttaggggcgtgtgtgtgtctgtgtgtgtgtgtgagacatgggatcttgctctgttacccaggctggaatacataatagttatgcacattatatgatccgtatttaggggtgtgtgtgtgtctgtgtgtgtgttagacatgggaacttgctctgttacccaggctggaatgcagtggcaccataatggctcagtgcatcctcaaacttctgagctcaagggatcstcttcaaactcctgagctcaagggaggctgaggtgggaggatcgcttgaggccaggagtttgagaccagcttgggcaagatgacaagatcctgtctctacaaaaagaattttttttaattagttgggcatggtggtgtgtgcgcctaaagtcccaagctatgtctgcttatttgaatattgtttgattataaaggtattaagaaaatgcctaacatcacataccacactcaaagctagatttaagatttgccatctttcacctctgctccactctgcaggccattgtgtatggccagaca

SEQ ID NO: 151012 - DNA, 601 bp, Human
aatcagaaaacacctgctttggtgtttggagatgtcctttgatttttcatcatgagctgaggctccctcacttgccttctgtcacccgatcttagaatcttctaagaaaccattttgcttttactgtatagagaattcttagctctgaaaggaaagtctttcagtgcacttgttacaatgttataacatttttagtgttgatggaaatgaagctggaaggctaaacaagagtctcccatccccggctcgctgagactcggctcggtccctttgcagctctcagtgcagtcatttctccacrggtcttgcaggcaccacctgcatccaggttgtgggtgtttatttaagagagatttctgtcctcactccaaacctagtgacgtaggctctcttggagtgaggcctgcggatgagcatttgaacagctcaccacttgatttttgcacacactgaggtccggaagccattgccttactgacgccacagccttcttcccatagggcttcctgtggtcctgatcaccagcgtccgcaatgccaaatgccttactttgttagaaagtgtctaacaccattgaatttctgtctaagaacatgatgag

SEQ ID NO: 151013 - DNA, 601 bp, Human
aggtaaatggctttggaaaaaaaattaagttggatttatatctcaccttgataccgagataaataccagaagaagatttaaatatcagcagtggtacctaatagtaccagaagaaataacaggatattttttatatcctcgtatggagaaatttgtctaaatgacacaaaatccaaaccatgaaagaaaaggttaataaattcacctacacaaaaaaatgtaaaactttacacaagacagtccaccataaggaacatctaaagttaaaaatgaaatagagaagatatataggcagctcatatcacaaaggactgatttgccagtaagaaagaacttttacaaatcaataaggaaaaaaaagaccaagaaaatggacaaaagatattaaacatgtgtcatagcaagggaataaatggccttcaccatgagatcatcaactttacttaatataagaaaagcgtacatcaaaaccacactgagttcatttcacccagtggattagccgagatcaaaaaggtggaccccatgctgcgtggacgaggctccgttgctgggggagtggagcagggcagcccctcagaggcctccggtggcatcttcc

SEQ ID NO: 151014 - DNA, 601 bp, Human
tacttatatacatttgcgcacttgcttgtacatgcacataaaatgtctctgaagtgatagcaagaagctggtgattggaactggtgacagtggaaggtggggtgagaagagtttttactttgtatcttttttatctttggaattttgaatcctgtaaatgtattttaaaaataccaatgcaagtaaaaatatactgagatatttttaaagttcataggttagcagatttatggtacttagtttttatcacaccattcagttgctcaataattcttgtttaattttggcaagctgcattatmtttttatcttcacttctgtgtccccatcacttaaaacactcaatagctttcttaaccccttaaagatagacatacaggtagtttacagtgccctccacagatggcccttgtggcaatgtaagagatgttagtgaaacaagcaaagatttctgggctgtgaaggtgacgttctcacaggagaaggacagacgacgattgtaaaaaatcacttgcaccctctgtcagaaggccatacatgctatgggaagcagcagagcagaagaataggcagggaggcaagctgcagtttaagggggtcca

SEQ ID NO: 151015 - DNA, 601 bp, Human
tacatgctatgggaagcagcagagcagaagaataggcagggaggcaagctgcagtttaagggggtccagggagggcccgctaagagagtggcgtttatttgagtagagacatgaaggagccatagggatatctgggggagtggctttccaggcaggagcaccagtgcagaggccccaaggagggtgctggcctggaggggtgagttggtgagccacagctgggggacgggggtgctgttgggtggctaggggctggctggagtgttggggttatttgtgtagagtctggaggatcttgacrgctgacttcacaggttacccagtgaattatggcttagaactttgattttacaagctaagatcatttatctgggttttgaactccgaccttctttcttttggggatttttaaagtcagtttcctgaatatgtgttaaaaagattttctagttaaagcttaacggagaatagcaggttccatagaagaggagtaactcacttatttgaaaacactataacaaaggaagcctaatagtaataaccatcgaaatggatgtgaagagagagagctgttgagaagtcagagttgagtgaggttgcc

SEQ ID NO: 151016 - DNA, 601 bp, Human
cagtgcagaggccccaaggagggtgctggcctggaggggtgagttggtgagccacagctgggggacgggggtgctgttgggtggctaggggctggctggagtgttggggttatttgtgtagagtctggaggatcttgacggctgacttcacaggttacccagtgaattatggcttagaactttgattttacaagctaagatcatttatctgggttttgaactccgaccttctttcttttggggatttttaaagtcagtttcctgaatatgtgttaaaaagattttctagttaaagcttaayggagaatagcaggttccatagaagaggagtaactcacttatttgaaaacactataacaaaggaagcctaatagtaataaccatcgaaatggatgtgaagagagagagctgttgagaagtcagagttgagtgaggttgccaaatggtatatataacttgttgtatggttgtctgtgtatctctgtgaaaaataataaactatgcttaacttaatgaaagatcttttctgtgtacatacaaaatagaataattttagagagagctctcaaacagggaaacaaaatttacagtacctctatat

SEQ ID NO: 151017 - DNA, 601 bp, Human
taactcacttatttgaaaacactataacaaaggaagcctaatagtaataaccatcgaaatggatgtgaagagagagagctgttgagaagtcagagttgagtgaggttgccaaatggtatatataacttgttgtatggttgtctgtgtatctctgtgaaaaataataaactatgcttaacttaatgaaagatcttttctgtgtacatacaaaatagaataattttagagagagctctcaaacagggaaacaaaatttacagtacctctatatagatgatttcctgactagtgaattttcctycacattttctgagagttaaagcaatcaacacgacacagaggagcttcatgaggaattttgttgagtgcctgctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccatgcatccattctacacatttttactaagcacctccta

SEQ ID NO: 151018 - DNA, 601 bp, Human
ctctatatagatgatttcctgactagtgaattttcctccacattttctgagagttaaagcaatcaacacgacacagaggagcttcatgaggaattttgttgagtgcctgctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccrtgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctggggctttggtctcagtttctaccatcagccggttttcctgttcagagctcagagttggagtcaagtcgccactgtgtttcaggtttctggcagtcggattcatttgcctcacaatactttcctgttgttttttgcagca

SEQ ID NO: 151019 - DNA, 601 bp, Human
agcggctttgaggagagtagcagcattgtgaagaccgcgttcttcgcatacattcctccatgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctggggctttggtctcagtttctaccatcagccggttttcctgttcagagctcagagttggagtcaagtcgccactgtgtttsaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcggtaaatggccttgtgcaaactgaataaattatggtcttcttcctaacg

SEQ ID NO: 151020 - DNA, 601 bp, Human
ctgagttcattggctctgttattccacagagtaaaagtctccagctagatatcattccagccagtatccctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgsgttcactgtcctcttatcacctggttcagaaacagcatctagtttttatccctgtgcctgtgtttcatatggagttgatgaattgtcattaatagatagtgacactaaggagaggaaattaatagtttttatcacgcctaaaacaaatttagttgtgtaaaagttgccagttagtaaactctatataaataaaaaagagtgctctaatccagtggttcttaattggcagttttgtccccaatgtgaggggacactttggttgtcacagtggggagggggagggagtgctgttggcctcta

SEQ ID NO: 151021 - DNA, 601 bp, Human
ctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgggttcactgtcctcttatcacctggttcagaaacagcatctagtttttatccctgtgcctgtgtttcatwtggagttgatgaattgtcattaatagatagtgacactaaggagaggaaattaatagtttttatcacgcctaaaacaaatttagttgtgtaaaagttgccagttagtaaactctatataaataaaaaagagtgctctaatccagtggttcttaattggcagttttgtccccaatgtgaggggacactttggttgtcacagtggggagggggagggagtgctgttggcctctagtgggaagctgctgagcactctccagtgcagagggcagccccacagcagagttacctggccccagatgt

SEQ ID NO: 151022 - DNA, 601 bp, Human
agggggagggagtgctgttggcctctagtgggaagctgctgagcactctccagtgcagagggcagccccacagcagagttacctggccccagatgtccacagtgccaggttgagaaaccctgatctgtcggtacctcagtaaagtgtgtgcagaaatctttttttcccctttgaattagcgggtggatactgttctatttgtgattcacctctccaaaatgatcaatctaagactaatacttttagacccactctgttatttcataaatccataaaagtagatagtgaagtaagctgcacsctgactgtactcctcactgtcttcctctctttaaggttcataatggctgagctcattcaaactgaaaaggcttatgtaagagacctccgggaatgtatggatgtaagtaagttttttttttttttttttgcttgtttatttagattgagcataagcttgctattttattcttacctgttggtagtccttagaataatcacaatttttttctgtcatttttttaaatgtaaagtatgcttcagcagccggtttcatgtttctgcacttctgtagagttctaggtttgtttttcactcatta

SEQ ID NO: 151023 - DNA, 601 bp, Human
ttgaagctgggaataattttagagttgaaaagtataggaactcctctcaagtattaacagcaactgagggccttttttagaagggttttttatgttttgtaaaagggtccagtccttagttatactttcacttatacattaactctgtgtgtttacagatgtcagaaacagctgtttcttgaaaatatggtgattatttttgtctaatccctgtttccctctcggctagacgtacctgtgggaaatgaccagtggcgtggaagagattccacctggcattgtaaacaaagaactcatcatyttcggaaacatgcaagaaatctacgaatttcataataagtgagtggctttttctttgggagcagttacgcttgaaatccatgtgctgaagtttcatcacaagaaatgaaccattcccattgaattaagcagatttcagtgattttgtttccatttgaatgaagcctatcagtctttctccaaaaagactgacattctagaaattcttttaatacagactcaactttatgtttgtacttatcttctacagaaataagatcaggaaaactatgaaaatatttttataggaagcttaatttct

SEQ ID NO: 151024 - DNA, 601 bp, Human
tatctcactagtaaaatgttttaaaacacctttgtaatatgataccatttttattctttgcagcatattcctaaaggagctggaaaaatatgaacagttgccagaggatgttggacattgttttgttacttgggtaatgaaacctcaaccatttgttctctcccagctattaggtgacgttgaaggaagttaggagggatggtcttcatttcctttaagtcaccatcttctgctcatatccatgcttgcggagaaatagactttacctcaaagaattgcatacttcaactaattgtttttrtggagtgagtttttttattggccctggtgatggtttgaaatagaatatttagtgtgccaggtctccgcttgaccctggggatttgctgataggtgagttcccagtccttctgggggatcgtctagtctagaggggaggcagacaggtgaacgtgcggtcatgctgtccaaagcccacagccagctctgcacgcgtgactgtggaaagagaggacaggtgctcagcccgatgtgtcggggtcggggaggctgctgcagctgcatgctgtcagaacgatgtgtttcttatttcagtagcttt

SEQ ID NO: 151025 - DNA, 601 bp, Human
taagtcaccatcttctgctcatatccatgcttgcggagaaatagactttacctcaaagaattgcatacttcaactaattgtttttgtggagtgagtttttttattggccctggtgatggtttgaaatagaatatttagtgtgccaggtctccgcttgaccctggggatttgctgataggtgagttcccagtccttctgggggatcgtctagtctagaggggaggcagacaggtgaacgtgcggtcatgctgtccaaagcccacagccagctctgcacgcgtgactgtggaaagagaggacwggtgctcagcccgatgtgtcggggtcggggaggctgctgcagctgcatgctgtcagaacgatgtgtttcttatttcagtagctttctttttaaaatagagtctcttcaactcgaggcttaaatttccgttatccatactgcttcttttctatatgaaagtttatcatgcgttgacttgttatgatttaaatgagatctttttttttttggcttacaggcagacaagtttcagatgtatgtcacatattgcaaaaataagcctgattctactcagctgatattggaacatgcagggtccta

SEQ ID NO: 151026 - DNA, 601 bp, Human
tgctcatatccatgcttgcggagaaatagactttacctcaaagaattgcatacttcaactaattgtttttgtggagtgagtttttttattggccctggtgatggtttgaaatagaatatttagtgtgccaggtctccgcttgaccctggggatttgctgataggtgagttcccagtccttctgggggatcgtctagtctagaggggaggcagacaggtgaacgtgcggtcatgctgtccaaagcccacagccagctctgcacgcgtgactgtggaaagagaggacaggtgctcagcccgaygtgtcggggtcggggaggctgctgcagctgcatgctgtcagaacgatgtgtttcttatttcagtagctttctttttaaaatagagtctcttcaactcgaggcttaaatttccgttatccatactgcttcttttctatatgaaagtttatcatgcgttgacttgttatgatttaaatgagatctttttttttttggcttacaggcagacaagtttcagatgtatgtcacatattgcaaaaataagcctgattctactcagctgatattggaacatgcagggtcctattttgacgtaagtaa

SEQ ID NO: 151027 - DNA, 601 bp, Human
ggggatcgtctagtctagaggggaggcagacaggtgaacgtgcggtcatgctgtccaaagcccacagccagctctgcacgcgtgactgtggaaagagaggacaggtgctcagcccgatgtgtcggggtcggggaggctgctgcagctgcatgctgtcagaacgatgtgtttcttatttcagtagctttctttttaaaatagagtctcttcaactcgaggcttaaatttccgttatccatactgcttcttttctatatgaaagtttatcatgcgttgacttgttatgatttaaatgagatctttttttttttggcttacaggcagacaagtttcagatgtatgtcacatattgcaaaaataagcctgattctactcagctgatattggaacatgcagggtcctattttgacgtaagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacaca

SEQ ID NO: 151028 - DNA, 601 bp, Human
atgcagggtcctattttgacgtaagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacacaaatactggaagccttatatctgtaaggaactcagattgtaatatatagatgtatgtttgtgtgtgtgtatatgttattatttatattcaktcatttataatatcattactatttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggctta

SEQ ID NO: 151029 - DNA, 601 bp, Human
taagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacacaaatactggaagccttatatctgtaaggaactcagattgtaatatatagatgtatgtttgtgtgtgtgtatatgttattatttatattcagtcatttataatatcattactrtttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggag

SEQ ID NO: 151030 - DNA, 601 bp, Human
aacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggagctttagaacgtgatacacagagtgctttctgggtttccagaacttggtcaaatatgtgccaatacattttgattgaaggataaggtgctattgaatagtgtgcatagtttggtgcataaggttgtgaggatgttggacttgttttctgtstttacacttgtgcatggactggtgggatcatcagctcttatgtgaaagtctggggaagtagaataaacttttcagtttctatctttgagatgaagccctacctgtagatgaccctgttttaattgtcattctcctgaccattacattacacattacacatcactgcctttgttaataggaagccttctcccaggccaaagtggccttttcttgttaatatttcacatgattctaggtctttgccatcagacaaaattcagcacctgtatatggagttagaaatattttagtattaagtat

SEQ ID NO: 151031 - DNA, 601 bp, Human
atataattaccctgaattttttgaaacacctagtcaattaattttactttttaattcattagtatttattgacctgcctaatttctcattgcaggagttaaatgagagtgtgtgtcatgattatgcgtctgaactgcactgactgaccctaaacataaaatgagaaatcatcagttcttgatattttagtacccttagttcccagctgtggcttgctgactgcgggccaggcatggtgcactttggtacgctctgcatatgttaacctcccaacaatgctagtctgcaggcatggaaactrgcctcagactgtaaggagtgtgcccagaatcaccactcaaacacgttaacaggctcagctcagaacacagatctggctgatgcccagggcttccactgaagccacggagaacccatgcccaggaggcttcctctgtcttgttgcttgtccctgatgtcacacccctcgcggcacaccttgtccatacagaccgcaagtattggagtcaggctgacctctgctttttattagttgtgagtgactatagttaaaatcacatttaagaaaacaatagtgattagtcttgacaatagaaaggta

SEQ ID NO: 151032 - DNA, 601 bp, Human
ttagaatttgtgctaagagttgtcacaaaatgtattttatttttatattatatatcatcaatacacattttcttgactacctaaaaattgacagattttgtctggtaatgttcagcataccattttctcagctggtgaatgttattaagcattaaaatgtagaaacatgcattcatcccagtgatggtattctatgaatcctgccatgttccagggactgccctaggctcgacaacgggaagttattatgtaatttgtctagatataaaagaaatttagaagatggagttacaaatgctgraactcttctttaccctttttgttagcaagaaaaatctacagacagtaataagtagctacatcgttttgtgaaagtgatactattatgggatttttcaattggaaaagctctcctgtacttttatatcaaaatgccgttaagtgattatgtgaccattcccgcagaaatatatagttactatgaatgcaaaataagtcaggaggctaatttgttcatattcaaatttgtcctttgctttctaattctacaaaggcagtttacctttcagtgtcctcaagatgtaaggattttgttttcagc

SEQ ID NO: 151033 - DNA, 601 bp, Human
cacaatcttggctcactgcagcctccacctcccaggttcatgtgattctcctccctcagtctcccaagtagctgggattacaggtgcatgccaccatgcccagctaattttttttttttaagtagagatggagttttaccatgttggccaggctggtctcgaactcctgacctcaagtgattcacccacctcagcctcccgaagtgctgggattacaggcatgagccaccacacccggcctctgtttatcatttttgaggcttgattgttaacaggtatactaatttcatcttaaactgtraatacatctggcttactctgattagaacaggacaaaccctgccatccattgaataaagaggtagtagtttatttctatgagaacatatgcccagttgaccacattctgtttttatcttgaaagccatgggctttcataaactgtttctgccaaggtcttattggcagagcattctgcagtctttacctagtttctgttgtttatctttgcaggagctgctgacgtgctgtgaggaaggaaagggagagattaaagatggcctggaggtgatgctcagcgtgccgaagcgagccaatgacg

SEQ ID NO: 151034 - DNA, 601 bp, Human
tgaatacatctggcttactctgattagaacaggacaaaccctgccatccattgaataaagaggtagtagtttatttctatgagaacatatgcccagttgaccacattctgtttttatcttgaaagccatgggctttcataaactgtttctgccaaggtcttattggcagagcattctgcagtctttacctagtttctgttgtttatctttgcaggagctgctgacgtgctgtgaggaaggaaagggagagattaaagatggcctggaggtgatgctcagcgtgccgaagcgagccaatgaygccatgcacctcagcatgctggaaggtaaaggaccctccataccccagtgtgcatctatgcagtttctaatgacactgtttgtaaatggatttcctgaaccctaaaaatccccgctttatgtctctatgttagtggttaagaacatttcttaaagaatcagtgtcattgcttttcttgaggaccacataaaatgtttctatactcattgaaagccttttctggtcccttcactggaaaacagcctctccacactctggactccaatagcactttgtgtcgcttgctgcaggccacctgtt

SEQ ID NO: 151035 - DNA, 601 bp, Human
aaaatccccgctttatgtctctatgttagtggttaagaacatttcttaaagaatcagtgtcattgcttttcttgaggaccacataaaatgtttctatactcattgaaagccttttctggtcccttcactggaaaacagcctctccacactctggactccaatagcactttgtgtcgcttgctgcaggccacctgttctccctgttagatggatgggtaggtgggtgtatgggtggatcaaaccccaggactgtaaaatccttaaaagaatgtgttgcttccccacctctgtatccattgcwtcacttgctagagcctggaacatagtaggcaccagatatttccttgtgtaacatggtaaagagaaaattagataaatatgtttcaaaattagagcaattataatttccataaatgcctctgtttaagaaagctcttcctgttgtgcaaagcttggttcttgccaggctacacagaataagttttaatcctgccccaaatgcttttgctagcctgtgtctttatgggtaacactgaacataggtgccactgtgggtaataagacccaaaactcagaggccaagcaaaacagatttttcttt

SEQ ID NO: 151036 - DNA, 601 bp, Human
tacacagaataagttttaatcctgccccaaatgcttttgctagcctgtgtctttatgggtaacactgaacataggtgccactgtgggtaataagacccaaaactcagaggccaagcaaaacagatttttctttctctgatataaaatgctgatctggtatggccgcccttcatgatgtcatccaggacccaggctgtgttccagctagtttctctccattctagttgtttttctggctggctaggtccagggtgtttcaagaccatgccaacattccatttagcaggaagtggggaagaargtcagggaggaaactccagatgggcagacactagcagtagtacccgctactttgctcacttgcccagagcgtaggtacctgagctgcttttaactgttcctggggctgggggatggagtgcttattttgagcagccctagtgggagcttctactatgagagtaaaaagagagtggaagtcaggaggtaatgggcagcctctgccctagggctggctttactaagccctggtggcttcataaccaggtgataaagcaggccacttccatgaagagaggagcagtagtgaagtccagagcac

SEQ ID NO: 151037 - DNA, 601 bp, Human
gcttattttgagcagccctagtgggagcttctactatgagagtaaaaagagagtggaagtcaggaggtaatgggcagcctctgccctagggctggctttactaagccctggtggcttcataaccaggtgataaagcaggccacttccatgaagagaggagcagtagtgaagtccagagcacgaatgattcacatgcagactgtcacattcagaggagggagggtgcaccaagcatgggcagccagggacttctccaagaagcaagaccaggacaggtccttgaagaaagcctggacctgascagagtgtctgggaaggatgctctgggctgaggaagcagagagaatcaagacggaggctgggaagtaggtgggggcttagaggagagtcggaactgtttcagaggaggagctttcggtggtgggatgctgcaggagagggctgaagagaagtagagggtggaaccagatctcaactgttgcagaggcccaccagagggatagaactcaaagaataaagccatgaggaatcgcaaaatgtttttgaacaaaggaaaatatatgtaaagtggtgtgttaggaagaattatcctctgtaggat

SEQ ID NO: 151038 - DNA, 601 bp, Human
ggggcttagaggagagtcggaactgtttcagaggaggagctttcggtggtgggatgctgcaggagagggctgaagagaagtagagggtggaaccagatctcaactgttgcagaggcccaccagagggatagaactcaaagaataaagccatgaggaatcgcaaaatgtttttgaacaaaggaaaatatatgtaaagtggtgtgttaggaagaattatcctctgtaggatgggtcagtggcgtcgagtcaggatcagatgggaaactcttatctagggttggccgatgggcatttttaaaatgttgaaaatactaataatgctttcttgtgcatcagtttttatttttcttttaaattgatttgcctcccttttttcatgttgtagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgta

SEQ ID NO: 151039 - DNA, 601 bp, Human
accactggctagccttaccagcctccccaagggcagcatcgtctctggatccagtgtacttccatctaacttagtgggccgtttctcagaggcttattcatgcagggtcgctgggcagggccaggcagaagggacgattgggttgcactaaggaggaatcatcatcaagaaaagaatagaaaatgccaagaaggtgggtttctttacagcagatctcttataaatactggtagatgtttgcaatttggacaacttacacatcatactttttgtgatgtccatatataatgaaattcttcargtaataaaatgtccccgagtatggaaatcatctgagtaataatctggaattcacaggttccaaatgatggttttcataccattttgtttggcttgtgttctgtttgagatcgtcttttggatcacagcttgcctgacatcattttaggtcgcattctgactggaaagaaaaaaatgcaacattgctggctagtaatttcattagctggctttaatctctctttagagaccaagctcatctgttttagcagccaatacatcttcacttaatttatcttttagaagttaagattccctcaga

SEQ ID NO: 151040 - DNA, 601 bp, Human
ggaggaatcatcatcaagaaaagaatagaaaatgccaagaaggtgggtttctttacagcagatctcttataaatactggtagatgtttgcaatttggacaacttacacatcatactttttgtgatgtccatatataatgaaattcttcaagtaataaaatgtccccgagtatggaaatcatctgagtaataatctggaattcacaggttccaaatgatggttttcataccattttgtttggcttgtgttctgtttgagatcgtcttttggatcacagcttgcctgacatcattttaggtcrcattctgactggaaagaaaaaaatgcaacattgctggctagtaatttcattagctggctttaatctctctttagagaccaagctcatctgttttagcagccaatacatcttcacttaatttatcttttagaagttaagattccctcagaggctacctctggagctctggatgatgaatcacttcctttgctggggtggagaatgcatcagggggaccttgactgtgggggaggggctgaagctattgacctttctctgcatgcttccatgttctgcatatattacagagggattttgcct

SEQ ID NO: 151041 - DNA, 601 bp, Human
atgatgtcctcatagttgtaaaacaaaattttggttattttcacttctcctagtctggaaaagagaattttatttttaagtcttaagcagattgcgactacccagattatgaaatgaactatcccctctcttagccaggtaggaccttggtatttagtactttacctcagttacctttctcttactatttctgaaaaactgacatcttttttcctcgtttaatttctttaaggttaggagaattactctctaagtgtaacgatcaattcatatgagaattttctttatttctgaaccataytaacagttttcctcagttgtttccaaactctgccagttgttcttttgcaggtacttctctttagttgaccttccaaatacttttatcaggcatttaaattccaaccaatttgtagtttttagaaaagtttcttctcccgagtcccttactttccccccgctttccccggtcaccctgcctccttcctgccccctcgccagaagacattggttttcctgctgtcctatgtcactccggagaagagggagcaagaggctgcctttacccatcatttcttttccctgtcactacctgttagta

SEQ ID NO: 151042 - DNA, 601 bp, Human
gactcaagaacacattttgaaaatcaaggactccatcctttccctagtcagtctgcaaaatgcactgtccctctgaactaggcttaaccagcaaccccatctccggtgacggtaattttcctgagtctcgaagttctttctgccctacgtagtttaagtttaagcagcctctgataacgcaggcagatggatctggcaagggaaatcacttaacgacattctgcctgttcgacttaatttatgatgtctgttattagttagttgttatcatggaatttggtttcatttcagaaactgggtsgggggatgtttttgactcggcctcttggagaattctgaaggcaaaagttatctgctagggctgttagtaattctcagatgaggcacacaaggtttagggagagtctgaaggagggaccctggagacgccctctttccagggagcactgtcagcagagcggggttagccaggccacggccatgagccacaggccccagcagcacgtttcctactttgaaaacatcagttttaaaatatgccttctttttgttccagaagtgaatttagtactgattcttgctgatctccatggtacttaac

SEQ ID NO: 151043 - DNA, 601 bp, Human
tttggtttcatttcagaaactgggtcgggggatgtttttgactcggcctcttggagaattctgaaggcaaaagttatctgctagggctgttagtaattctcagatgaggcacacaaggtttagggagagtctgaaggagggaccctggagacgccctctttccagggagcactgtcagcagagcggggttagccaggccacggccatgagccacaggccccagcagcacgtttcctactttgaaaacatcagttttaaaatatgccttctttttgttccagaagtgaatttagtactgatycttgctgatctccatggtacttaacctgatacaatgatcttatgaaaatataatttggattccaaagaaatcaagcgctttccagattcttatctcatctgtcctgagtgcatctccctgcggtagggaggagagcgctgagccgggcctggggcactgcaggagatccaggccctctgcaaggcctcccagcagcagagggccacagccagacacggaacatgcatttaatcatctgtcattttccaggccttattatttcatgcaagagctgaatttggagctcagtatttttactaa

SEQ ID NO: 151044 - DNA, 601 bp, Human
gggagagtctgaaggagggaccctggagacgccctctttccagggagcactgtcagcagagcggggttagccaggccacggccatgagccacaggccccagcagcacgtttcctactttgaaaacatcagttttaaaatatgccttctttttgttccagaagtgaatttagtactgattcttgctgatctccatggtacttaacctgatacaatgatcttatgaaaatataatttggattccaaagaaatcaagcgctttccagattcttatctcatctgtcctgagtgcatctccctgcrgtagggaggagagcgctgagccgggcctggggcactgcaggagatccaggccctctgcaaggcctcccagcagcagagggccacagccagacacggaacatgcatttaatcatctgtcattttccaggccttattatttcatgcaagagctgaatttggagctcagtatttttactaaagacacatctttaaaaattttttccctgtctcttccttattagtctgtgatttataatcattaaactaaaatccatattacaaagaaaatagaaaacatggaactcaaactgtattgtagaa

SEQ ID NO: 151045 - DNA, 601 bp, Human
tatacagatggcttcctcctgcctcactcgggctattggccggcattgctgctgttgcaggttactgtcaatttcagcctccccttccttcatctgcacactcttggggctacagtggatttagctgttgattgtattgtacttgttaggatctggaagctgtcctaagaatgaaatgttttacttcagtgcctggcctgatgaattgtggtggctcaactgcaaaattctgtgtgtggaatgggcacaattactgcagaagggggagagtcttgcgtaaagcacctttccagctgttccrtctttcatcctagctgcatgcgtatccagtgacctaatattcaaagggtgggttcatttattctcagatatgtattggccacccactgtgtgccatccctatgataggcattcagtgcacaagaatgaatgaaggagacagagccccgctcccctggcgagctctgagtgatgggttccgtgtgacgtctgcttccttcttttactcatctttgttttctgtttttctaagtgatgtggctttttgtatatttttttagatgagttttttaagttctctcataaaaccacaaactgaatg

SEQ ID NO: 151046 - DNA, 601 bp, Human
ggatttagctgttgattgtattgtacttgttaggatctggaagctgtcctaagaatgaaatgttttacttcagtgcctggcctgatgaattgtggtggctcaactgcaaaattctgtgtgtggaatgggcacaattactgcagaagggggagagtcttgcgtaaagcacctttccagctgttccatctttcatcctagctgcatgcgtatccagtgacctaatattcaaagggtgggttcatttattctcagatatgtattggccacccactgtgtgccatccctatgataggcattcagygcacaagaatgaatgaaggagacagagccccgctcccctggcgagctctgagtgatgggttccgtgtgacgtctgcttccttcttttactcatctttgttttctgtttttctaagtgatgtggctttttgtatatttttttagatgagttttttaagttctctcataaaaccacaaactgaatgtcatctttgatcatttcagttaccaaatcagaaaaacaaaatcccccaggcagaagtagaaagcctcagttctaagaaaagacagattttttttaagtttggttagaaatgttaca

SEQ ID NO: 151047 - DNA, 601 bp, Human
tgcatgaggtgggagcccatgatagaaacccattaaatatatagaagcaacgaagatactgtgagaacttgcacaaaatatggttagaaagaaaagggaatttttaaactagataaataaaatggtaactctttcaactgagggtagaaattctctgaaagccaagacctccgtcagacgtaacatacgagatagtggctgaatgttttctagttcggaatttaatttttcttaaaaagcagtaacgatttgcactgcttcctcaaaatagttatcacaagtcttttgtacacagaaaagtttttttttttttaattagcaaacctggtttcaaagatgttttgcagcaagaagttaaaaatattcaaatgtgagcattgaggtgcatccccaggacagctcttctctgggctagaaaacacccatttaatcctcccctatggggcctctctttttgggtaaagccagttgatttgctgggagatgggaagatttttaaaataattgtagtgccctttgaaatattctgttgttggattttcttaacaagttcttaaaagcctttaaaaaggaattttaactttgtatatgattctttggc

SEQ ID NO: 151048 - DNA, 601 bp, Human
ctcctgggtctctgggtgtgggcttgtgctcagtggactcccaacaggaatgtttcccagcaggaggctgggccatttcctcctcccttctctcactcccacagccagccccatagcccgcagcacactcttgtgtccctgtagtttgtctgggctactgccctttagcaagaggtgacaggggagagctgagcgtctgcaggctaagcacaggcagagtgagctcctgaagccagtgaggaaaatccaggcttcgttttgggttttcaaatgcattgccttcatttttagagcatatgtrtcttttctttttcatttcacaaatatttgaatgctagctggatgcggagcacagtgcgaggcaggctgaggaggagacccactcctaacagcttctgtaagtcacatgcctaccaccactggcactgggggactcagggtgactgtgcccagccccatctccgccctcccagtccagggatggaaagttcacagaagagtagggtgagcctgcttctggtgatgaaggcagacacacacacgtgtaactccagctgtggctcacttcagaattgaagtgccatggaggacaggcacgaga

SEQ ID NO: 151049 - DNA, 601 bp, Human
atattttcatacggagagtgcagtgatcacacaacctcggagcactcagctcactccggggcagggtggcaggaacccacctggaggacttcccagctgtacctgaaggcaccatggctcacactggctgacctgtcctctcttcctctgttccccccagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacmactgaccgctccccagcggcagaaggcctggtcccctgtggttcactgtgcatcgcccactccagaagtagcatggaaatggagggcatcttcaaccacaaaggtaggaatcagtggggcatgggtggcagacccctactggaagtggccctggagcgctctgtctccgcgcctctcctgcctgttaatgtgcatgagcttccttgtcagctgtgccttcagcacatggtcactgactgtccgggcatttccagtccatcagcacctgaagaggaaatgaggatttcacccacgactcag

SEQ ID NO: 151050 - DNA, 601 bp, Human
tttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttattttattatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgc

SEQ ID NO: 151051 - DNA, 601 bp, Human
ttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttatttatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgct

SEQ ID NO: 151052 - DNA, 601 bp, Human
tgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgctt

SEQ ID NO: 151053 - DNA, 601 bp, Human
gcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggaccca

SEQ ID NO: 151054 - DNA, 601 bp, Human
gctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggacccaggag

SEQ ID NO: 151055 - DNA, 601 bp, Human
aaacttgtcacttttatgtatttattgacagtcttggtcacaggaagtaaacagaaatgtcaagaatgtgtatatttccagtgaggccagttcaaaacatcctctttgccctacgctgccctgcttttttcaccttttccctttcttcccaaccaagagtcgccctacacaatggtccctggggatttagctccagtgtgatcggaaggaaaagtagccaggaaaaagcaaaatagtgttgtcacaaacctgggcaaatgagcgtctctcactctctgccggatgcatttctggagtgccyggcatgaatctttttgactgatagtgttttgagggtgggacaggagttcataccctgtcctggggagggccttccgtcaccctccccactcaggacatctggaaaaccaccccagggcctgtgtcccgcactactgctgcccagagcctttgccattcgaagttgaatctggaaggcccctctcagaccccatggaatttttttttttttttttttttttgctgaaataaggctttaaccaggagtttgagactacagtgagctatgatcaaaccactgcactccagcctggacaacaga

SEQ ID NO: 151056 - DNA, 601 bp, Human
catttctggagtgcctggcatgaatctttttgactgatagtgttttgagggtgggacaggagttcataccctgtcctggggagggccttccgtcaccctccccactcaggacatctggaaaaccaccccagggcctgtgtcccgcactactgctgcccagagcctttgccattcgaagttgaatctggaaggcccctctcagaccccatggaatttttttttttttttttttttttgctgaaataaggctttaaccaggagtttgagactacagtgagctatgatcaaaccactgcactcmagcctggacaacagagtgagacctcatctctaaaaaataaataaataaataaaatgaaatgggctttaagaagagaccttttggtggcaagggaggagtgagtggtgagcttggaggatgcgttcttcctgtcaggaggcctgagatggggcgggcgcaggaggcctcccagggtcttgccagctctgacattctgagttcagagttcttagaaggctttatgagcaaaggccgattcaaaactgccgtttccttacaccaacccatcatgtgatgacaggtggcctttttgcttgtgct

SEQ ID NO: 151057 - DNA, 601 bp, Human
tccttacaccaacccatcatgtgatgacaggtggcctttttgcttgtgctttcaaatatgtctagaagaaaacacccacttataaaaattaacctttaccactctaaaaggcattcacaattttaaagttttttctcctttggatagagaaaaagtatggttcagtacctgcattttatttcgaagaagttcagagtatgagtcatctgcagtgaatgagaaaattaaagggaaaaaaaacatgagaaataaaaccttttgcttgtgggtgacttgagcctctaaacccaggggctttaastcaggatgctacgttttactatggtaaaatctgtgccaaaaacagtcccccatagtttaccacaactccagtgggcactaccaagatcagctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctcctt

SEQ ID NO: 151058 - DNA, 601 bp, Human
gctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctccttgcttctctccaagctctctcccaagggttttcttgtccacccgaatagtttacttttccacttgactgtcttagcaactttttcaaatcygaagtattcagattccctctcccaccatctccccacttgttcacccaagaacatggctaacgcacgtgagggtctctccactgcccaccacagtttttaaaaactggtaaactccacataacaaaatgtatcatcttaaccattcttaagtctacagatcagtggcattaagtaccttcacattgttatgcagccgtcattaccattcacatctagaattcttttttccgtcttacagaactgaacctctgtgcccatggaacaaaaccctccgctctctcctcccagcccctggcactg

SEQ ID NO: 151059 - DNA, 601 bp, Human
agattccgtgttctgacttttgtcagaatttcctttctttttaaggctgaatagcatccccttgtatgcagatgccacattgagttcaacattcatctgctgatgggcacttgggttgcttctgccttttgactcttgtgaataatgctgctatgaacatggatgtacaagtaatctcttcaagtccctcctttcagtccttctgggtgtatacccagaaatgcaattgatggatcatatggtactgttgtctgaatgtttgcgtccttccaaaatccgtatgttgaaatctaaccgccartgtgatggtattaagaggtggactgttgggtggtaattagatcatgagggcagagcccttgagaatgggattactacccttacaaaagaggcccagggagcccttttgtccttccgccatgtgagggcacagaaggcaccgtctttgaggagcaggccctctttaaatactaactctgccagcgcctggatctcagacttcccagcctcgaaaactgtcagcaataaatttctgtgctttataagttatccagtttaaggtattttattatagcagcaggaatggactaagacatatggt

SEQ ID NO: 151060 - DNA, 601 bp, Human
acctttcgtctcatagacgcacatgtacacacacatgtgcacacacacgcacacctatacaccttctcttggagctgtacatcaggtaacataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactcmaaggaacgctgaagacccacaaggaactgtccaggaactcactgaaagcaccttaaacagattgtaacaggaatgatgattgcagatacactgttgaacttaaaaatgggatagaggaactgcagacaacacaggtgttttaaaccgtaggctcggtagagaaagcagcgagtctccgcagatggccggcactgagagccagcaagaagcggaggagatgggccttcagcagggggttgcggggggagctttaaactgagccctgtaaacatggcagaactgctcagtgggagactctca

SEQ ID NO: 151061 - DNA, 601 bp, Human
cataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactccaaggaacgctgaagacccacaaggaactgtccaggaactcactgaaagcaccttaaacagattgtaacaggaatgatgattgcagatayactgttgaacttaaaaatgggatagaggaactgcagacaacacaggtgttttaaaccgtaggctcggtagagaaagcagcgagtctccgcagatggccggcactgagagccagcaagaagcggaggagatgggccttcagcagggggttgcggggggagctttaaactgagccctgtaaacatggcagaactgctcagtgggagactctcagcacagacggtcatggggaagtgagtgcagttcatttgtaatcttgttgtcgagttctgggttttttttgtttgtttcgtaactttaaa

SEQ ID NO: 151062 - DNA, 601 bp, Human
tacgccggtgctgtttccctgctcagaatacaaccagttaccagaaacgacctcacccctccaaccactttccaaggtgccaggacagagaagcccttcactggcccacccagggcagttgacagagggatgccctccttggaggggagcctcacctctacccacagggccgcggccttgtcctggattctcaccggggcagtcacgtcaggatggagaggtcccatgtcagccagttctttggtgggggtcatgtagtctgaaatgacctgccgatggtccaggctgagccagggaagcygagcctgggtgcctttttggtgcctactctgacttgagttggattcatgccacagacccaccttcttgagcaacaacacatatagccaccaacacaagagccagccacacactgagcagagaaagtccctgtcgcctcaccacccaaaaactccagctttgcagagaccaaggttcttctctacctttgcagaagcctctgtgaccaaacccggagcttgcccttctgaggcctctagcatttctccaggtgtttttcagaggacttggtttaaatttgttcaccccaaatgtggtcttt

SEQ ID NO: 151063 - DNA, 601 bp, Human
ggcttcctctggggcctctgtccttggcttgcagatggccaccctcttgctgattctccgtatagctgtctatctccctatttccttttctgtaagaacaccagtcaggttggatcagcacccaccctaagagcctcattttaatttaatcacctccttaaaagaccttgtttccaaatacagtcacattctgagatactggggatttgaacttcaacatggattttagggggacacacttcagcccatagcaagggggccattggagccttaagaaattaacagtagtaacagagagcayggggtgcggacttgccattgccagccacagtgctgttctctatgttccaccctcaagataccctcatgacaacgtagacatacaccattatcatccccattttagggtaggaaaagggaagcacagaaaaatcacgtaaccaaacatagcaggggacgtaaagtgagatttcaaagcagcagtcagacttaagatagccactgtacatactgctgtctgtgcacgttggaagaaacctttggtgcagggaggaagctgaagcccgtagagacaaactcagttgcccaaggccagacattg

SEQ ID NO: 151064 - DNA, 601 bp, Human
gtgctaggtatgctcattgctgtgtgttgccatggcttcaggccctcttagcagatgtgtgtgtaccaacccatgcatacataaacatctgtattttctgtttcccctcctccatcctcccctgcccccatctccgtctcttcttgtattcatctgttttcacactgctgagactaggcaatttacaaaagaaagaggtttattggacttacagttccatgtgactggggaggcgtcacaatcttgatggaaggcaaggaggaacaagtcacatcttacatggatggcagcaggcaaagcragagagagcttgtgtaggggaactcctctttgtaaaaccgtcaggtcttatgagacttattcactgtcacaagtacagcacgggaaaaacttgcccccatgattcaattacttcccaccaggtccctcccacaacacgtgggaattcaagatgagatttgggtggggacacagccaaaccgtatcattccacccctggtccctcccaaatctcatgtcatcacctttcaaaagcaatcatactttccaaacagtcccccaaagtcttatttcagcaataactcaaaagtccacagtcaaa

SEQ ID NO: 151065 - DNA, 601 bp, Human
attgtttgcagcttttccaggctcacggtgcaagctgtgtcagtgggtctgccattctgcgggtctggagggtggtggccctcttctcacagctccactaggctcctgtatgtgtgtgtatgactttacatcatactgaagtgtctgcaatctatcaacaaaggctttattctaaccttcttcctttcctcatttgtaacctctttctttgatagtaagacacttggatttcattctctggaatgtgattatttgttccatcctattctaaaagttctttttttccctctcctgtttggawattgaattttttactaattatgactgtgagactcagctccacccattctcactatagtagtttcagaattgctaacccatactcatggaagaaacttacagattttttttcctttggttttacagtatacaatcaaaaagctgtttttcaaagttaggttagttgttttcttccccacccacctcggggtgatgttgttcagctgggttcattggtttctgcgtatttatattccatttggagtatagtacccctcacacactcatgccctgatgagctgtgcctggggcagctgtaaca

SEQ ID NO: 151066 - DNA, 601 bp, Human
ccaagtcacccacctgttttcacctccttctccttcccaccctcacggccatggttttgaaccagggtttcttcccacggtctgttgaggtcactaacccctgtgtcgtcttctcctgaaccgagtctgttcagattctcagaccagatccctggccatgccaccatggtagaaataggccttggcgtcaaaacttatttccagggaaattttgccagtgatttggacttccttcctttccttttgcctcgcctcctctcccatcggtcatttactcacctccgcatttccgctggttccrcgtttctgtctagtggctcaggttgtcgcccttcagggcatgcctttaattgagataatttctctttacttactgtataaaatgccctgtcccatctgacacgctctgcagtctctcacctacatgactggaaggagggaggggacccagaaggcgtcttccttcctcactccctcatctgtgcgatgctacacctctgacagatgtgaacttgagggtttttttttgtttttgtttgtttgtttgagatggagtctgtcacctaggctagagtgcaatggcacaatctcagctcactgc

SEQ ID NO: 151067 - DNA, 601 bp, Human
gtcgcccttcagggcatgcctttaattgagataatttctctttacttactgtataaaatgccctgtcccatctgacacgctctgcagtctctcacctacatgactggaaggagggaggggacccagaaggcgtcttccttcctcactccctcatctgtgcgatgctacacctctgacagatgtgaacttgagggtttttttttgtttttgtttgtttgtttgagatggagtctgtcacctaggctagagtgcaatggcacaatctcagctcactgcatcctccacctcctgggttcaagcrattctcctgcctcagcctcctgagtagctgggattataagcatgtgccgtcatgcctagctaatttttgtatttttaatagagatggggtttcaccatgttggccaggctagtctcgaactcctgacctcatgatccacctgcctcagcctcccaaagtgttgggattacaggcatgagccaccgcgcctggcccaaacttgagatttgaagtgatcagtccctagggaaatttcccatacatctttagccaaaattattgtactcatttttaagcttaatcctcttttctttcatagag

SEQ ID NO: 151068 - DNA, 601 bp, Human
ataacggttgtagtaactgaaaccttagaatgtcaattaacttgatttcctttaggtcataatttttagtgctttttgctaacaaaagaggaggttatttatttggcaataaagttgtcttctcttacataaaatgtgctctgtgcagaactctgcctctcgctgggtcctggcataagtacaccatctggatctatcacgggaccgtttaaagggaaaaacaaccttacgctttgcttttggtgttttaagaagaatatgaagcctaacgtgggcccataaatgccagactcccctctgyagcagttggtgagagagccgttggagcgcctgagacagttttctctgggtgccctggatatagcatcttgatttttatagtagttaattgtcttaaactcagaaagaaactagaagtctgtgctgttttcacgttctttttcctttgaggattttaaaattttattatgcaacaaatgtggaggtggggacaaaaccaaaattttaacttttttttaactgaggaagtaaaaaaaggcaacattcttcttagcaaagccataaaaaacagcacaaataaaattgtttatactgtcaagtt

SEQ ID NO: 151069 - DNA, 601 bp, Human
gctaagcgattgttaagaaaataagagaaggtaaggtcaagaagaactgtaaatcttcttttatgacgtttccaatgggagagcctagttctacggataagagagtggaactattgggttggttatcattctgaaatcagtattcccttttataggacagatggaatctattccagtgctatacgtattcccctgactcaagctcaggaaaaacataatctggtgactctccttaacactgaacagactcttacacaaagtgaactgtgtgctttataattcttgaattctcttgaagtctttttttttttttctttctgtttgggttaggaatatggattctcaccactgcaatttttgtttttataaattaaagggaaacattccaaagactaaatataggataaagaaatttctttgctgaagaaatacataatatgaacctattctgaaagtatccaagtggatgaacagtactgcctcaaattaaagctgtcagtacatggaatattcagtttcacatgaataaacaaaaaccacagaagtacttgtcacaatgttggattgtttcgactgtgaagactgattgtgtcacacaagt

SEQ ID NO: 151070 - DNA, 601 bp, Human
tttaagcaaactgcattttaaaaataattttgttcccttgcttccatgttaaacacgaaaaaagagtgttacacattgaatttgtatatatttttagccaagaagcaaagaaacttgaagttatttggtattatagccttttttagagtgaatataaaatcttgaaatattagaatgtttttgaagttaatattaaaattagactgaaacctcccccaaaaagtgcccaagaaacccacaggtcccaggttaggagccttcaggcaaagtggcttttcctagttttggaattcttttcttrtttctagacaaggagcaggcaccctcctcgtttaactgtaatctgtctttggtatgtgctctttctaagtatatctcttcactagattttgggggaacacaaatttatagtttttcattctgaaaaatttcctccaggtgctcaaagttggcctcagggacacgtgagcaagtccataaacagagtgagtcggcctgggagctgggtaacaagccatggaattcatccatggagtcttcctcatttcctcttcctgtctccaaggagtggcagtgggggctgggcagccataaagatgct

SEQ ID NO: 151071 - DNA, 601 bp, Human
tgatccacactagcccatttttactgttatccacgatcagtaattggactctttcttcatttattttatttctgaggtgttttacactttcactttggcaatatgtgagatcctgtgcatctgattaaccaagcaaaggatcttaccatctgttttcatttacatttaatttcttcacgtttctttattggaaatttcagtggtgaaaataaaaagaaagacctttaaaatgaaatggtttcctgaccagaaatgctgatagattagcattccccttccaagaatcagcttgagaggaaaratgatgctcaaagtcttgcatttgtctacatagctacattttccaatgcttatgtaatgttttcagtgttttcagaaacgacgctgagaataagagtgtaagagccagtgtgtacatgtgacttccgttggcttgttctgtttggtgagatcgacgcggccggcctcatatctctaggactcctcactcttgagtggtgatgaggccattctcttttcatgacatgactcatgaagactagcccaaaatggggagactgcagtgtgttctcattttcataattcacaaagaagagcagtt

SEQ ID NO: 151072 - DNA, 601 bp, Human
tttactgttatccacgatcagtaattggactctttcttcatttattttatttctgaggtgttttacactttcactttggcaatatgtgagatcctgtgcatctgattaaccaagcaaaggatcttaccatctgttttcatttacatttaatttcttcacgtttctttattggaaatttcagtggtgaaaataaaaagaaagacctttaaaatgaaatggtttcctgaccagaaatgctgatagattagcattccccttccaagaatcagcttgagaggaaaaatgatgctcaaagtcttgyatttgtctacatagctacattttccaatgcttatgtaatgttttcagtgttttcagaaacgacgctgagaataagagtgtaagagccagtgtgtacatgtgacttccgttggcttgttctgtttggtgagatcgacgcggccggcctcatatctctaggactcctcactcttgagtggtgatgaggccattctcttttcatgacatgactcatgaagactagcccaaaatggggagactgcagtgtgttctcattttcataattcacaaagaagagcagttgtttttcactgggttggtt

SEQ ID NO: 151073 - DNA, 601 bp, Human
ataagctagctaaaatcctttgggggagacagcgtggagaatttgcaatgcaagacagatgttcaccggaactctcctgctgttgagcagggcatccgtgggtggccctgtctcatcggaaacgccctggctgtcaatcggcagcagacccacatgtgtgcatgtttggctgacgttatgtggcatgagggctgccagtcacagcagaggcttggtgaccttgtggggtttgtgaccctggctgtccaaggaggcccggccttcacagccccagctcttcttcccactctgggcctggggygcttgtccttagattcgtcgtctcgccgctctgcttcatcctgctttcttcctcagccttctgcagctttttcctacacatcagtgtgagtattccctcatactgtgttaggctataagtttccaaagacttttttcataccttttccccccagcagcctggtaaaggctagaggaatcactgtcattttacacatcaagaaactgaagcaaaaagggggtcattgactcataagaacccacacccagcaggtggcaggggtgttagtggaaccccggcccggtggccttgagtgtccac

SEQ ID NO: 151074 - DNA, 601 bp, Human
ttctgtgctatcatggagtcctttatgcctcagccatcctacatttataaacacttaacagtttatgaagtttgtttgttcccattatttcatttaatcctattacaaccctgtgagatgtggaaactcacatgccagaatgtttgctgtgtagtgggagtgccaggttcactcaggccctttgacaagtccagcattctttctgacatcccttatggatcatccatctgggccttggatcagcgggtttccccaggctggaaagggggaagcacattcccaaaccaggcttagtgggaaytgaaggcattcttgctgatgagaaagttagcgatggggtgaaaaagcaggactgagagttagttgacttttttttcttccaaggtgataggagttgagggaaaggcaagagatgagtaactatttctttgcataatagatgcatctttttttttttgagacagggtctcactcacccagactggagtgcggtggcacaattctggctcactgcaacctctgcctcctgggttcaagcgactctcctgcctcagcttcccgagtagctgggactacaggcatgcgacacgatgccaactaa

SEQ ID NO: 151075 - DNA, 601 bp, Human
atgcataggctgagaaataatagcttgcagctggtttgttggctcacctgtttgtcatttattcagtgtatactcattaagctccaggtgtatgccacgctgcctgctggcagctgggtatgtagttagaaacaaccagacatggtgccctggagtctaaggtcatggttggcttcctgccttcacagttgcccagctaggaaaatgttgtgtccgaaattgttgggttcttggtctcactgacttcaagaatgaagccgtggatcttcgtggtgttacagtttttaaagatggtgtgtcyggaggttgttccttctgatgttcagacgtgtttggagtttcttccttttggtgggttcgtgggctcactggcttcaggagtgaagctgcagaccttcgcggtgagtgttacagcgcttaaggtggcacgtctggagttgtttgtatctcttgtccagagttgttcattcgtcccggtgggttcgtggtctcgctggcctcaggagtgaagctgcagaccttcgcggtgagtgttatagctcataaaggcagtgcggacccaaagagtgagtagcagcaagatttattgcaaagataaagc

SEQ ID NO: 151076 - DNA, 601 bp, Human
gtggcacgtctggagttgtttgtatctcttgtccagagttgttcattcgtcccggtgggttcgtggtctcgctggcctcaggagtgaagctgcagaccttcgcggtgagtgttatagctcataaaggcagtgcggacccaaagagtgagtagcagcaagatttattgcaaagataaagcttccacagtgtggaaggggacccaaatgggttgccgctgctggcttgggcagcctgcttttattcccttatctgaccccacccacatcctgctgattggtccattttgcagagagccgattsgccgattttacagagagctgattggtccattttgacagggtgctgattggtgcgtttacaatccctgagctagacacagagtgctgattggtgtatttacaatcctctagctagacgtaaaagttctccaagtccccactagattaactagacacagagcagcgattggtgcatttacaaaccttaagctagacacagggtgctgattggtgcatttacaaaccttgagctagacacagagtggattggtgtatttacaatcctttagctagacataaaagttctccaaggccccactag

SEQ ID NO: 151077 - DNA, 601 bp, Human
ataaatgttctccaactccccaccagattagctagatacagagtgctgattggtgcatccatgaaccctgagctagacacagagtgctgattggtacatttacaatcctccagctagacataaaagttctccaagtccccacccgactcaggagcccagctggctttgcctagtggatcctgcaccagggccacaggcggagctgcccgccagtcccgcactgcacacctgcactcctcagcccttgggcagtcgatgggaccgggcgctgcggaggctcaggctgcgtgggagcccaccrcagtggggcttgggcatggtgggctgcaggtcccaagccctgccccgcggggaggtggctgaggcctggcgagaattcaagcgcggtgcgggcgggctggctggcagtgctgggggacccggcacaccctctgcagctgctggcccaggtgctaagcccctcgctgcctggggccagtggcgctggctggccactcggagtgcagggcccgctgagcacacgcccacctggaactcttgcaggcgctagcctgcgagcaccgcacacagccccagttcccgcctgcacctctcccaccac

SEQ ID NO: 151078 - DNA, 601 bp, Human
taaatattccggcaaaatgaaagaatgtcacttccgtcattcaataagtaggaactcagggcaagaactgctgcttctcatcaatggcagttgtcacccagtcctttgcatttaatctgtggcaccgatgagctcccaccttgggcagccctgacctccccccccccccgccccgccccccggtactaggagtgaccatttaggccatagccacatttttaatgcttaacctgccaggtaagcaggaaatctctttcgaaccagcttcccaaagtgcaaagaaccaaatcccttgcagctsagcccacagagagaagctggggaatgacgtatttaatttccttttcttcttgaaccatttttacaacaactagctcctttcccaggcaaggctaagtgtcctgggaatcatccttgtaacgccagctgggtgccacaaagcattattaattgactgtggttccttctctcatgcgtgcagaggccgctggatctgctgaacagtagggaggtctgtgtgcttcagggctgccctgcgtccctgcctgccctgcatgcccttttccgagagcacgcctgcttctctgtagccctgcaagtc

SEQ ID NO: 151079 - DNA, 601 bp, Human
ggaactcagggcaagaactgctgcttctcatcaatggcagttgtcacccagtcctttgcatttaatctgtggcaccgatgagctcccaccttgggcagccctgacctccccccccccccgccccgccccccggtactaggagtgaccatttaggccatagccacatttttaatgcttaacctgccaggtaagcaggaaatctctttcgaaccagcttcccaaagtgcaaagaaccaaatcccttgcagctgagcccacagagagaagctggggaatgacgtatttaatttccttttcttcytgaaccatttttacaacaactagctcctttcccaggcaaggctaagtgtcctgggaatcatccttgtaacgccagctgggtgccacaaagcattattaattgactgtggttccttctctcatgcgtgcagaggccgctggatctgctgaacagtagggaggtctgtgtgcttcagggctgccctgcgtccctgcctgccctgcatgcccttttccgagagcacgcctgcttctctgtagccctgcaagtctgggtggacagagggaccaggtcagaatacttggtaggtgtcacttaggc

SEQ ID NO: 151080 - DNA, 601 bp, Human
cctgcttctctgtagccctgcaagtctgggtggacagagggaccaggtcagaatacttggtaggtgtcacttaggcttcataccactcctatgccaactccccccaagttctaacttacaggcccaaaaatgtctgtgaggttgatttattggctgaggtcctactagttgtgatgtgtaagtgttctgcttatgaatgttaagacctgtacttgatttcattttactaaaataagtgggcctgggtcttttttttttttttttcctccatcagtttatccaaggcacagcagagctccgkggtgacacctcaccacatctcaggcatccgggctgtctcccgacctccccacgggccacactcatagttccttgtcttgtgcagttgtgaatctatgtcaaacaaaagactgtccttaaaatatgagctgtgggtcagcttgctgtttctttagactgttgatttctgatgtttccatgtaatacttgtgtgcctactgtatgccaggcactgtgcagagccctggaagtacctcaggtcccagacagatgaggcccctgccttcctggagcttttatccattctcctgacccagtgcct

SEQ ID NO: 151081 - DNA, 601 bp, Human
cttatgaatgttaagacctgtacttgatttcattttactaaaataagtgggcctgggtcttttttttttttttttcctccatcagtttatccaaggcacagcagagctccgtggtgacacctcaccacatctcaggcatccgggctgtctcccgacctccccacgggccacactcatagttccttgtcttgtgcagttgtgaatctatgtcaaacaaaagactgtccttaaaatatgagctgtgggtcagcttgctgtttctttagactgttgatttctgatgtttccatgtaatacttgygtgcctactgtatgccaggcactgtgcagagccctggaagtacctcaggtcccagacagatgaggcccctgccttcctggagcttttatccattctcctgacccagtgcctaggttacctgtgcccacctccctcaaaggccagcttcagtgccatctccttcagggacccttccatggttcctcctcctgttgccccttctcaaccctaacagggtttgtacctcgcctatagtacaggataattttgtgatccaaataccactgtgtgctgagtcacatggatgaagaaactaggtgt

SEQ ID NO: 151082 - DNA, 601 bp, Human
gccacctgctccacctgctgtgagcagtgcagggttctgctagcagttggtactttaaaaaatattcgttgaataaattgtcatctgacatatagattatccaaacctgccccttctctttgtccttcctgaggctaggaactgtgtctacctcatttgcattttatcttaaatcagcacctgagaaagtccctgggaatggatttcattcttttcctacctccttccagaccacaccgaaggaaagtgagactgatagggaaatgttttagtaactcttgtttaaaaatagagtaaatayatgagaaaatatatatacatataagtacacaaacataatatagacacacatacagaggggaaagggttatcattctttaacagatatcaatgggttctgaaccagagtttgcctctgagaaaaatctggattttgaagaatgaatgatcctgcctaaaacgcatcatctgtttctggaatcttcactaatctgtgtcttgggcgaaggaaggaacgggacagcagtgagacgggcgtgtgctgtctagtcccagcgtcggaagcacttggtgggaaaccgctgccaactctgctcctgta

SEQ ID NO: 151083 - DNA, 601 bp, Human
agctggaccaaaggaactaaatcaacatgagggttgtagctcaaatttttgagcctttttaaaaattggcttctcaaagatgagctgtgttcagagcctaacagatcacattggcagtccctttatatgacacatgacacattcagtggccattctgtcatccaagttgacaagcaaagctattgggtagcaggaagagaggaaaagttaccatcgaggtcgagaatagctttgttcctgatttctgccatcccagtctctgtccccaccttgcttctccaagtaacccttggtccacgtytgtgaactggcctggaatataatgagcaaatcttgactggatttcagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggtaaagggggatgagggctggggaatccatgcctgccgtgcaggggcagggcacgctcggtagctgcttcacaccagcctca

SEQ ID NO: 151084 - DNA, 601 bp, Human
ctagaatccctgagagaacaatcagagatatcccatgcaggtctgtctgaaggcatcactaaatgaagagttggccatctcccctctgtgaggtttttgcatgcaggtttctggtttgagatgaggttacatcactgtccagttactttttccaacatgccagacattagtttgtaggatccctacgctagagtgcaggcatagttgtcaaagtgtaggaatcagttgaaagctctttgggtctacgcaggagcttcaagccatgaaagtcatttgttttcttgagttcttacgtagtctwaaattattttgtcagcccaattgtagagccctaaaaaataaaatagcagaaaggaaacctgctcagtgtggcttgcacatcctctagcattctggccctattgtgcccctcaaaatcatgctatgaagtcattactggtgatgctttttttttttttttggcagtaactaaattttctgagtaaaacagataactttatcaacatcttcccccatgcttccctttttccttccctgacttccttgtcagtacttgcacagtcacttgccagattaatcaccctctattttacgacatggg

SEQ ID NO: 151085 - DNA, 601 bp, Human
atccttctgtttgctagttactatgttacctcgttgagtattatcagtagcagttcttcatttacaaaaatctgtagtgattttcccacacagtatataatctcgtgactaattttttgttttgttctgttttctctttttgtaaactttcactgcagcattatgttgatttgtgttctgtgtctgttttggctcaatttccttacctttccgtttgaatttttttctttgttttcttcaccccatattccaaatgtcattagaccaaaccaacatttgttttgcaaagtgcatattttgwcccacacgtgtaaaagccttgttgtgagtgtatgagcctgtatctgtctgctgtgagacacgcatggccaggacagcccgctgtgggtcgcatgcctcgccgctgtccttaatatgaagcaaggttcatattacgccccttctagttcccagttaattaacggctcaagtaatctgcaaacacgtcgtgtttgctaattactgaaactcgaacttagtagcccctcccccagatttcctgtcaacccctttacgccctcgattctagccataagtggcatctgatagcttgtgaggcctc

SEQ ID NO: 151086 - DNA, 601 bp, Human
acttgtttcccatatttctctgaacatccattacatgtttgtgattatatttgtcaggtgaattttcaacactggaattgctaaatcagagtatacttctttaaagttagaagtttctcttcctgcatttgggcattaactaggtaccagatatatcattcccatttcttccttcatccacagacaacctctaatgaaactggttgactgagtcaaatgggaattatataaagaaaaatttggactgacgtgtcaccctgccatagctagaaatttctccccaggtaatcgtgtggtgttscggagaagacccagtgaactttgaacaggaagcttgctagggtgtggtagataactcacgaattcggactccactggttaagattttggaatcaggcctggtgtggtggttcatgcctgtaatcctagcactttaggaggccaaggcaggcatattgcttgagcccaggagttcgagaccagcctgggaaacacgagaccgcatctctacaaaaaaatacaaaaatcagctgggtgtggtagcatgcaccggtagtcccagctatcgggaggctgaggtgggaggatcacctgagcccag

SEQ ID NO: 151087 - DNA, 601 bp, Human
tactgttaagaggagaaaatagaacaagtgttagagattttagtttattaataccaaatgttttaagtgaggtattgtttttgcattttgtattgtgctgttcaaacctagaataaattcatcacatttttttccagttcaatcatatctatatatccagtttgttgctttgggaatgttaaaagaactataaatcttatgtgttctgtgaatccaggtaaaacaacgagattaatatttaccaaattgaaagcaatcagtcaccagtcattgtcacattaatccaaggagagaagtcacsaatattcaacttacagatttgctgaacacttgcaaagatttgcatgaggttctactggggatacagcaatgaaaacaatcacctatagaaaccaaaagccagtgggggaaagaatgtattgcagaagtaattaagacaagcacgattactattttgtatagagggatagaatggaagttgctagatggagattaattttaccagagtgatttgtatgcattgaagtatgagtcaaagctctagtaggataatcaggaaacaaaccaagtttgttggattgctgatgttgctacatagtcc

SEQ ID NO: 151088 - DNA, 601 bp, Human
agttttagccaatcatgggctgtgggcagtaagtgttgttgattatgtcaatttcttccaggcactggaggatcgccccagctcactccttgttgaccagggagatagtagcagcccttccttcaacccttcggataattcccttctctcttcctcctcgcccattgatgagatggaagaaaggaaatccagctctttaaagagaagacagtaagacagaaatgttttcattcttattgttctctgggttccgtcctgtctttgttgccttcaaaaatgtgactgagattcagctctgaawtaccgagatgagaagctccagggcctctcattaagtaactgcacgtatgtaaaagactcaggacctaataagggcacagtattccatagctgcagtttcttgttttatttgtatatgatacttcataagtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcag

SEQ ID NO: 151089 - DNA, 601 bp, Human
agactcaggacctaataagggcacagtattccatagctgcagtttcttgttttatttgtatatgatacttcataagtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcagcatatggtgaaaagagtcctgaaaaatgttacaaaaggtttaaacttgcctttkgagaaggaaaaaaaaaaaacgtaagctacgaaacggcagagactgggtgttttattcagcactgtatcccagcacctccgatggtgttgggcacatgagaggtgccaggttgatgttggttgaatgaatgactgaacaacacatggatgaaccttttcaggccaattgaggttgtttgctatactgatcaaatggttgtcttctgttatctgagtggccttaaacggttactgaatgtaacaaacagaaatacttgtgagtgatgtgattagacacaaggtttaaacatctgatttaaaa

SEQ ID NO: 151090 - DNA, 601 bp, Human
gcacagtattccatagctgcagtttcttgttttatttgtatatgatacttcataagtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcagcatatggtgaaaagagtcctgaaaaatgttacaaaaggtttaaacttgcctttggagaaggaaaaaaaaaaaaygtaagctacgaaacggcagagactgggtgttttattcagcactgtatcccagcacctccgatggtgttgggcacatgagaggtgccaggttgatgttggttgaatgaatgactgaacaacacatggatgaaccttttcaggccaattgaggttgtttgctatactgatcaaatggttgtcttctgttatctgagtggccttaaacggttactgaatgtaacaaacagaaatacttgtgagtgatgtgattagacacaaggtttaaacatctgatttaaaagtttttcttgtatagccagt

SEQ ID NO: 151091 - DNA, 601 bp, Human
gtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcagcatatggtgaaaagagtcctgaaaaatgttacaaaaggtttaaacttgcctttggagaaggaaaaaaaaaaaacgtaagctacgaaacggcagagactgggtgttttattcagcactgtatcccagcayctccgatggtgttgggcacatgagaggtgccaggttgatgttggttgaatgaatgactgaacaacacatggatgaaccttttcaggccaattgaggttgtttgctatactgatcaaatggttgtcttctgttatctgagtggccttaaacggttactgaatgtaacaaacagaaatacttgtgagtgatgtgattagacacaaggtttaaacatctgatttaaaagtttttcttgtatagccagtgaaggttaaaatgacttaatcattttttaaaagccacttcctttactatcatggc

SEQ ID NO: 151092 - DNA, 601 bp, Human
atgtgcgggaccttggctatgtggttgaggtgtgtattgccagaaatttagtatcttcgtatcagttccaagagttgtcaaaagtagtatcgttttagacagttgaacacctctcaaaagctttaaaaacatttttgacccaaaataaaaagtgaccaacgatgtatttccgaaaaattaagtttagccaattgtctttaccatctgtattcagttgtaaatgcttctttttcgcatagtgtatcttgacataatcttttttaacagttgaaatttacaattattataaataatttgatattattattaaatgatactaagtaagtatactgtagttagtagacaggaatcttgccttaattgtatcactacagaaatgaagaccttactggttgaaaaagtcagtgtggcccagctgtgggttcggttccatcctgaatccacccaggttcagagcctgtactgtggctgcaccaggtcatttacttgatagttttgtacagaacacattgccatttccattgaccagaagttgccaagcactgtagccatagcaaaccactgccttttgtactggatcgagagccatctctaggctaat

SEQ ID NO: 151093 - DNA, 601 bp, Human
agaactggttacaagacagtgcatgtgtccattttgccctctgtgactattaatcaataagccactagttgattcagacatattccatgaaatacacttatcataactgtttaattgtagggctacatggcacttatgaaagaagatggtgttcctgatgacatgaaaggaaaagacaaaattgtgttcggcaacatccatcagatttacgactggcacagagagtacgtaaacatgcattgtgcccgatggtgtgcaaagcagccacacttgctaaaccaaggcaggccaggccaaaggraatttattctgttcatcgtattacctgtgtagcctcctggagggagctggtgcaaaggagatattgatgtacccaggagttctgcagtagcatttggtggcacggagagagtcttgtctcttcttcgtgctggtccatgtcgagagtctgtggaagggagtagctggaagcaccagcgtggagccagctgccggagctgctggcctggtcctgaccccgagccctcggcctccctgctgtacacttccattcttcatctgcacacccacattataatgtgggttttttgtgaagagtgac

SEQ ID NO: 151094 - DNA, 601 bp, Human
cacactgtactttgaggatcactgatttatggaaaggctcattgtctacattttttttcttctgcctttaggatttgagattaaagagcttcttctctactaaaaccaaccaggcttactaggactgttggcagggtttggagtgatggcagtaattctttgtttaatattaagaagggtgttgcggccaggtgtggtggctcatgcctgtaatcccaacactttgggcagccaaggcaggagggttgctgaggctagttttgagaccaggctgggtgaaaaagcaggactccatccctamaaaaaaaaaaaaaaaaaaattaaaaattagccgggcatggtgatgcacatctgtaatcctagctactcagaggctgaggtaggaggatcgcttgagcctggaagtttaaggcttccgtgagccatgatcacaccactgccctcctgcctgggcaacagagtgagaccttatctctttaaaaaacaacaacaaaaaaatgttcttttgctacctatggtgtttgttggtatttggtactgtaaagtgaagggtttggtgtgtatggagagtgatgggggaaggactggttttggagccaca

SEQ ID NO: 151095 - DNA, 601 bp, Human
atgggggaaggactggttttggagccacaccgtagaatgctgatctacatcctgaatctggaatttactcccgagagccttagctgtgcagcttggttttaagatgagtgcctttatgaatgtgctgaaatgtgcgggtactcgtgtattctaatcgaatttcccattgttataacccaactgtttgccttttttattcctaggagagaaggttgcacatgtacatagcttattgtcaaaataaaccaaagtctgagcacattgtctcagaatacattgataccttttttgaggtaagacytaagatacaaacagaaagtatttctgaatcttttgttccaacttatttctaaaaatgaaagtatcattggtttcccaggagactaatttccaaagaaaattagcctgagtgataagacttctgaacctttctttctttcctgtaaatcagagaaatgagtatgaatttagtctgtggtcatacccctggcattcagaagactgcagtcattgttaaaaataagagtttttaataagtgttacacttaagtctcattacaaagtcagaataattattatctaaacttgtagcctaaaaata

SEQ ID NO: 151096 - DNA, 601 bp, Human
gctggggcactgagcggctgagtaatttgcttcgagtcccacaagttgttgagggcagagtcaggacacagagtggccatctggctcttggtctgtgcccctcgcagctacactgtcccacacataacatgtacgagggcccagtcctaggaagaggagtttgcgagaacacgagatggcattggccagagacattcacgagggccttgcacacccacacctcctttccccattaaaaaaataagagatggggccaagcatggtggctcaagcctataatcccagcactttgggaggccargttgggcagatcacctgaggtcaggagtttgagaccagcctgaccaacatggagaaaccctgtctctactaaaaatacaaaaaaattagccgggcgtggtggcgcatgcctgtaatcccagctactcaggaggctgaggcaggagaatcacttgaacccaggaggcggagatcgtggtgagctgagatcgcaccattgcactacagcctgggcaacaagagtgaaactctgtctcaaaaaaaaaaaaagagacggttcagtacttccctgcttccgtgacttgagggattgcagagatgc

SEQ ID NO: 151097 - DNA, 601 bp, Human
agatggcattggccagagacattcacgagggccttgcacacccacacctcctttccccattaaaaaaataagagatggggccaagcatggtggctcaagcctataatcccagcactttgggaggccaagttgggcagatcacctgaggtcaggagtttgagaccagcctgaccaacatggagaaaccctgtctctactaaaaatacaaaaaaattagccgggcgtggtggcgcatgcctgtaatcccagctactcaggaggctgaggcaggagaatcacttgaacccaggaggcggagatygtggtgagctgagatcgcaccattgcactacagcctgggcaacaagagtgaaactctgtctcaaaaaaaaaaaaagagacggttcagtacttccctgcttccgtgacttgagggattgcagagatgctgcagaacacagcgggcgtggccacactacccttccattgcctcttaatgtatttgatctctttgcaaatgttggcttcaacactggcttttaatttggtgatcagcaaagaactttgagaattcagtccgaagctatgtgcccatgtcatctgtgtcttctgggttctttgc

SEQ ID NO: 151098 - DNA, 601 bp, Human
gttctcatgtggcagggaacctggaaagggaacttgctgaacaggatttcagacaagtcaagatgccttacagaaatgccctaaaggcctaggaagactccagagctccaaaatggggctttaaaaatgccctctaggctgggcatgatgtctcacacctgtaatcccagcgctttgggaggccgagacgggcagatcacaaggtcaggagttcgaggccagcatggtgaaaccccatctctactaaaaataaaattagctgagcatttaaaattaggtgagctggcacgcacctatagtcccagctacttgggaggctgaggcaggagaatcgcttgaacccaggaggcagtggttgcagtgagccgagatcgtgccattgcactccagcctggatgacagagggagactccgtctcaaaaagcccccacgtatttgcacttctgtccccctggagatctgcaaaggcctccttcctccttgatcacttctgtcaagctgtctgtggtcacagtcaagcagctgtgcccagcccacagcccggctccctcttccccctttagatgagcagcttctgcaaagctctgctgacagcaggagt

SEQ ID NO: 151099 - DNA, 601 bp, Human
ctagcaaaaacagtacaattcactgatggtgcggatgatagcattttttttagcaaataaactgtttttaattaaggtatgtacattttttagacataatactattgcacacataatagactctagtatagtataaacttaacttttatatgcactaagaaaccaaaacttgatgtggctcactttgttgtggtagtctggaaccaagtccccaggacctctaaaaggtatgcctgtctagaagtggatttatgatgagaaattgcctcacatagttagggagactggcaagtccaaatcygcatgtggaccagcaggcttcagaccccggagagcacgtggtgcaggctgagcctgaagacagtctgctagagaacgccctcttgcttgggagaccagactttttgtgttcccttaaggccttcggctcattggatgagggccattcaccttagaaagggcacatgcctttactggacccatcaaaatgttcatcttattcagaaacaccctcacaggaatacccagaataatgtttgaacaaatatctaggcgtcctgtgacccagtcaagttacacataaaatcagttatcacaggca

SEQ ID NO: 151100 - DNA, 601 bp, Human
gtcatttgtggggcttcaaaagacagttgtaagtagcagaccagagtgtctgggatgtcacaggagagtgacctctcggcaccttatgtaaagtcgggggagacaccggagctcctgttgctgggaggaggatgggggcctgcctggtgaaggcctctggctgcccaccatggggcaccagggccccccacgaccagcttctgagttggagcagggtgctttccgtgctcctagtactcaaaacactcatatccagctacccagctgaatctggatctggtctaggttggtctcatgtagaatgtgcatgggaaaagcaggaaaggagatgtgggtgagtcccgggcctgcgcaggccctgtgcctgtctgagaccctaacagcaacccttctgggtgaatgcacgccctcctcaccccatccaggaggagccaggcccagggcggctcagtagcttgtccagagcatctggctaggaggcatctgccatggggcctgcttgctccagtgtgaagagcttgttctttctcctcagctaaaccacaagctccctggggcagaaccaatatcttaggctctttcaaaacgtcctgtagttgcc

SEQ ID NO: 151101 - DNA, 601 bp, Human
ttagaaaggtatactattcagctgggcgtagtggctcacacctgtaatcccagcgctttgggaggccgaggtgggtggatcaccaggtcaggagatcgagaccatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtctcaaaaaaaaaaaaaaaaaaagactattcataccctggaaatgcaaatgggaaaataatccaagtgtgtagttacttctatcacacaaattcagctgcacccctaaaggtcttcagaagaattatcttatgtggactattccaagatgatcttaaccatttccaaattgttctctgagagaagccactttgtttgcaggcatcagtaattttgtgttttgttttaaatctacccttggctccactcctgtctgcctgaggctattcctgcacccacaagctgtctggggtgtgcgccctcatt

SEQ ID NO: 151102 - DNA, 601 bp, Human
gtggactattccaagatgatcttaaccatttccaaattgttctctgagagaagccactttgtttgcaggcatcagtaattttgtgttttgttttaaatctacccttggctccactcctgtctgcctgaggctattcctgcacccacaagctgtctggggtgtgcgccctcattctctccagccctggctgccttgcagagccccagttctcagatgctcaggaaacaaagccttattctcagtccagctctggctcaaggcaggtagctggtcagagtctgggctatgagaggggagtccygaggctggaggcattggccctgcaccctgaggacaggtgcaggcccccaaactgtgtccgagagaatcatccaaagagagccctgtcatcccaccagccagggccgaggcttctgttgatgagaaaagggggccaggtgcagtggctcatgcctgtaatcccagcactttgggaggccgaggcaggtagccatggcttgagcccaggagttagagaccagcaacatggcaaaacaccatctctacaaaaatacaaaaaattagctgggtgtggtggtgtgcgcgtgtggtcccaactact

SEQ ID NO: 151103 - DNA, 601 bp, Human
cacagggttcattactcacaggtgatttacagttggcacttttataataaaatcctctttgtagtgtatttatgattcattaaccatgtaaaaccctgtggacgttaagtaaatactgtggactcttgatctctcacggctgtgaaaggaggcgtggggaggagagagcaacttagcctcgaggtggtgcggccaggtgaacggggaggaccatctgtagcagtgctgtccaatagaagcaaaaagaggccacatatgcaagtttagatttttctagtaaacacattttaaaaataaaagyaaaagcagtttttactaacatgtatttaatttaatgaaatacatccaaagtattagatttcaacatgaaatcaatatttgaaaaatcattagtgaactattttgcattcttccttcacactaagccccagtgtctgtgtgtcctttatgcagccaccacatctccactcgcatgagccgtgtggcaggtgcccggtggccacgcgcagctgctgtgagggacagtgcgtggcgatagccttcttacccaagaagctccacgggaaacaagctcaggcaggtgctgttcttcttgcaggtc

SEQ ID NO: 151104 - DNA, 601 bp, Human
tctctgtcagctgtctgtggctgcataaaaagtcacaccagcacatgctgtcttaggacagtggtgacatgtgccttcttccagtgcagtgggcagatgggaccattattctgttggcctctcctggcctggtcagctggtgcaccatgccccatgcgtgtcagaggcgttgtctgggacactggcctctttccacatcgactttcaccctgggctcccccacgtgagggcagtggcatcccagaacagcaggagcaggagcgtcaaggcctctgaaggcccagcctcagaacgaccaacrtcctccacatcctgtgggccagagccagccccaggcagccctgattcaaggggacgaatagcccccgcctccgagtgacagaagtagcaaaaccgtggcctttaaccacacagtctgcccgccacaggcgcatctctggtcctcacatgtgcagaatgcactcacccacctcaggcccccagcccaggcccccacctgaggtccaaggcctcgtccagatcgcgttgagttgtggccagtccccaggagtgggtcatcaggggcagctccagggtcctcgtgcctgccccacacaccccc

SEQ ID NO: 151105 - DNA, 601 bp, Human
tggtcagctggtgcaccatgccccatgcgtgtcagaggcgttgtctgggacactggcctctttccacatcgactttcaccctgggctcccccacgtgagggcagtggcatcccagaacagcaggagcaggagcgtcaaggcctctgaaggcccagcctcagaacgaccaacgtcctccacatcctgtgggccagagccagccccaggcagccctgattcaaggggacgaatagcccccgcctccgagtgacagaagtagcaaaaccgtggcctttaaccacacagtctgcccgccacaggygcatctctggtcctcacatgtgcagaatgcactcacccacctcaggcccccagcccaggcccccacctgaggtccaaggcctcgtccagatcgcgttgagttgtggccagtccccaggagtgggtcatcaggggcagctccagggtcctcgtgcctgccccacacacccccacaggggcgaggctgaggcagtgaccacagcagacgcacctttcaaacgtgcagggaaaggtggctgacgggaggcgtgagcagccatcccagcttctgctcgtcgtgggaagcagaagggagtcgccc

SEQ ID NO: 151106 - DNA, 601 bp, Human
tctgaagagcttggatctgactctgcaatgatgggaacgagggaatggtttcagaaggccagactctgacccatacagaggttgggtctctccacagttaggagacaggatgttagcacagcctccgagggcctgagacattggtagtttcacaggcacaggtggatactactcccacaaacctctagtgcagaactcagcaaactttggtccacaggccaaatttggcctgcggcctttattttttatttttttagacagagtatcgctgtcacccaagctggagtgcagtggcacaatytcagctcactgtaacctctatctgctgggttcaattgattctcctgcctcagcctcctgagtagctgggattataggtgcccgccaccatgcccagctaatttttatatttttagtagaggcagggtttcaccatgttggccaggctggtctcaaattcctgacttcaaatgatcgacccacctcagcctcccaaagtgctgggattacaggcgtgagccaccacacccggccctgtggcctgtttttatacagcttatgagttaagaatggttttcttttctttctttctttctttttt

SEQ ID NO: 151107 - DNA, 601 bp, Human
gtcctacccagtactccaatcctaactgccatccatccattaattgcttgtttaatgcctattttgccactagactgtaagctccaggagggcaggactgtgtctgccttgatcactgctgaatctcccagtatccagcacactgatgactgaaatcactctgattagtacctgagtgaacatcagacttcattattgacatgatactccctgaacaagtaatatgtgcaaggcacagggccatgtgataaggacacaggggagcaagggacagtagctactctaagataactcactaggrgtagaacacaaagcaggaacgtcagttgtgatagggtaaagcacaggctcacccagtgcttcagggttcaaggaagacttccctgaggagcagcgaagccctagttgagtctcattaaaaagtcaatgtcatggctaggcatggtggctcacgcctgtaaccccaacactttgggaggccaaggcgggcagatcacttgaggtcaggagttcaagaccagcctggaaaacatggtgaaaccctgtctctactaaaaatacaaaaagtagctgggcatggtggcatgtgcctgtaatccca

SEQ ID NO: 151108 - DNA, 601 bp, Human
tgaagtcctacccagtactccaatcctaactgccatccatccattaattgcttgtttaatgcctattttgccactagactgtaagctccaggagggcaggactgtgtctgccttgatcactgctgaatctcccagtatccagcacactgatgactgaaatcactctgattagtacctgagtgaacatcagacttcattattgacatgatactccctgaacaagtaatatgtgcaaggcacagggccatgtgataaggacacaggggagcaagggacagtagctactctaagataactcactaggagtagaacacaaagcaggaacgtcagttgtgatagggtaaagcacaggctcacccagtgcttcagggttcaaggaagacttccctgaggagcagcgaagccctagttgagtctcattaaaaagtcaatgtcatggctaggcatggtggctcacgcctgtaaccccaacactttgggaggccaaggcgggcagatcacttgaggtcaggagttcaagaccagcctggaaaacatggtgaaaccctgtctctactaaaaatacaaaaagtagctgggcatggtggcatgtgcctgtaat

SEQ ID NO: 151109 - DNA, 601 bp, Human
gagtaaaccaagaggtaagtattgataattgagcctatcatcaaatgtcactggctccccgattcctctccaggactgggccaatgagaggaggagcatcactctcctagaatcaggaaagaaccttgaaagagaaagactcacccacgtactcatccatgttgaaggtcttcacatatttaaaggacaggtccccattcttatagtattcaatcagcttcttgtagcagccaagtggggtactccctgcaagagtggccacacccatgaacaccccttgcaccccaagtctggaagcccrgagggttcacaggaataagtcagggctgctcacagggagaacctgtcagatctgaagtcctacccagtactccaatcctaactgccatccatccattaattgcttgtttaatgcctattttgccactagactgtaagctccaggagggcaggactgtgtctgccttgatcactgctgaatctcccagtatccagcacactgatgactgaaatcactctgattagtacctgagtgaacatcagacttcattattgacatgatactccctgaacaagtaatatgtgcaaggcacagggccat

SEQ ID NO: 151110 - DNA, 601 bp, Human
aatcatttgttccagaaagaaatggaatggagttgaggagcaggcagaggagaaggagatactctaatatttattaagtatttgttatgtataagaaacttccacatcttttatcataaaagcattaaatgaatttaatgcttacaacctgtgaggtcagctttattagccccattttatagctgagtaaaccaagaggtaagtattgataattgagcctatcatcaaatgtcactggctccccgattcctctccaggactgggccaatgagaggaggagcatcactctcctagaatcagsaaagaaccttgaaagagaaagactcacccacgtactcatccatgttgaaggtcttcacatatttaaaggacaggtccccattcttatagtattcaatcagcttcttgtagcagccaagtggggtactccctgcaagagtggccacacccatgaacaccccttgcaccccaagtctggaagcccagagggttcacaggaataagtcagggctgctcacagggagaacctgtcagatctgaagtcctacccagtactccaatcctaactgccatccatccattaattgcttgtttaatgcct

SEQ ID NO: 151111 - DNA, 601 bp, Human
aagaatggacaatctctccttccctaactagggtctgaagaaaaatcattgaaagctgtgtcacctttctcatttgcagccctgggcaggtacaccttaaacatgtgatctgtccccctccctaccatttctttctctttgccatactgtctcagaggagaccctccccatcatgtctatctgaggcacacacagacattgttaacttgctatcaccctcaaaaagctgaggaggaaacactccaaacagcttctgcctccccagattgtcagaaaagtggaccttctctgtctcttctgyctgtagttagagggtcctgctgctgggatagaggtgcagtgaacaaaacacccagagaacctggacaggggctgccaaggttctaaaatctcagaggatgagaggtcctgcccccctcctccccaccttgaagtatagaagagtgatctctagagcaataaaaggcagttcaatgttacccctcatgggtaactccagaggtggcgatagatggacacacagaagggcagcccagaggacccgagcacaaatccaagaagcacacacttgctcccacctgtgaaccttgagtgagtcacc

SEQ ID NO: 151112 - DNA, 601 bp, Human
ctgtgataaggatcatcacctggggatcagaaaacaagtctgtgatggaggggagcattccagacaccctaaacagttgtaaggatgattgtttttcatatcacattgtaagtggttaccatgcaacatacttttgctcagtgctccctgtgctttatcacacaaataacccgaggcaggcagcatcattatctccatcttataagaaaacagagccccggggggttaaataacttgcccagggtcatttatgaccccaaagttcatgttcttgactaccacgtgacagtgcctccaggtrtctttgatgatgactatgaaggtgccctgtaaacagacatgccatgcccaggcctgctatcccatcagctgggtgactctacacaagcacagtttgtgaaagagggctcccaacctgcaccaccagcaagggcactttgcaagcaatggtgggagttatctgtggggcctctaaggctgaatcccagaaaggttgccccattatctggtcactttcagttcacagcattaaacctatgaactaatgtgacttggggtgatggtttttgttaatatataataaaacaaaggcacagtctcc

SEQ ID NO: 151113 - DNA, 601 bp, Human
gctgctggaaggcagacacggtccacatgtggttcactccctcctcgatggccttgtacagagcaaatgccttgtgagcacctgtgataaggatcatcacctggggatcagaaaacaagtctgtgatggaggggagcattccagacaccctaaacagttgtaaggatgattgtttttcatatcacattgtaagtggttaccatgcaacatacttttgctcagtgctccctgtgctttatcacacaaataacccgaggcaggcagcatcattatctccatcttataagaaaacagagccccrgggggttaaataacttgcccagggtcatttatgaccccaaagttcatgttcttgactaccacgtgacagtgcctccaggtatctttgatgatgactatgaaggtgccctgtaaacagacatgccatgcccaggcctgctatcccatcagctgggtgactctacacaagcacagtttgtgaaagagggctcccaacctgcaccaccagcaagggcactttgcaagcaatggtgggagttatctgtggggcctctaaggctgaatcccagaaaggttgccccattatctggtcactttcagt

SEQ ID NO: 151114 - DNA, 601 bp, Human
ttttcctgtaagtgctccattttcataaaatcttatttttcactctgatgatggttgctatgcttgtggccttcctgcaggctcttgtgaggactgaatgtgaggctttgcttaccagctctttctaaaatatataaatagcccagagagtcttctaaaattgggggctcaaatccacaaatgacatgttatttgaaaatactggatttaatagaaaatatcacattgtaaacaaatccattgatccatgagcttaaaacagaatgacggcacaatcacatagaaaagctaaagacaaaayactggtaccaaacatagcccttaggcctgggctaggctctcaaaggtctttcccagaaatggaggcagcagtagcttcaaacaggcacaaaaacagccaggaggaggcagcatccactccatgaaggcctaagacaatgaaaggaagccagagcaacagaccaccttgggatccggggagaagggtaaatgggcaaaagggttgtatttcctgatgctctcagaacatcagaccacaccatgtgaatttaagcaggactattttaagtggggaaacaatactagaagcatttggtgtatt

SEQ ID NO: 151115 - DNA, 601 bp, Human
ctattctggacatttcatataaattaaaaacaatatatggctttttgtgtttgacttttttttttttttttgagacggagtctcgctgttacctaggctggagtgcagtgactcactgtaacctctgtctcctgggttcaaatgattctcctgcctcagcctccctagtagctgggactacaggtgcccgccaccatgcccggcttattttttgtatttttagtagagacggggtttcaccatgttggtcaggctggtctcgatctcctgacctcgtgatccacccgcctcggcttcccaragtgctaggattacaggcgtgagccaccgcacccggccttctaagggttttatagttttagttcttacatttaggtcgttgatccatatttagttaatttttgcatatggtgtgaggaaggaagtgtataattttaattcctgcttagcctgacgataatcatgtgacccttggtaagttcttgcacctaagtctcaatttccttatttgtaaagtgagaataacaaatggtagctaaatcataagattacagtgaagatagaaaatttacgtagagcatttatcacactgcttgaagca

SEQ ID NO: 151116 - DNA, 601 bp, Human
aaggtaaacgggaggaagtaggcttgcttagtccacttggagaagcaggtctgggattgttgtgagagtctctgccctaggtagaccactgcctcatgatcccctctagagattggtaaaaattcgaattctcgggccccatcagaactactgaaaagagcctcctgtgagcacagggctcgcagtaagtgggggtgacggtggtcgcgccggcagcgccgccttgggcctgcgggaggcgcccgagaggcaggggcgaccacggcggctgcgcagagtcctccctatgccggcggtcgcrccagcgggatccgcctggctcagctgacagctcccgagaacggaagaggcggcgcgccggttgagcagggcgtttctaggcctggtcggctggcggcggtgagtgggccccaggcaagggcggagggcggaactttggggttcggcactgccgggcggccggaaggtacggtggggatagctctctgggcgcgcgaggcagagaaggggaccgggctgggactgtacactgggcctcagtccctcaaatccgggaccgggcgtccgcagctcggctggccgggactcccttcgggacgct

SEQ ID NO: 151117 - DNA, 601 bp, Human
ccctaggtagaccactgcctcatgatcccctctagagattggtaaaaattcgaattctcgggccccatcagaactactgaaaagagcctcctgtgagcacagggctcgcagtaagtgggggtgacggtggtcgcgccggcagcgccgccttgggcctgcgggaggcgcccgagaggcaggggcgaccacggcggctgcgcagagtcctccctatgccggcggtcgcaccagcgggatccgcctggctcagctgacagctcccgagaacggaagaggcggcgcgccggttgagcagggcgtytctaggcctggtcggctggcggcggtgagtgggccccaggcaagggcggagggcggaactttggggttcggcactgccgggcggccggaaggtacggtggggatagctctctgggcgcgcgaggcagagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcat

SEQ ID NO: 151118 - DNA, 601 bp, Human
gtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgaggtactggattccargtgacagcttcacaagctgaaatcttgtagggtaggtcatgaggaactgttgaaactgcttggagtagaagttcttagccctggctgcatattggaatcacctggagaacttggaaaactactgaggcctgaattaattgttctagggtgtggcctgggtattgagattttaaaaaacagctcctcagaagattctaatgtgcaatcagatggagaacactaacctaaaaccataaactgcatgaatgaatctctcatcccatttgcaaatgttttaacaggaagaaacaaaaagcttaa

SEQ ID NO: 151119 - DNA, 601 bp, Human
ggcgagctgaacccagactaggacacccgaagaccaaatggatagagtgagaaggaaatgggggttagcaacctgaattgaggtactggattccaggtgacagcttcacaagctgaaatcttgtagggtaggtcatgaggaactgttgaaactgcttggagtagaagttcttagccctggctgcatattggaatcacctggagaacttggaaaactactgaggcctgaattaattgttctagggtgtggcctgggtattgagattttaaaaaacagctcctcagaagattctaatgtgcartcagatggagaacactaacctaaaaccataaactgcatgaatgaatctctcatcccatttgcaaatgttttaacaggaagaaacaaaaagcttaattcaattagcaccatatactcccacctagtaaaataagacaatgtgaaaggacctaatacagtacatagtaggtgctcaattaatgtaaattgattctgaatctcattcttatctcatttgggagttacacatccgagaatctggtttttaattatggttttgtatatagtatttttgcatataattttagggtgttgataggat

SEQ ID NO: 151120 - DNA, 601 bp, Human
tctaaagcatttagaataaaacttaaaagtttgtgtttgtgtactcttgttttgtttaagtatttttctgttaccaaaattaaccttgagtgccactggcaggcttaattcatgaacaagagaggaaaaactggaggggagtggcaaatgaaggaatacaagaagcagaagaggaaaggagaaaaaaacaaaacaaaaaacaaactgaagagattgtttgttatggggcatggtgtcctgtactttcatatgaccttggtgttcctccttagctcctcccatagctgagggcagacagataaaaagtcctcagtcattgctggggacatgcaaatactcctttaaccacatggctcagttagcctgccctaggagagtaacatgcacttgtagattaggattggctatatgttaggatatgtttgacttaagcagtgatcatggaaattcagaattttaatttggagagggtcctaacaccatcttttgtatttcttttctgcagatggcaggattttcataatatatgtagtatgagttccacatcttggcctcttacccagcttcagcagtctcagctccaccagttagagaataaatg

SEQ ID NO: 151121 - DNA, 601 bp, Human
ttcatgaacaagagaggaaaaactggaggggagtggcaaatgaaggaatacaagaagcagaagaggaaaggagaaaaaaacaaaacaaaaaacaaactgaagagattgtttgttatggggcatggtgtcctgtactttcatatgaccttggtgttcctccttagctcctcccatagctgagggcagacagataaaaagtcctcagtcattgctggggacatgcaaatactcctttaaccacatggctcagttagcctgccctaggagagtaacatgcacttgtagattaggattggctatmtgttaggatatgtttgacttaagcagtgatcatggaaattcagaattttaatttggagagggtcctaacaccatcttttgtatttcttttctgcagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtactaactgacctcaagtagaacatgtaa

SEQ ID NO: 151122 - DNA, 601 bp, Human
aaatattttagttgtgagggaggatatttgcaaatgcaattgtagttcaatattttaattgactggtagttttgttttattaaaatgatttttgtaaattctcattgcatatttttttcacatttaaattatctgaaattgctgtatctttcagttgatgctattttaaaaaacattgattcatactttattttttgagacaaggtcttgctctgtcccccaggctggagtgcagtggtgcaaacacggctcactgcagcctcagcatccaaggctcaagcgatcctcctgccacagtctyctgagtagctgggactacaggcatacaccaccacacctggctaattttttatagagacaggatcttgctatgttgccaaggctgatctcaaactgctggcctcaagtgatcctcctgccttggcctcccaaagtgctgggattacgggcatgagccaccatatccagccagttcatactttaattgtagctaatttctttttctttcttttttctttctttctttctttctcttctttcctttctttcttctttctttctttccttttttttggagacagagtctgtctctgtcacccag

SEQ ID NO: 151123 - DNA, 601 bp, Human
gcaacctctgcctcctggattctagtgattctctagtctcgtgcctcagccaccgagtagctgggattacatgcgtgtaccacaatgcccggctaatttttttatttttagtagagatggggttttgctgtgttggccaggctagtcttgaactcttggcctcaagtgatctgcctgccttggtctcccaaagtgctgggattaaagacttgagccactgtgcctgggccttgtagctaaattcttagtattacctaaaataatggtaaatctttcttaaaattattatcttttaaatatwcttgagtcataatggtgaatctttaaattggtgactgcttggatttgacaaaatctattatttcaaaaatttaatattattttgctgcttgctcagttatctaattttcttccataatatctatgcctgtaacattctcaagcactgttttctcacctgggagcaattttgcctccaacccccatcctgccccaggacctggcgctatttggagatattttttttttttgagacagggtcccactttgtcactcaggctggagtgcagtggtgctatcatggctcactgcagcctcgacc

SEQ ID NO: 151124 - DNA, 601 bp, Human
tgtgcctgggccttgtagctaaattcttagtattacctaaaataatggtaaatctttcttaaaattattatcttttaaatattcttgagtcataatggtgaatctttaaattggtgactgcttggatttgacaaaatctattatttcaaaaatttaatattattttgctgcttgctcagttatctaattttcttccataatatctatgcctgtaacattctcaagcactgttttctcacctgggagcaattttgcctccaacccccatcctgccccaggacctggcgctatttggagatattttttttttttgagacagggtcccactttgtcactcaggctggagtgcagtggtgctatcatggctcactgcagcctcgacctcccaggctcaagtgatcctcccatgtcagctccccaagtagctgggaccacaggcaagcaccaccacacctggctagatattttcagttgtcacagctcttgtgggtggaagcgggccactattgggtatctagtgggtaaaagccaggggatgctgttaagattctataatgcacaacacagctctccaacaacaattatttacttcaaaatgtca

SEQ ID NO: 151125 - DNA, 601 bp, Human
ggaccacaggcaagcaccaccacacctggctagatattttcagttgtcacagctcttgtgggtggaagcgggccactattgggtatctagtgggtaaaagccaggggatgctgttaagattctataatgcacaacacagctctccaacaacaattatttacttcaaaatgtcaatagagctgaagctaagaaaacttgccctaaagattcctgtggatttaaaaaatttacttttttgtttttttgagacagagtctgactctgtcgcccaggctggagtgcaatggtgcaatctcagctyactgcaacctctgcctcccacgttcaagcagttctcctgcctcaacctcccgagtagctgggattacaggggtgagccaccacacccagctaatttttgtatttttagtagagatggggtttcaccacgttggccaggctggtctcgaactcctgaccgcaggtgatttgcccgcctcggcctaccaaagtgttgggattacaggcacgagccaccgcgcctggcaaattaacttaagaaaggagtgtaatatactttgaccacttttgcgaaccaggcacattgctaggttcagtggac

SEQ ID NO: 151126 - DNA, 601 bp, Human
gacctcaggtgatccgcccgcctcggcctcccaaagtgttgggattacaggtgtgagccaccacacccggccagcctctgtgcattttctgttcttaactgattttaatgttttcaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggttagttaataatttcttaaacakatttttctattattctttatttcttagtgtaccttaaactatttgtcattttgtgttttaggcattagtgataggtggtagtattacagaggtaatgcatgtttctgttttaaatgaaaattgcaatgaggggcaagcagttttcaatttgattctacctttttgatcactgaagagggatattatcctgcatatttcatacatcctggtctgctaactagcagtttatcagccatgagtcattggctgttacatagcagtaatcaaagagaaaatgaatgtatgtgaaaacgcttagaa

SEQ ID NO: 151127 - DNA, 601 bp, Human
aaacaaaactgctgcttttgatacagacatttacagaagactttgatgcacactttctcaaaatgtttctactataaagggattgagtaaggaaagtaagtgtggtaatttaaatgaaactttgattgtgagagtgttgtgtgctatattatatcctcaaacctgagatcattgtgttggcacaaattttcccaactgattcatgggtagttgggacatgctggtctaagtgggacatgctggtctaagtaggtcatgctgttcaatggaaatgaacatcctttctctagattgtgtcttyaatcatccactgtaaaccaaaccacaacaaaacaaacattgtgtgttccttggtcattagtgttaggaattgtacccagaagtgtatacaagaataagttgtagtattttcattatacatttcatggtgctgtagatttttcaagggcttacaagatttttttttaaggtggtggctaccaagttaaaattaagaaatagaaagtgctttgggggagggtttttattccctcaactaaagcattaagtctttcttgagcgctgctcaacagtagtggacactcaagtgttgaccaactga

SEQ ID NO: 151128 - DNA, 601 bp, Human
cacaaattttcccaactgattcatgggtagttgggacatgctggtctaagtgggacatgctggtctaagtaggtcatgctgttcaatggaaatgaacatcctttctctagattgtgtctttaatcatccactgtaaaccaaaccacaacaaaacaaacattgtgtgttccttggtcattagtgttaggaattgtacccagaagtgtatacaagaataagttgtagtattttcattatacatttcatggtgctgtagatttttcaagggcttacaagatttttttttaaggtggtggctacsaagttaaaattaagaaatagaaagtgctttgggggagggtttttattccctcaactaaagcattaagtctttcttgagcgctgctcaacagtagtggacactcaagtgttgaccaactgatcctttctaatctttgtttttggttcaggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcag

SEQ ID NO: 151129 - DNA, 601 bp, Human
tataaataatataaagcattctgggagagataatgaatcagcagctgcttttctagaagtcataatgaagatcaatagactaatgtgtattaagacaaaagctcagcctgtgcaacatggcgaaacccaatttctacaaaaaatacaaaaattagccaagtgtggtggtgcgtccctgtaatcccagatacttgggaggctgaggtgggaggatcacttgagcctgggtggcagagattgcagtgagccaagactgagccactgcactccagcctgggtgacagacagagaccctgtctcaaaaaaaaaaaaaaagaaaaagacaaaagatgtcagagttgctgacctcaaggaatagctcattagtttttctctttggatcatacagttttcatttccccatccaccaatctaatcttttaagtgagagtactttcacaaactagagcttatggtttaaaagcaaaattaaaccttaaaaaggataacacaggtagaataaaaaggagtattactttacattctaatgtctgtgccagaggcaacagatgcaagacagttgatttgtccaggaatatcaagactgtttggcatttaggcc

SEQ ID NO: 151130 - DNA, 601 bp, Human
ccaagtgtggtggtgcgtccctgtaatcccagatacttgggaggctgaggtgggaggatcacttgagcctgggtggcagagattgcagtgagccaagactgagccactgcactccagcctgggtgacagacagagaccctgtctcaaaaaaaaaaaaaaagaaaaagacaaaagatgtcagagttgctgacctcaaggaatagctcattagtttttctctttggatcatacagttttcatttccccatccaccaatctaatcttttaagtgagagtactttcacaaactagagcttatggyttaaaagcaaaattaaaccttaaaaaggataacacaggtagaataaaaaggagtattactttacattctaatgtctgtgccagaggcaacagatgcaagacagttgatttgtccaggaatatcaagactgtttggcatttaggccactgatagttggcttaattatttagatcttcatagtcctatttcaccagagagcttttcatactttacatccacgcatgtgcgtgcatgcacgtgcatgcacacacacgcacaaaacagggacagattaactggatgcgtggttgtggtttcaga

SEQ ID NO: 151131 - DNA, 601 bp, Human
taaaccttaaaaaggataacacaggtagaataaaaaggagtattactttacattctaatgtctgtgccagaggcaacagatgcaagacagttgatttgtccaggaatatcaagactgtttggcatttaggccactgatagttggcttaattatttagatcttcatagtcctatttcaccagagagcttttcatactttacatccacgcatgtgcgtgcatgcacgtgcatgcacacacacgcacaaaacagggacagattaactggatgcgtggttgtggtttcagattccagccaaccarcatctacttaatgctggatttgggggcggaggtgtgtgctggggaagagagttgttttatgtgttacagctaaaattacagtagaattcttaatcaaataaatgtttatgcatataattaacattttaattggtctcttatattccttcttggttcagttcttgtttgttgctgtaccctgattccttggcattatgactctcacctgttaatggtgaaattgacacatagagctgtcattccctgaattggggcgggtagacagagggaagtggttttagttttctaaaaccttattcc

SEQ ID NO: 151132 - DNA, 601 bp, Human
tttttttttttttttttttttttttgagatggagtcttgctctgtcacccaggctggagcacaggggcacaatctcagctcactacaacctctgcctagtgggttcaagtggttgtcctgcctcagcctcccaagtagctgggaatacaggcgcccgccaccacacctggctaattttttgtattttttagtagagacagggtttcaccatgttggccaggctgatcaccaacccctgacctcaggtgatccacccgccttggcctcccagagttctgggattacaggcatgagccaccaygcccagccccagctgcctctcttgagaagggactggggtagaaaagaggttggagaatggcttcttcataggacttggtagctcacacagcactcatagcttcccttttagtatttatcacattttacagatgttagcagatttctcaaaagcatggttgatttataaggatatttatgcaaatgtgaaaaatcattagttgttcaatcttaactcatcaataagtatttaaggtagtacctatgcagggtttagtcagtggcactacacagagtgtaagaaacagaaaatctggtccct

SEQ ID NO: 151133 - DNA, 601 bp, Human
ccgaggccttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgattaaccaacttttttatagacttcagcagaagtacagcctacttaggtkttgttgttgttgttgttgttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggatta

SEQ ID NO: 151134 - DNA, 601 bp, Human
cgaggccttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgattaaccaacttttttatagacttcagcagaagtacagcctacttaggtgktgttgttgttgttgttgttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggattac

SEQ ID NO: 151135 - DNA, 601 bp, Human
ggccttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgattaaccaacttttttatagacttcagcagaagtacagcctacttaggtgttgktgttgttgttgttgttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggattacagg

SEQ ID NO: 151136 - DNA, 601 bp, Human
cttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgattaaccaacttttttatagacttcagcagaagtacagcctacttaggtgttgttgktgttgttgttgttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggattacaggcgt

SEQ ID NO: 151137 - DNA, 601 bp, Human
gttgttgttgttgttgttttgtttgagatggagtcttgctgtgtcacccaggatggagtgcaggggcatgatctcagctcacggcaacttctgcctccaaggttcaagtgatttcctgcctcagcctcccaagtagctgggattacaggcacccgccaccatgcccggctaattttttttgtatttttagtagagacggggtttcaccacgttggccaggctggtcttgaactcctgacctcaagtgatcctcccgctttggcctcccaaagtgttgggattacaggcgtgagccactgckcctggccagttttttgttttcttattaaagcataattttacttaaaataaactacacatttaaatcatacaaggctagcatggtagcttacacctataatcccagcactttgggaggccaagataggaggatcgcttgaggctaggggtttaaaaccagcctgtgcaaaatagcatgactccatgtcttaaaaaaaaaaaatcaggcatgatggcaagtgcctgttgtcctagctacttgggaagctgaggtagagaatcatttgagcccaggagttcaaggctgcagtgagctatgatt

SEQ ID NO: 151138 - DNA, 601 bp, Human
agtctctccctcacatttcactctactaccagggccttatgacttcattcttcaatttggaagtattcatttagcagatatttctgtgtcagtgactatctcaggccttggggctgtagtagtgaccagaagagacaaaatgtctgccctcatggaactcacattctaccaggggagacaggaaaacaaaataaggatattaggtggtggtaagtgctgaagaggcagaagaaataaagcaaggacaggatatgaaatgttctgaaggggaggggacttgggattttagttagggaaaacgggaggcctcaccggcaaaatggtttaagtaaggacttgaaggaggtaagaaaaaccgtgcagataccagggaggaacattccaggagaaggaatggcacaggaaattctatatacaaacatggaataatgtagatcctggatggccaatgcagggcatctaagctgccattcttgtctccatggcacatgtgtttgactagtcatcaaatgctttctccttgagcccagagaggcctcagaatcttcctcaacatggcacttcggaaagctaccctctgatgaagtagacacaggagtga

SEQ ID NO: 151139 - DNA, 601 bp, Human
attcagaaggctacagcaggaggatcttttgagcctcagttgagactagcttgggcaacgtagtgagactctgcttctaaaaaaattaaatcaagcaaacctggttatatcttataaaagtgttgatctttgacgtatcagagaaaaaataaactgggcctttaccataaatagtttgagaaacagtgggctaatacatgtaaaatgcagaatggggctgggcatagtggctcacctctgtaatctcagcactttgggaggccaaggtgggcggattgcttgagtccaagagtttgacacyatggcaaaaccccgtgtctacaaaaaaatacaaaaattaacgaggtgtggtggtgcacatctgtagtctcagccactcaggttgctgaggcgggaggatcgcttgaaactgggaggtagaggctgcagtgagccagattgcaccactgcactccagcctgggggacagagtgggaccctgtctcaaaaaaaaaaaaagaggaaaaagaaaaatagtaattattaatgctattattattgtagttattacttgctaatgttagcagactgtcattatttccaagaaagtaccatgagagga

SEQ ID NO: 151140 - DNA, 601 bp, Human
aattattagagggatgagatttacattgcttcactgctacattgaagtagaggtgatgaagctgtgggaatgtactacacagagaaagaattcacaggtgaaagcaaagagtggagataggatataggattctataccagaagatgtcttttgctttaaaagggagatagacttccaaataatgtgaggaaagtaaactgataaaataactagaacattgttgagaaaactctttaattaattgtattgaaaaattaaggtaatacaactgtgaacaaaagccttttgtctgcaagtaaarcctttgggattggttacctgttccatttcagttaaatgatagagcagtagaagccagattgaagagtatcgagggaaaacttttcagcacctgtagcaaagcatagtacagggtgagacttgggtggtaagttttattcactgatttttttttttacacagaattgaagaggtagtctttgcccttaagccaaaagtgcctttgtatttggtaggcctcttcattatcaaacagtgaatggtgctgacttagtggaaaaatcaatgtctgtttcaacctttgtgtcttctagataagtca

SEQ ID NO: 151141 - DNA, 601 bp, Human
gtggagataggatataggattctataccagaagatgtcttttgctttaaaagggagatagacttccaaataatgtgaggaaagtaaactgataaaataactagaacattgttgagaaaactctttaattaattgtattgaaaaattaaggtaatacaactgtgaacaaaagccttttgtctgcaagtaaaacctttgggattggttacctgttccatttcagttaaatgatagagcagtagaagccagattgaagagtatcgagggaaaacttttcagcacctgtagcaaagcatagtacrgggtgagacttgggtggtaagttttattcactgatttttttttttacacagaattgaagaggtagtctttgcccttaagccaaaagtgcctttgtatttggtaggcctcttcattatcaaacagtgaatggtgctgacttagtggaaaaatcaatgtctgtttcaacctttgtgtcttctagataagtcagtctttaactgcatacttctagatgcataaacataccaacattaagaaatcaaaatcaaaggaaaaaaatagcctatcttattctaccacttttagcagatacatctttt

SEQ ID NO: 151142 - DNA, 601 bp, Human
ttcaacctttgtgtcttctagataagtcagtctttaactgcatacttctagatgcataaacataccaacattaagaaatcaaaatcaaaggaaaaaaatagcctatcttattctaccacttttagcagatacatcttttctagttgggggattcctttccatttattatcatttgtgcaagtataatttttactgggttataacataaatatactttttttctggattctgtgatgagtgttttaattgggttgtagcgaacctaattatgtttttaataattgaatattatgtcattaartggctcttccaaacataattatttccttagaaatttaatttttttgccattgttatatgcatctccatgcatatgactttggattatttccttatgataaagttctaggaataacattattgaatagtcgaagattatagccatttttaatgatttttggtcagcattacaaagttatataaaagttaattttccatttcactttgtagagaaattaatggacttacgaaatgaatacctgcaagcggatgaggctaataaaagacttttggatcaaaggtatggtaagagagtgattca

SEQ ID NO: 151143 - DNA, 601 bp, Human
caggcatgagccaccacacctggccatataatcacttttgacataccttagccctatgacagagtggaggacttggtaccaaatatttacttagatttctgtaaaaattaaaaacccacacgttacatccaaacattttaatattaatctaactacattttccagttatacgtgtgtgatttttatctactgcttgtcagaagagattgtgccaagtaactaattgtagtaacactagctattttctgtattttacttctaatgcaaaatagaaagaattacatagtcatcagtgtgttayattgatatctcaaccctgcataagaaaagggagaggaccaagacaatgttgtactgaatcattttggcatgtgctgtctcttctgcttttacagccttgatatttttctctttctatccttcccaccagaaattagacggatgtaacaagatgacatgtactggctgtatgcaatatttctgttggatttgcatgggttctctctctagagcaaacccttacaaacatttcaatgaccctggttcaccatgttttaaccggtatgtatacacggaattcctcaggctcaccagcaatttt

SEQ ID NO: 151144 - DNA, 601 bp, Human
aagaattacatagtcatcagtgtgttacattgatatctcaaccctgcataagaaaagggagaggaccaagacaatgttgtactgaatcattttggcatgtgctgtctcttctgcttttacagccttgatatttttctctttctatccttcccaccagaaattagacggatgtaacaagatgacatgtactggctgtatgcaatatttctgttggatttgcatgggttctctctctagagcaaacccttacaaacatttcaatgaccctggttcaccatgttttaaccggtatgtatacacrgaattcctcaggctcaccagcaatttttggtacttgatttgcagaccacaaatccagtgttttatttaagtacttggacttatttagagaattctcttacatgttttcccctataaaggaatttttatattattttctcaaaaatgagttttataatgagacttatacaccatctggaagtttttatagtgaaagttttcaaacagaaaatttgaaaggataggactatgaatagtaggatactttccacccaaattaacagttgatagtactttgccatatttgttcccttaacatttt

SEQ ID NO: 151145 - DNA, 601 bp, Human
gatatttttctctttctatccttcccaccagaaattagacggatgtaacaagatgacatgtactggctgtatgcaatatttctgttggatttgcatgggttctctctctagagcaaacccttacaaacatttcaatgaccctggttcaccatgttttaaccggtatgtatacacggaattcctcaggctcaccagcaatttttggtacttgatttgcagaccacaaatccagtgttttatttaagtacttggacttatttagagaattctcttacatgttttcccctataaaggaattttyatattattttctcaaaaatgagttttataatgagacttatacaccatctggaagtttttatagtgaaagttttcaaacagaaaatttgaaaggataggactatgaatagtaggatactttccacccaaattaacagttgatagtactttgccatatttgttcccttaacatttttactgaactacatgaagttggagttatgataatgcttcaactctaaatatttccacgtttctcctaagataaggaaatgcttctacataatgacagtacttttaaaaaacttaatgatagtggcat

SEQ ID NO: 151146 - DNA, 601 bp, Human
tttctgttggatttgcatgggttctctctctagagcaaacccttacaaacatttcaatgaccctggttcaccatgttttaaccggtatgtatacacggaattcctcaggctcaccagcaatttttggtacttgatttgcagaccacaaatccagtgttttatttaagtacttggacttatttagagaattctcttacatgttttcccctataaaggaatttttatattattttctcaaaaatgagttttataatgagacttatacaccatctggaagtttttatagtgaaagttttcaaaaagaaaatttgaaaggataggactatgaatagtaggatactttccacccaaattaacagttgatagtactttgccatatttgttcccttaacatttttactgaactacatgaagttggagttatgataatgcttcaactctaaatatttccacgtttctcctaagataaggaaatgcttctacataatgacagtacttttaaaaaacttaatgatagtggcatactattatctagtaaacaaacatatttgaaacttcctaattatttctgaaaatatcttttaaagctatttgattgaac

SEQ ID NO: 151147 - DNA, 601 bp, Human
caaacccttacaaacatttcaatgaccctggttcaccatgttttaaccggtatgtatacacggaattcctcaggctcaccagcaatttttggtacttgatttgcagaccacaaatccagtgttttatttaagtacttggacttatttagagaattctcttacatgttttcccctataaaggaatttttatattattttctcaaaaatgagttttataatgagacttatacaccatctggaagtttttatagtgaaagttttcaaacagaaaatttgaaaggataggactatgaatagtagratactttccacccaaattaacagttgatagtactttgccatatttgttcccttaacatttttactgaactacatgaagttggagttatgataatgcttcaactctaaatatttccacgtttctcctaagataaggaaatgcttctacataatgacagtacttttaaaaaacttaatgatagtggcatactattatctagtaaacaaacatatttgaaacttcctaattatttctgaaaatatcttttaaagctatttgattgaaccagaatctgaacaagttcagtcattgtatttggtt

SEQ ID NO: 151148 - DNA, 601 bp, Human
tagaaccactccatggtcagtggtctattggcaggaagaaatgctggtcggtttttgtgccaaaactgcagaagggaggggcagcgtcaggcagttggttgatatcagcggtggagcaagtcttcccaaagggttggtttgaacccttagggaaagaaagcctaatggtggtcagtgagggaggggggtatgaccaggtgtgtctggcctcccatcccatcatggccgggaactgttttcagggtttctctggggttcccttggccaggagagggtctgttcagttggttgtggggcttarggtatcatttttatttctcattttcccctttttggctgagatttgccagaggcagcattgatggtcaaacttattttgtcccatatcattgctggagtggtgtggctaacctgcctcgcctccatctaggccctcagtgggacccctatggccaagggacttaaggccaaaagacagccaattaaatcttctaggccagtgggaatggagctggacaagtactcatccaccttaaatgggccattcttaactaactttagggtagattgttcagagggacccatatttcagccctcctca

SEQ ID NO: 151149 - DNA, 601 bp, Human
ggctgaggcagagaatgcgtgaacccgggaggcagagcttgcagtgagccgagatcgtgccactgcactccagcttgggggacagagcgagactccgtcccaaaaaaaaaaaagaaattacagagttaagtctttagcttggtattcagagctccttccagtcttttcactcaagctaagcctgtctctttatatttttttctgaatggctgtttcacttccctgtatttgtatttttattcatatattgttctctacctagaatgttcttaattgactgcatatctacctgtagttactyaactctttctattgacattctgcttatttaggatcaagttgttgtgcaaagcttcatgattttagtgcttcttcagtagataccaacaagatcagtattttaagataggattttggctgggtgtgttggctgatgcctgtaatctgtgcactttgggaggccgaggcaggtggatcacttgagaccagcctgggcaacatggtgaaaccccatctctacaaaaaaatacaataattaactgggtgtggtggtgtgcacctgtagttccagctacttagggaggctgaggtgggaggattg

SEQ ID NO: 151150 - DNA, 601 bp, Human
agagggtcacagtacttggttatcttttaaatggctgtctcggagtttcttaggtacttgaaagccagattctccttattttaacttctcagtacttttggatttttggtgaatcgaatctacaattaaaccccttgggtacttttttatatctcccatattagtctgttaggttgttattagaaagttcagattataggccgggcgcagtggctcacatctataatcccagcactttgggaggctgagaaaggtggatcacctgaggtcaggagttcgagaccagcctggccaccatggcaaaaccctgtctttactaaaaatacaaaaattagccaggcatggtgacgggtgcctgtaatcccagctacttgggaggctgaggcagggataattgcttgaacctgggaggtgaaggttgcagtgagccgagatcgtgccattgcactccagcctgggcaacagagtaagactctgtctcaaaaaaaaaaaaaaaaaaaaaagattcagattatagtacgataaactactcagaaaaagtgaaagttcctaacatgaagtagcatttacaagctttgagaaataaaatggttgaacactg

SEQ ID NO: 151151 - DNA, 601 bp, Human
aaaaagctgactttgctttattgttacgtgttcagcatgcatttttgagtactagatgctagtgtggtggtagacagggtataatataaagctgatttggtcagatatttgtgtggtaacgatctttaacctggccatgaagggaaccctctgcttctgtcatcttaaggcaggcattcttcactcgagggccatgaacctaatgaaaaggtataaatgctgtttgttagggatggggtctgtggtataacagattcttagaggagttcttaactctagaaagttttagaacttggtaccstaataaattgttgacatagagctttgctgtctagaattagagtgggatttactatttcctcagccttgcaattctgattttaatggcagagttctggaaaaattaacaacatggaaaggagcaaaatgtaggatgtagcacaatatagcgtctggaaaaagggaataaaagagctaaaaagaggttactaaggcctgttaaataaatggcctgtccccacttcttgctagaattcagtgaactcataactgcacttagttggctccagtaggggcatgttgggtttgtaatattatcttt

SEQ ID NO: 151152 - DNA, 601 bp, Human
gtatttttagtagacacggggtttcactatgctggccaggctggtctcgaactcctgacctcaggtgatccgcctggcttggtctcccaaagtgctgggattacaggcgtgagccaccacgcccagccacatagactgtttttttagcaagttgatgtccactttgaaagtggttgttttttgttatggtattctgcatgtcacatgtttgagaggcaaaagcagcattctgacgtgaaagccactttccagtaaccaagtattcttgagcacacccaagtccagaacttcatgttcttgkcagctctaatcctttcagttatttgctttttttctgattcctgtaatagaaatatatttgttaggccacctactgacattatggtaagttctgttaattattattaaataaatactatattgaatttactataaccccttagtaaaaattagactcttaatttcttcttttagtttctttactcactgactcaggttttaaaatatattcaaagatgtagaaggagtaagacgctgctttgaaaaattgaaatattgattttgttgacacttttgaggaccggatcagattaattgatct

SEQ ID NO: 151153 - DNA, 601 bp, Human
ctgtcttaacagtgccttctctgagtgtgtcaaatctccttctacctttctcttaaaaaaataatttatctacaaaatagaagttccaaatttaaacattatccttaagttatttcccattacatctttttcagtgcctagtatgtttctttattctttaaaaggatcctgttgtcaatctctaaatcctttctaaatctgactctattttcactctttgcataagttctatataaatgaacactacttccttctatataccttctatttgttctagaccaatgtgtctttcatgcttccrtaatacagtaattcaatgaaaagaaatctaaacaaaaatctgttatatttctagttaaacaccaagagatttatttagaaaggagctttgtattggaagaaacattttgtaaagtgttctcttttacttacttttcattatatctagtaactgtgacaggcaagttctgttctctttcagcatcagactctctgataaataactagtaaagaaaagaaaaaaaaatctattgaaaacatacagcacattgagaaaacatgacatcataaattattttcctccatcctcatcaaaggcaat

SEQ ID NO: 151154 - DNA, 601 bp, Human
acactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacartggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatg

SEQ ID NO: 151155 - DNA, 601 bp, Human
cctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccstggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggac

SEQ ID NO: 151156 - DNA, 601 bp, Human
ggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcrggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctgg

SEQ ID NO: 151157 - DNA, 601 bp, Human
ctttcgcaggtctcggtattctgcctcgagttctcctacgacctgggccgggtcttgctcaggccggagcttgagtgacttccctcagtccctttccgggagtatccagggtgacctgccctaatcctgtctctggcctggtccgggggtcctgcccggtctccccattggtgggtctggccgcctgtcccacctcccatctgtggtcgcagccatctgggcaccccacctttcacagtcacggagcgtaggttcgactttccccatgcataggggcgctggccagcggaaggttgaggcrgagaagaatttttgcctcccatggaggagcacatattggctggctattaagatcattcaggaagcaggttgtattttgttttttcttgcatcgcctgttgctgaaaccgacctgttacataacttcacaactcttgccttggaaaagttgggtttgagttttgttcttccaataagacagcaataatggctttacataaacgagtctgccacgttggaaacttatttttaatgatgtggatgtttagagaaggttacttaggtattttaaatgggggcttgggttgggagaagtatcggg

SEQ ID NO: 151158 - DNA, 601 bp, Human
tatattcagagttgtgcagccattaccacagtaaactttagaacatttttgtcaccccagagataaaccctgcaccccttagcccatccgtcctacctccacagcccctggcaaccactcacctgctttctgtctcaagatgtgcctgttctgggcatttcacatcaacggaatcatatcatatatggtgttttgtgtctggctcctttcactctgcgtgatgtgtgagaagtagctacaaggtgagcttcgtagctgttccctggccgagcattcaggaaaatgaacctgatcgaggttyatccacgctgtggtatgtgtcatcatttcattccttttttttttttgagacagagtctcgctctgttgcccaggctggggtgcagtggcgtgatcttggctcactgcaacctgtgcctcccaggttcaagcgattctcctgcctcagcctccccagtagctgggattacaggtgcacaccaccatgccccggctaatttttgtatttttagtagagacggggtttcaccatgttggccagatggtcttgatttcctgaccatgtggtccacttgcctcggcctcccaaagtgctgggatt

SEQ ID NO: 151159 - DNA, 601 bp, Human
gtggtgtgtgaatgccttaatgtatttacccttgatttattctctgtggctctttttattatgcaagtagggttggcttaattctccttcccagtttttatttcgatttttctgcaagatgagctcttggcacacccgctgatcttcattaacgggaggatgttcccaaggcagtaacgggcatccaggggcgctggttcctgagcaagcttgctctggcctgagctcatcggagctgtccggaggctaattcaggccagatcctgaatcatcggcttcaattaagttcacttgaccgtcrgcgctgggcttgccttcctgatgttgatcagctgcagctggactgtgtcgcttgttctgtgtttgggacaggacagtgttctcccagtgcccaaattccaaggggggagttcaatggtcttgcccgagtggtgggactctcgtcctggtgggtcccgtgctagcggctccccttcccctccaggttgctgtgtacaggtcactccactgctggagaggatggagcagagcctgggaggcagagctccgaggtgctagcaaggaagtgtggggtctttttctgaggttcacgttctggaga

SEQ ID NO: 151160 - DNA, 601 bp, Human
gcaagatgagctcttggcacacccgctgatcttcattaacgggaggatgttcccaaggcagtaacgggcatccaggggcgctggttcctgagcaagcttgctctggcctgagctcatcggagctgtccggaggctaattcaggccagatcctgaatcatcggcttcaattaagttcacttgaccgtcagcgctgggcttgccttcctgatgttgatcagctgcagctggactgtgtcgcttgttctgtgtttgggacaggacagtgttctcccagtgcccaaattccaaggggggagttcratggtcttgcccgagtggtgggactctcgtcctggtgggtcccgtgctagcggctccccttcccctccaggttgctgtgtacaggtcactccactgctggagaggatggagcagagcctgggaggcagagctccgaggtgctagcaaggaagtgtggggtctttttctgaggttcacgttctggagaaagaaaatgaccaaagcccggaggcaggcttacttgtgctgacacaagcccctcctgtgcctttgacagctgtgggtctcggagggttacagatggagcagtcagatctcgtg

SEQ ID NO: 151161 - DNA, 601 bp, Human
tccctccctcccctcctctttctgtccctccctcccctcctctctctcttcctccctcccacagcagctgctccctggccacggaggcctctggtgtgcggtgaagcctccagacgggattggcctgtgtgtgttccggggactcctaatggcttctctttcagatgtgcccttggtggcatttggggctgcaggtgccactcacggcgcctgctctcacggcagaggcttgctgtagggcccgcctcatggggcctcgggcatgtggaggccaggcccgggcctgtgctggaggctaacyggggctcttgtttttcatgtgctcagactcaagataacatcactgtcaggtgggacctgggccttaacaagaagagaatcgcctacttcactttgcccaagactgactctggtaatgaggatttagtcataatttggttaagaggtgattttaagttttaaaatatttgtgaccataagtagcataaattcctagttccacccttgtaaagtgccccttaatttgaactctccctggtggaagcgacggcgtgggttaaaatggccacctctctcacttttttacctcaagacatgcggc

SEQ ID NO: 151162 - DNA, 601 bp, Human
tgacattattcgtgtcagctccaaccttaggattgcattttagtaaccaggtctgctactggtttagaaaactgggggcagggggggcatggctgcagcagcgtgagttccgtgtgcggcactttatagtgtggcgggatggtgcaagttccagccttggcattgcttgcggtgggtagagctgtgaagcctgggctgtctggatctgagctccttcggcatcgtgtcattactgcctgttaaaaatgtcaggagtttaaggccagcctgaacagggtgagacgtctctacaaaaaaaaaattcagaaattagctgggggtagtggcgtgcacctgtggtcccagctactcaggaggctgaggtgggaggattgcttgagcccaggatgttgaggctgcaattagctgagatcacaccactgcactccagcctgggcaacagagcaagaccctgtctcaaaaaacagagtcttggcttactacgttcaccgagcttcctctgggtaagcactgagctgccccaatggtgttgcaggccggtgctggtgtgtgctccgagcaacatcgccgtggaccagctaacggagaagatccaccagac

SEQ ID NO: 151163 - DNA, 601 bp, Human
cacgaagtcacatggggatggagtggcaaagagttgtcacaggcctgcagaaacccacctttgtccagcttgatgtggcctcagggctggagactcccagccatgcagaaaggctgtaaaaacaaacccatctccctttccagcctcaggcatccatgaggcctggcttccccacagcgtccccagagcccaggagggtggactgagcagaggtggaccccagggcccagctgcctccgattcagccagatagtaaggagatttgcagaaatgggagacaggaccactcttcttacttagyttatttttggagaaataactaacacgtaatgggttatttttaaatgaattaatatattttttaaatttccaagtttagagaatacagttatccaataaacaaaagctgtttggactccctaacttttgagagtgtaaagggtcctgaaagctgccgacacagcgcctcatgaactccaaacctgtgaggttggtattgtcaggcctagttacaggagaaagtgaggctcagagcccaccccccgggttgggccacaccactctttgcctagcggtaggtcttgggagttgatgccactat

SEQ ID NO: 151164 - DNA, 601 bp, Human
ccccaggacctgcagcactgtagcgtagcaactacattgccctgtgtctgaactcatttgaggcgggctagggcttttgaagtgttacttctttccctcccctcacagcggatcgtgtgaagaagggatttgacttccagtggccccaacccgataaaccgatgttcttctacgtgacccagggccaagaggagattgccagctcgggcacctcctacctgaacaggtgagcagggacaggcccaccggcgtctgcaggtcttggggacagcttgagaggttgttgacccattctacttayttttaacatgggactgaaactttttttgccttcatttcctgtttagcctgtttagactctaaaccgtgttgtttctgcctccttttccattgtacttgttttttattgggcagatacttgctaatcccacatggcagccgtttctgcccctcgagactcccctggtgaaggctggggaagctcagctgtgcaaacgccagtgatggcagctgccttcccgcagggtgttgtgtctgcacccctcacggcctccagcctcagggctcgggatcccacaggtggagcccagcactgacagcc

SEQ ID NO: 151165 - DNA, 601 bp, Human
atcatcacgccctacgagggccagcgctcctacctggtgcagtacatgcagttcagcggctccctgcacaccaagctctaccaggtgcgctgcgccctcgggcacacttggtctcctgggccatgcaagggtattgacccttgacctttaagttaccccccaagaggggcccgtcctggctggagctcagaatggcccaggaagcaccagctggcccaccctctggggagggcacagacagcacatccccacagaccctgcgaaattccacatgatcaggacagagactttgagaaatacrtcacagggatcagaaacatgggctgagattggcacatcaaggtgttttctcgggatggttgaaacaagtccaaggtggaacggcagtggtctgtgcctgccacacactggatgttgtgctgtggagaccgtggtgttcacacctttattgacacccggatgaaacacccactgcgggtgtgtggggaggaggcacagctctgcctccatgaggaaatgagcccaagtgctgagtctgagtggccacatggcagtggtttctgttctgtttttgagcacggctcaggttctctgggatgag

SEQ ID NO: 151166 - DNA, 601 bp, Human
cactttgggaggccgaggcaggtggatcacctgaggtcaggagttctcgaccagcctaacatggtgaaacctcctctctactaaatacaaaaaaatgagccgggcgtggtggcacatgcctgtaatctgagctacttgggaggctgaaacaggagaatcgcttgtacctgggaggaggaggttgtggtgagccgagattgcgccattacactccagccactgggcaacaagagcaaaactctgtctccaaaggaaaaaaaaaaacactagacagcaaggacccattcaccagctggaagtyggggggacctggcctgtggctccacccagcacagggagagagcctggtgctccttccggctcatatgcgcggtggttctcctctaggtcaccatggctttgtcattggttactccctctttctaaggcgccctcttgtttggtgggcagtattgggtgggtccccccacagcttcgtgaggtgggctagaggagctgggcatcgggtcagtgccccggcctgctgggggccctgtggggccgcgtgtgccccggtgcctggaaggccgactctcttgacagcaggtcttctctccaaacg

SEQ ID NO: 151167 - DNA, 601 bp, Human
cgggtcagtgccccggcctgctgggggccctgtggggccgcgtgtgccccggtgcctggaaggccgactctcttgacagcaggtcttctctccaaacgtatccacccagccaggtgtctgccatggggctgcttagagtcggccacaaaatcaacccgtgtgcagggtcagtggcttggcattgggctttggggcctgtccctgtggctggcagcctgcctgctgcccggtccacgcctctgttgccttggatttgggttctgagtgaatgcagccttgcctcttggaccgtcctgtgagrcgggcagctctccacctgcgtcctcagcactgcgcccttgttgcaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccggtgagcgcctgcacaggacagcagggcagcacggagaaacccgggcccaaaacactgctgggaacgtgccagcttggcc

SEQ ID NO: 151168 - DNA, 601 bp, Human
ctgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttscgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaa

SEQ ID NO: 151169 - DNA, 601 bp, Human
cacgtagaagctggagctgtcctggtagccaaagatgaagcccgcatagtcgtcatccgtgaccgtgttcacatggaacgtgccctcgaagtccacgccattgaaggcagtgtaacctagggatggaaagagagcagtggcctttccgaacgccagccccagcccccggaacctggcacccagaacccaaacctgccccctgggtcccgatctgcctgcagacctgcaccattcccactcgcagagcccggactcagccacgccccccatctaccattggccacgcccctccagagtccasctccacttggccccgcccttcccgagcccgcccctcctctggccccgcgccttctcctcccgggcccgcccatataaccccgcccctctgtccccgcccttcctgagcccgggccagcccccttctggccccgcccattctcagcccgggcctgccccttctctggcccctctccctgagcccgctccgtggcaggatagcgctgctccccgcttctcacccacagccaggcctgggtcgctgttcattgtctgcacgatctcccttccctgatggggtcaaagaaaggagggcctcagg

SEQ ID NO: 151170 - DNA, 601 bp, Human
ccaatacgtttgctccatctgcttccacatgaccacgtagaagctggagctgtcctggtagccaaagatgaagcccgcatagtcgtcatccgtgaccgtgttcacatggaacgtgccctcgaagtccacgccattgaaggcagtgtaacctagggatggaaagagagcagtggcctttccgaacgccagccccagcccccggaacctggcacccagaacccaaacctgccccctgggtcccgatctgcctgcagacctgcaccattcccactcgcagagcccggactcagccacgccccccatctaccattggccacgcccctccagagtccacctccacttggccccgcccttcccgagcccgcccctcctctggccccgcgccttctcctcccgggcccgcccatataaccccgcccctctgtccccgcccttcctgagcccgggccagcccccttctggccccgcccattctcagcccgggcctgccccttctctggcccctctccctgagcccgctccgtggcaggatagcgctgctccccgcttctcacccacagccaggcctgggtcgctgttcattgtctgcacgatctccctt

SEQ ID NO: 151171 - DNA, 601 bp, Human
cccagaggagggctgggacagctttgaggtccatagtatgaggctagggggctggggggctctaagggctgtaaagggttttacggagggtcatgggagggcatgaggaccgcagaggtcaggcacggacggccctggcaccttgagttggatgccaggctcggccacagcacggaaggggttcgcctgccaatacgtttgctccatctgcttccacatgaccacgtagaagctggagctgtcctggtagccaaagatgaagcccgcatagtcgtcatccgtgaccgtgttcacatggaaygtgccctcgaagtccacgccattgaaggcagtgtaacctagggatggaaagagagcagtggcctttccgaacgccagccccagcccccggaacctggcacccagaacccaaacctgccccctgggtcccgatctgcctgcagacctgcaccattcccactcgcagagcccggactcagccacgccccccatctaccattggccacgcccctccagagtccacctccacttggccccgcccttcccgagcccgcccctcctctggccccgcgccttctcctcccgggcccgcccatataac

SEQ ID NO: 151172 - DNA, 601 bp, Human
gcctgtggaagacttcacagcctgccaatacccaggaaaggtggtcagagacctcgtgggccaccggagcccccctagacaccttcctggagagacagttgggagcagcaggtggtgggcggccagggggatccggatgagagacccacaaggaagccttcttcaggggccaaatggcagcttggggataggtcacagggggcagcagtggtctgcaggttcatgagaggatttgggagtccgtggacagattcagggtctgggaggatggggggctctgcagaaggacttggaaactaargaaaagtttagggctgtgtgagagggtttagggtccataggaagactggggggccctgagaatgtttgagaatttgtgcaaggaactgggaggatttggggactgcgggagcccagaggagggctgggacagctttgaggtccatagtatgaggctagggggctggggggctctaagggctgtaaagggttttacggagggtcatgggagggcatgaggaccgcagaggtcaggcacggacggccctggcaccttgagttggatgccaggctcggccacagcacggaaggggttcgcctg

SEQ ID NO: 151173 - DNA, 601 bp, Human
acacagcccctgcctggccagggcactcccacctgggcctgtgtgtccccagcccagcccaccacagagggtggagtccccacctgatgtagcccacttggggccggtgctgcaggaaccaacgataggacttcttgtccttccaacccacgtttcgcgggtccttccacagcagccgcacctgggactctgtgtctcctgtatgccacagagcgttccgcagctgttccccggggcctgtggaagacttcacagcctgccaatacccaggaaaggtggtcagagacctcgtgggccaccrgagcccccctagacaccttcctggagagacagttgggagcagcaggtggtgggcggccagggggatccggatgagagacccacaaggaagccttcttcaggggccaaatggcagcttggggataggtcacagggggcagcagtggtctgcaggttcatgagaggatttgggagtccgtggacagattcagggtctgggaggatggggggctctgcagaaggacttggaaactaaggaaaagtttagggctgtgtgagagggtttagggtccataggaagactggggggccctgagaatgt

SEQ ID NO: 151174 - DNA, 601 bp, Human
aacagagcacctgggcttgctagcagcatggaatggaggctgagaaacagggactgggtgaggccccatttctagctggatacacactgtgtgctgtgtcctggccagggtctcgctctgtcacccaggctggagtgcagtggtgcaattactgccaccttaattcccagactcaactgacctcagcctccctagtagctgggaccatgggcacgtgccaccatgcctggcatttttttttttttttgagacagagtctcactcttgtcacccatgctggagtgcaatggcacgatctccrctcactgcaacttccgcttcccgagttcaagcgattcttctgcctcagcctcctgagtagccgggatgacagggccccgccaccacacctggctaatttttgtatttttagtagagatggggtttcaacatgttggccaggctggtctcaaactccggacctcaggtgatccacccgcctcggcctcccaaagtactgggattacaggcatgagccactgcgcctggcctaatttttttcttttttgtagagacagggtcttactatgttacccaggctgcctcgaactcctgggctcaa

SEQ ID NO: 151175 - DNA, 601 bp, Human
gcctcagtttcctggtgtggtggacatcaagggccctggacatagttggtgctaaacagagcacctgggcttgctagcagcatggaatggaggctgagaaacagggactgggtgaggccccatttctagctggatacacactgtgtgctgtgtcctggccagggtctcgctctgtcacccaggctggagtgcagtggtgcaattactgccaccttaattcccagactcaactgacctcagcctccctagtagctgggaccatgggcacgtgccaccatgcctggcatttttttttttttttgagacagagtctcactcttgtcacccatgctggagtgcaatggcacgatctccactcactgcaacttccgcttcccgagttcaagcgattcttctgcctcagcctcctgagtagccgggatgacagggccccgccaccacacctggctaatttttgtatttttagtagagatggggtttcaacatgttggccaggctggtctcaaactccggacctcaggtgatccacccgcctcggcctcccaaagtactgggattacaggcatgagccactgcgcctggcctaatttttttctttttt

SEQ ID NO: 151176 - DNA, 601 bp, Human; identical to SEQ ID NO: 31341

SEQ ID NO: 151177 - DNA, 601 bp, Human; identical to SEQ ID NO: 31342

SEQ ID NO: 151178 - DNA, 601 bp, Human; identical to SEQ ID NO: 31343

SEQ ID NO: 151179 - DNA, 601 bp, Human; identical to SEQ ID NO: 31344

SEQ ID NO: 151180 - DNA, 601 bp, Human; identical to SEQ ID NO: 31345

SEQ ID NO: 151181 - DNA, 601 bp, Human; identical to SEQ ID NO: 31346

SEQ ID NO: 151182 - DNA, 601 bp, Human; identical to SEQ ID NO: 31347

SEQ ID NO: 151183 - DNA, 601 bp, Human
aacaactattacagacagagttttatttaaaaagagttaatttgtaagatttttaggccgggtatggtggcttatacctttaatcccagctctttgggaggctgatgtgagaggatcacttgagcccaagaattgtttgagaccagcctgggcaacatggcaaaaacccatctctacaaaaaatacaaaaaaattagttgggcatggtggtgcatgcctgtagtcccagttactcaagaggctgaggctggaggattgcttgagctgagattataccactgcagtccagcctgggtgacaragtgagacccggtctcaaaaaattttttttttttttttttttttttttagttttaaaggttataaatatatgaatatgttgtttccagagtagttcagttatttgggggaatagatgggagaaaatgtgattatatttacatgatttctttttttttcaggtaacagactgggttgacccatcatttgatgattttctagagtgtagtggcgtctctactattactgccacatcattaggtgtgaataactcaagtcatagaagaaaaaatgggccttctacattagaaagcagcagatt

SEQ ID NO: 151184 - DNA, 601 bp, Human
tttttaggccgggtatggtggcttatacctttaatcccagctctttgggaggctgatgtgagaggatcacttgagcccaagaattgtttgagaccagcctgggcaacatggcaaaaacccatctctacaaaaaatacaaaaaaattagttgggcatggtggtgcatgcctgtagtcccagttactcaagaggctgaggctggaggattgcttgagctgagattataccactgcagtccagcctgggtgacaaagtgagacccggtctcaaaaaattttttttttttttttttttttttttagttttaaaggttataaatatatgaatatgttgtttccagagtagttcagttatttgggggaatagatgggagaaaatgtgattatatttacatgatttctttttttttcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggt

SEQ ID NO: 151185 - DNA, 601 bp, Human
gcgagaaaaagaggaaatctatcttccttagaacagatttatggtttagaaaattcaaaagaatatctgtctgaaaatgaaccatgggtggataaatataaaccagaaactcaggtactgaaaagcatgcagacatatctacataatttaatttcagggtgcataagggtagatgggaagcagagggatttacattttcagattttttactcataagaatctttctaagtgttagaaaaaattctggatttttttattttccaaggcttagatttttctcaatagttattctaaagttgtrtgattagttgtcttagatttaatttaatcccaacatagaattgatctttttaaaaatttttgtactaaatgtaatactcctctctactgtcttctcaaaatgtatttctgaattttaaaaaatgttataactgcaaacttgccaaaattatcatacagaggtatcaacttaagaatataatttttccataatagtataaaaattcaagtataatcaaaaggatcattttattatatagattgttactgatttgctacttcttttcgttaataatgcttaggttcatatgtgctgatgtac

SEQ ID NO: 151186 - DNA, 601 bp, Human
agactcaagttgaacatttttgcaagaataaaggtcatgttgtatgttgtatagggcgtcaaattggaaagtatttgtggttctcctgctgtcttaagtttggtcactagatcaaagagatgaaagtcaaaaatcttcattgtagagtaactttccctcacaactgacacataatccatggggagataccgtggcagcatgtgagtgcccagttctccatcagtcgtccacctaagtgctgtagcttcagtttttcaatccttgcctgaatcacttattttattagagttgtacagtagtractttcttatagttctgttatttctacagttattactggcatttttctacaaagaaaagtttgccatcactagctagggttgtttagttaccttgaaatacatttccaactagaaaggcaggataagttttgtatcttttccttttttaaaaaatagacttatttttggagcagttttaggttcacagccaaattgggtagaaggtacagagatgtacctcatatcccctgccccaacacatgcatagccttctcccgttactaaccttccctcaccagagtagtacatttgttaaaact

SEQ ID NO: 151187 - DNA, 601 bp, Human
ctaggctatatggtatagcctcttgctcctatgctacaaacctgtatagcttgttactgtattgaatactgtaggcaattataacacagtgggaactatatgtgtaaataaacatacctaaagcataccattaaaaagtacagtaaaaaggccgggcttggtggctcaggcctataatcccagcactttgggaggtcgaggtgggtggattacctgatgtcaggaattcgagaccagcctggccaacatggtgaaaccccatctctactaaaaatgcaaaaattagccaggcatggtggtrtgtgcctgtagtcccagctatatgggaggcacaagaatcacttgaaagcgggtggcggaagttgcagtgagctgagacagtgccactgtgccccagcctgggcaacagaacagagactttgtctcaaaaaaaaaatattttttggtaaaaacatggttataaaagataaaaaaaatgctagtatacatttatatagggaacttaccatgaatggagcttggactggaaaatggttaagtcagtgactgtgagtggttagtgacagtctaaggacattactgtgcactattgtagactttt

SEQ ID NO: 151188 - DNA, 601 bp, Human
ttataacacagtgggaactatatgtgtaaataaacatacctaaagcataccattaaaaagtacagtaaaaaggccgggcttggtggctcaggcctataatcccagcactttgggaggtcgaggtgggtggattacctgatgtcaggaattcgagaccagcctggccaacatggtgaaaccccatctctactaaaaatgcaaaaattagccaggcatggtggtgtgtgcctgtagtcccagctatatgggaggcacaagaatcacttgaaagcgggtggcggaagttgcagtgagctgagayagtgccactgtgccccagcctgggcaacagaacagagactttgtctcaaaaaaaaaatattttttggtaaaaacatggttataaaagataaaaaaaatgctagtatacatttatatagggaacttaccatgaatggagcttggactggaaaatggttaagtcagtgactgtgagtggttagtgacagtctaaggacattactgtgcactattgtagacttttataaacattgtacacttaggctacactaaacttaaacagttttttatttaataaattaaccttcacttactggaactt

SEQ ID NO: 151189 - DNA, 601 bp, Human
gaaggtcttcagaggcaacaacacgtaaggagctgtcatctcttatgacaacagtgccttcttctgcagtacctcctgaaggacttgcctgaggctgttttatagttaacttcttttttttttttttgacagagtttcactcttgttgcccaggctggagtgcagtggtgcaattttggctcactgcaacctctgcctcccgggttcaagcgattttcttgcctcagcctcctgagtagctgggattacaggagtgcaccaccacgcccgggtagttcttgtatttttagtagagatgggstttctccatgttggccaggctggtcttgaactcctgacctcagatgatctgcctgcttcggcctcccaaagtgctgggattataggcgtgagccactgtgcccggccaacttttttttttaaaaaacaagtagattctaataataaagatgggcactgtaaatacataaaccagtaagatagttgtttattataattatcaagcattatgtgttacacataatgagatatacgtgttacacttttatacagcacagtaggtgtgtgtacaccagcattaccacaaacatgagtgatgttt

SEQ ID NO: 151190 - DNA, 601 bp, Human
aaaaagaacttgccccccaacaagatagcttagatcagtaagtacctgttagaacaatatcaaatgaaagcaaaagacaaagatgtctttggaatttggaaggaggccttaagataacgatttaaaaattgataatagtaacaattttatttatttttattttttttgagacagagtctcactctgtcgcccaggctggagtacaacctctgcctcccagactcaagctattctcatgcctcagcctcctgagtagctgggattagaggcatgtgccaccacacccagctagtttttgtayttttagtagagatggggttttgccatgttagccagtctggtctcgaactcctggcctcaagtgatccacctgcctctgcctcccaaagtgctgggattataggcgtgagctaccatgcgtggcaatagtaccaatttaaagatgtaatacgttataagttcatgcatatgcttatgtaccttagcactatcatttttatctttcatagtttttcatattgcaactccaggtggtgaaactagggatagccaaatctcctaggccattttgaagggaaaagggttctgtagaaggataatt

SEQ ID NO: 151191 - DNA, 518 bp, Human
cctcctgggttcaagcaattctcctgactcagcctcccaagtagctgggattacaggcgtccaccaccatgcccggcttatttttgtattttttagtagagatggggtttcaccacgttggtcaggttgttttcgaacccctgacctcaggtgatccaaccacctcggcctccaaaagtgctgggattacaggcgtgagccaccacgcccggcccattattattatcatttttttaagagagaaagtctcactatattgtctagaatgaacttcttaagcatttaagggattctcacgacycaacctctggggtagctgggactacagacgtgtgttcctgcatctggcttttactgctttctaaatagtagcattacttttgacagtctgataagctttaacttaaacagtcttcaatatgaaacatgccttcagagagcttccctcattctcaagttcactaatcagttattctgtttttgttgttaaactttatcactccagcctgaccaacatg

SEQ ID NO: 151192 - DNA, 357 bp, Human
acctcggcctccaaaagtgctgggattacaggcgtgagccaccacgcccggcccattattattatcatttttttaagagagaaagtctcactatattgtctagaatgaacttcttaagcatttaagggattctcacgactcaacctctggggtagctgggactacagacgtgtgttcctgcatctggcttttactgctttctaaatagtagcattacttttgacagtctgataagctttaacttaaacagtcttcaatatgaaacatgccttcagagagcttccctcattctcaagttcamtaatcagttattctgtttttgttgttaaactttatcactccagcctgaccaacatg

SEQ ID NO: 151193 - DNA, 601 bp, Human
aattttttaattttttttagagacagggtctctctgtgttgcccaggctggtctcgaattcctggctcaagtgatcctccctcctcggcctctgaaagtgctgagatttcaggcatgagcctctgtgcccggcttcttttcacttttagtacgtcattttttctgtatttcaaatcaagatgatgttaaaaaaaaattgatggaccttctgctcccagcgtcatggttttagggaatcctattggtataaatcaaccaaatcttgcatgaaacataatttttgttgcactgctaggaccayaggaactgagggaaatatccaagggagaggttgttttgaggattaaatacgttagtgtagagcacctaactgaataaataacagatattaatagtgaaaaatgagaaacaaactgagtccaataatacaggaagcaattactgtgatgaattattatgctattagtgttttgaaaatatttaatgggtcaggtgcggtggctcacgcctgtaatcttaacactttgggaggccgaggtgggtgtatcacctgaggtcaggagttcatgaccagcctggccaacaggtgaaaccccatctc

SEQ ID NO: 151194 - DNA, 601 bp, Human
ctgtattcccagctactcagaagcctgagacaggatgatcgctggagcctaggagtttgaggctgcagtgatctagatgaaatgactgtagtctgtcatggacagagctagaccctgtctctaaaaaaacatctacattctctactataagcatgagaactgcaaattgagccatggtgcatgcctgtagtcccagctacaaaggctgacagtggtgggaggatttgttgagcctgggagctcaagaccagcccaggtgtgatatagtaagaccttgtgtcaaaacaaaaattttttttttagtgaattgattagttcaagtggctctggtttaaaaaagaagaagaagaaataattggtgtaattatggctttttcatcctcaccagactgtataatgtataaccccagtaaaggaattttcatgtaaatttcataaattagttagattattttgtgtatatttaattttatcacagtctgttgcattttgagggtttttttgtgtgtacacatatatgttgttatatatctgtgtgtatgtagtgagaaagagtaaaaacttcaaaatacaacctggtcaaagtgaaaaagtaaaataa

SEQ ID NO: 151195 - DNA, 601 bp, Human
aaaattaaatatatacacatgcatacatacccttctatgaatatgtcgtagtatatatccttgtttctgtttgagatagtttacctttcaaagttaacttagaaccagatttcctggataaaaattctgcctctgccacttaccagttatataggcctatgcaggtgactcttatctttctgtgcctctgttttctcaccttttatgtgagcacttacctcttagggttctatgaagaatatgtgaggtgacactattatagagtgcttcttacagtacttgattcatattaagtgttcaataaatggccagccattaatcagtttaataatactgtgcagaggtaggtttacttttggaattattattatttattttgagacggagtctcgctctgccgcccgggctggagtgcagtggcatgatcttggctcactgcaagctccgcctcccaggttcacagcattctcctgcctcagccttctgagtagctgggactacaggcagctgccaccacgcccagctaattgtatttttaatagagatggggtttcactgtcttagccaggatggttgctatctcctgacctcgtgatccgcc

SEQ ID NO: 151196 - DNA, 601 bp, Human
aatatgtcgtagtatatatccttgtttctgtttgagatagtttacctttcaaagttaacttagaaccagatttcctggataaaaattctgcctctgccacttaccagttatataggcctatgcaggtgactcttatctttctgtgcctctgttttctcaccttttatgtgagcacttacctcttagggttctatgaagaatatgtgaggtgacactattatagagtgcttcttacagtacttgattcatattaagtgttcaataaatggccagccattaatcagtttaataatactgtgcmgaggtaggtttacttttggaattattattatttattttgagacggagtctcgctctgccgcccgggctggagtgcagtggcatgatcttggctcactgcaagctccgcctcccaggttcacagcattctcctgcctcagccttctgagtagctgggactacaggcagctgccaccacgcccagctaattgtatttttaatagagatggggtttcactgtcttagccaggatggttgctatctcctgacctcgtgatccgcccgccttggcctcccaaagtgctgggattataggtgtgag

SEQ ID NO: 151197 - DNA, 601 bp, Human
aaggtgggtggatcacttgagcctaggagtttgaaaccagcctgggcaacatagcaagaccttgtctctacaaaaaaattaaggaaaaaaaataaaaacccaagaaatgtgatcacatgcatattcataaattggatactctcaacatcaatagagaggttgttaaacatagattgcagaaccaggctgcctggattccagtcattcactcactgatgaccttgagccaatgactttacctctttgtatctcatttcattaactgtctaataataattggtcaggtgcagtggctctcgcstgttatcccaacactataggagactgaggtggaagaaagcttcaacctcaagagtctgataccagcctgggcaacatagcgaggcctcgtctctaattaaaaatatatatatatatagccagcatggtggtgcatgtagtcccggctacttgagaggctgaggtgggaggatcacttgagcctggaggttgaggcttcagtgagctatgattgtgccactgtactccagcctgggtgatagagccagaccctgtgtcaaaaaaaaaaaaaggccgggcatggtggctcatgcctgtaatc

SEQ ID NO: 151198 - DNA, 601 bp, Human
taataattggtcaggtgcagtggctctcgcctgttatcccaacactataggagactgaggtggaagaaagcttcaacctcaagagtctgataccagcctgggcaacatagcgaggcctcgtctctaattaaaaatatatatatatatagccagcatggtggtgcatgtagtcccggctacttgagaggctgaggtgggaggatcacttgagcctggaggttgaggcttcagtgagctatgattgtgccactgtactccagcctgggtgatagagccagaccctgtgtcaaaaaaaaaaaaaggccgggcatggtggctcatgcctgtaatcccagcacttggggaggccaatttgtgtggttgggaggttgtgaccagcctggccaacatggtgaaacctcatctctgctaaaaatacaaaaatttagccgggcatacacctgtaattctagctgctcgggaggctgaggcaggagaatcgcttgaacccaggaggcagaggttgtggtgagccgagatcacaccactgcactccagcctgggcaacagagcgagactccatctcaaaaaaaaaaaaaaaaaattctcccttcacagggtt

SEQ ID NO: 151199 - DNA, 601 bp, Human
tgtgtcaaaaaaaaaaaaaggccgggcatggtggctcatgcctgtaatcccagcacttggggaggccaatttgtgtggttgggaggttgtgaccagcctggccaacatggtgaaacctcatctctgctaaaaatacaaaaatttagccgggcatacacctgtaattctagctgctcgggaggctgaggcaggagaatcgcttgaacccaggaggcagaggttgtggtgagccgagatcacaccactgcactccagcctgggcaacagagcgagactccatctcaaaaaaaaaaaaaaaaaattctcccttcacagggttgttatgaagattaaattcctatgtattacatgccaagaacagtatcttgcacataacacgatgagaaaccaaggcgatgtgactgtacaggttgaatatcctttatttgcaatttttgggaatagaaggattgcagatttttttaagattttggaatatttgcattatacgaattgaaaatcccttgtctgaaaatctgaaatacaaagtgctccaatgagcatttcctttgagcatcatgttggcactgcaagtttcatattttggagtattttggagttt

SEQ ID NO: 151200 - DNA, 601 bp, Human
tcttaaaatggaaataaaatgtcacttttaaaaaaatgtcatgtattttggttctgctctaagagttagagctaggtcagatactgtttgcctaggcctaagacatagtaggaaatcagaatattttctgaccgtaagcaggattaaaagtaaaaacatgcaattgcaggccatatccatgtgtgtaaatctttaaaattatagtttgctgaaggtaagagagcagatcatctagacttgtagtggcaagtgttggtagcctaaagccctcttaacactgggctccagccaacagagcctyatacaaattaccaggtagtttaaggtttctttcaatcgtcttgtatttctctaatttacaagcgttctgtctccccaaccagagatgtttatcgccttttctgtcttttttgatgactgctccccctcagttctttcactccctattgcccattttagtgtcccaaataatccctccttttgatagcaaatgcctgttttcagtctgatgaccctaaaggaaagaaattaggatttctaaatggaaaccttcataccatctgaggaaaatgggcatcacttaggtggcagtgaggacact

SEQ ID NO: 151201 - DNA, 601 bp, Human
cccctcagttctttcactccctattgcccattttagtgtcccaaataatccctccttttgatagcaaatgcctgttttcagtctgatgaccctaaaggaaagaaattaggatttctaaatggaaaccttcataccatctgaggaaaatgggcatcacttaggtggcagtgaggacactcctctgtcactggatcctcttactttgaacctgagtgactattcccacctgattcttttctttctctcctttcttttcctccccaacatacgtttatcgtctcttgcattagtgaatggaatycgtattctttcatgtagagagcaacatcttcctacatagtaaataaaagagtaaagaccactgtattgagatgagaaatcaagggaagaaagcaacccaaagctgaaaaaggtgaaatgggagtgcattaggaaatggaatattttaagtctagagaagccataatctaagcatcagaattgttaatttagttcttgctaatgtggaaaaaataggtgcttgcttccagttgttttttatttatttattattttttaacagtttgttactatgttggtattgtatgtctaaaattttcaa

SEQ ID NO: 151202 - DNA, 601 bp, Human
atttacgtatttgtttctggctgaataattggaaagtattagtaattgcgaacatcgtgacacttaagcagcataaggacattgttctattacaactaccatagcattatcataccccattgaaactaaaatataactagttgatataactggcctctcaaagtgctgggattacaggcgtgagccactgcgcccagctgcatagtcatattttagtttcaattatattttagttatattaactaattagttacattaactaattagttatataattaagttaactttccagagaaacttsacactaatctagcaatatattgtccctattcagatttcctcatttgcctcaaaaatgtattcaaagttgtttcctccacccctgtccaagatccagtcagggtttacacatttaatttgatggctatgtcccagtggaatttgctttagataagtttatagtgctgttatttatagggctgtagtgatgttgaagaaagtgaacacatagaaactaaatacggttagtatttttgtatatatcaggaataccagtaatgctcttttataaatctattttctttcacatcttgtctcattt

SEQ ID NO: 151203 - DNA, 601 bp, Human
aggaggcggagcttgcagtgagctgacatggtgccactgcactccagcctgagagacagagcgagactccatctaaaaaaaaaaaaagaaaatcactaaaacggtagattttaagtgttctcaccacacacaaaaaatatatgtatgtaaggtaatgcatatgttaattggctcaatttagccattctaccatatatacatatttcagaacatcatgttgtatacctataaatacatacagagcttatttgtcaatttaaattaatcaaagaaaggagaagaaatcttggccttgcctctrtatggacaaggtattcacctaatgtgttcttactctccacagctaaaaatgtagatgattgaattatttagaggtaaaaaatgggaggcacacaagttgaaaacaaaatacacaacagttttcaaaatgaattgccaatctttaaaaatcagactaatgattaaaagtcagatatgaatttcggctgggcgctgtgactcacacctgtaatcccagcacttttgggaggctgaggcgggcagaacacaaggtcaggagttcgagaccagcctgactaacatggtgaaaccccatcgctac

SEQ ID NO: 151204 - DNA, 601 bp, Human
gaggcggagcttgcagtgagctgacatggtgccactgcactccagcctgagagacagagcgagactccatctaaaaaaaaaaaaagaaaatcactaaaacggtagattttaagtgttctcaccacacacaaaaaatatatgtatgtaaggtaatgcatatgttaattggctcaatttagccattctaccatatatacatatttcagaacatcatgttgtatacctataaatacatacagagcttatttgtcaatttaaattaatcaaagaaaggagaagaaatcttggccttgcctctatrtggacaaggtattcacctaatgtgttcttactctccacagctaaaaatgtagatgattgaattatttagaggtaaaaaatgggaggcacacaagttgaaaacaaaatacacaacagttttcaaaatgaattgccaatctttaaaaatcagactaatgattaaaagtcagatatgaatttcggctgggcgctgtgactcacacctgtaatcccagcacttttgggaggctgaggcgggcagaacacaaggtcaggagttcgagaccagcctgactaacatggtgaaaccccatcgctacta

SEQ ID NO: 151205 - DNA, 601 bp, Human
tattgcctgcttgacttctgtaatatctgaattcgtgacccctggactgggtcgtctctgagatgtcttccagttctaaaatcatacagctgaaaattaccctataatttattacctaggacattttttccaacagatttcttggagaatttaatgacttttaagcaatttatatctcattgacttgctttgtcttttatagcatatatattaattttgcattgttgctgcatataaattatctaagactgttagcttcttgaaggcagggattgtgcttttctcttgctcagcataacgggttgactaaagaaaacaaattatttcattgaaaactattttcgtgtaatttatgatgtgtgtgtgctcataaacaattcctttgagttttaaatttggttttcttatacattcaatgtcttttaaaaattgttgtttattaaatgtggaatagttgtgtaggtaaaatactttattaaacgatgctaaaaaaactataaaggactacttaaataagctattaaaagtatatttgtgatatataaacccacaagttaatataaacttattgtgtaagtttatataataaacttagtttgtc

SEQ ID NO: 151206 - DNA, 601 bp, Human
taggagttcgagaccagcctggccaacatggtgaaaccctgtctctactaaaaataaaaaaattagccaggtgtggtggcatgcgcttgtaatcccagctactcgggaggctgaggcaggagaatcacttgaacccaggaggtggaggctgcagtgagccaagatcgcacacctgcactccaggctgggtgacaaagtgaggtctgtctcaaaaaaacaaaaagcatcagatgatacagaaatatataaagagccgaacgtggtggcttatgcctgtaatcccagcactttgggaggccarggctgggaaaccccatttctactaaaaatacaaaaaattagccaggcgtggtggcacgcgtctgtaatcccagccactcgggaggctgaggcaggagaaccttcaaccccggaggcggaggttgcagtgagccaagatcaggccattgcactccagcctgggcgacagagcaagactgtctcagaaaaaagaaaaaagtttctaaagtaaaaattgaaagtacttcccctacaaccacaggttgctttgacagattaatgtaaattcttccagatactcttctgtggatgtagaaacatg

SEQ ID NO: 151207 - DNA, 601 bp, Human
ctgtctcagaaaaaagaaaaaagtttctaaagtaaaaattgaaagtacttcccctacaaccacaggttgctttgacagattaatgtaaattcttccagatactcttctgtggatgtagaaacatgcagaatgaggcaagctttaatttgcttatgtcacttactgtggatagcctttcatatcttataagttaatgtcagagcagcaatctcatttttttccaatttgtaaacattttatttaaccttatgatggatattttggtggatttcagtattacaaaaatgcctattaatagtaattttcattatatttctgttacgaaattataatgctacaaacattactatgcctgtggcagtatacatctgcacaagttttgaaaatgttatgcattcataggcaaaaatgggataacttttgggcagtggtcatgattaatctgttgatcagaatccagagattgcccttctccttgccaattgctttaagagtacactagtttttggccgggtgcagtggctcatgcctgtaatcccagcactttgggaggccaagacgggcggatcacaaggtcaggagatcgagaccatcctggcta

SEQ ID NO: 151208 - DNA, 601 bp, Human
agtatacatctgcacaagttttgaaaatgttatgcattcataggcaaaaatgggataacttttgggcagtggtcatgattaatctgttgatcagaatccagagattgcccttctccttgccaattgctttaagagtacactagtttttggccgggtgcagtggctcatgcctgtaatcccagcactttgggaggccaagacgggcggatcacaaggtcaggagatcgagaccatcctggctaacatggtgaaaccccatctctactaaaaatacaaaaaaaacccacaaaaaacaaaaaaaccaggcctggtggtgggtgcctgtagtcccagctacttgggaggctgaggcgggagaatggcatgaacctgggaggcggagcttgcagtgagccgagattgcaccactgccctccagcctgggcaacagagcaagactctgtctcaaaaaaaaaaaaaaaaaaaaaaaagattacactagtttttaaacttttggtttttttttttgagatggagtttcactcttgttgctgaggctggagtgcagtggcatgatctcggctcactgcaacctccacctcccaggttcaagcgattctcc

SEQ ID NO: 151209 - DNA, 601 bp, Human
ttgaaattatttcaggctgggcgcagtggttcacgcctgtaatcccaacactttgggaggccgaggcgggcggatcacgaggtcaggagatcaagaccatcctggctaaccccgtctctactaaaaatataaaaaatcagccgggcacggtggcaggtgcctgtagtcccagctactcagtgggctgaggcaggagaatggtatgaacccgggaggcggagcttgcagtgagctgagatcacgccactgcactccagcctgggagacagagtgagactctgtctcaaaaaaaaaaaaaaaattattttaaatgtaaggatgcaagaatagtacaaaaaattcttgtatatccttcactaagtttcctgattattacattttttaccatatttgcctgattatattctctctctttataagcatgcacatatatgtattattttgctaaactagtcttgagtaaattgcaggcatgatatcccattattcttaaaaacttaagtctgcacttgccaaaaacaaggacattttcctgcataaccacagtgtgcaatcaaatcaggaaattaacattaataccgtttattttatagtccccatt

SEQ ID NO: 151210 - DNA, 601 bp, Human
agaaaatatttgtaaattatacatctgataaggggttaataatcaaaatatataaggaactcaaagaatgcaatagtaagaaaacaacccaattaaaaaacaggcaattccagcctgggcaacatggtgaaaccctgtctctacaaaaaatagataaaattggccgggcacggtggctcacgcctgtaaccccagcactttggttggccgaggtgggtggatcgcctgaggtcaggagatcgagaccagcctggccaacatggcaaaaccccacctgtactgaaaatacaaaaaattagcygggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaatagataaaattagccgggtgtagtggcacacacctgtagtcccagctacttggaggctgagtgggaggatggtttgagcctgggaagggaaggttgcagtgagccgagatcacgctgctacattctagcctgggggacagagt

SEQ ID NO: 151211 - DNA, 601 bp, Human
aattggccgggcacggtggctcacgcctgtaaccccagcactttggttggccgaggtgggtggatcgcctgaggtcaggagatcgagaccagcctggccaacatggcaaaaccccacctgtactgaaaatacaaaaaattagccgggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaatagataaaattagccgggtgtagtggcacacacctgtagtcccagctacttggaggctgagtgggaggatggtttgagcctgggaagggaaggttgcagtgagccgagatcacgctgctacattctagcctgggggacagagtgagatgctgtctcaaaaggcaaaggaccagatagacatttcttaaaagaagactggccaaaaggtatatgaaaaactgcttaacattaaggcttaacactaatgatcagggaaacacacttaaaaccacaatgagatatcatattacaccagttaga

SEQ ID NO: 151212 - DNA, 601 bp, Human
acaatgagatatcatattacaccagttagaatggccgttaccaaaagataaatgataacaaacgttggctagggtgtggagaaaagggaatcacagagttagtaagaatgtaaattagtacagctgttttgaggaacagtatggaggttccttaaaaaactgaaaataggccgggcgcagtggctcacgcctgtaatcccagcactctgggaggctgaggcgggcggatcacgaggtcatgagtttgagagcagcctggcaacatagtgaaaacccatctctactaaaaacacacacacamaaaaaaaaaacaccaaaaaaactaaaaataggccaggcgtggtggctcacgcttgtaatcccagcactttgggaggccgaggtgggtggatcacctgaggtcgggagttcgagactagcctgaccaacatgatgaaactctgcctctactaaaaatacaaaaattagctgggcgtggtggcacatgcctgtaatcccagctacttgggaggccgaggcaggagaattgcttgaacttgggaggcagaggttgcagtgagccacgatcacgccattgcaccccagcctggcaacaagagca

SEQ ID NO: 151213 - DNA, 601 bp, Human
gttgctgcactccagcctaggtgacagagccagactccatctcaaaaaaaaaaaaaaagaatatgaagtcagtatgttgaagagatatctgccctccctcccagttttattgcagcattattcacaataaccaagatatagcgtcagtctaattgtccattggatgaggaaaacatggtatatatacacagtggaatactattcagccataaaaaagaacaaaatcttgtcatttgcagtaacatggatgaacctggaagaccttatttgaaatgaaataagccaggcacagaaagacaartattgcatattctcacttatataggagctaaaaaagttgatctcataatagtagagcacagaatgggattaccatgggcttgggtggtaggggagttgttgatcaaagaatacaaaattttgttatgtaggaggaataaattcaagaattctattttacaacatggtgactataattaatagtattttgtgtgtgtgtgtggttttgtttctttttttgagtcagagtatcactcttgtcacccaagctggattgtggtggtatgatcacggctcactgcagcctaaacctccttggccc

SEQ ID NO: 151214 - DNA, 601 bp, Human
tcagtatgttgaagagatatctgccctccctcccagttttattgcagcattattcacaataaccaagatatagcgtcagtctaattgtccattggatgaggaaaacatggtatatatacacagtggaatactattcagccataaaaaagaacaaaatcttgtcatttgcagtaacatggatgaacctggaagaccttatttgaaatgaaataagccaggcacagaaagacaaatattgcatattctcacttatataggagctaaaaaagttgatctcataatagtagagcacagaatgggwttaccatgggcttgggtggtaggggagttgttgatcaaagaatacaaaattttgttatgtaggaggaataaattcaagaattctattttacaacatggtgactataattaatagtattttgtgtgtgtgtgtggttttgtttctttttttgagtcagagtatcactcttgtcacccaagctggattgtggtggtatgatcacggctcactgcagcctaaacctccttggcccaagtgatcctcctacctcagtctactgagtagctggtaaccacaggtgcgcaccaccacacttggcta

SEQ ID NO: 151215 - DNA, 601 bp, Human
ataggagctaaaaaagttgatctcataatagtagagcacagaatgggattaccatgggcttgggtggtaggggagttgttgatcaaagaatacaaaattttgttatgtaggaggaataaattcaagaattctattttacaacatggtgactataattaatagtattttgtgtgtgtgtgtggttttgtttctttttttgagtcagagtatcactcttgtcacccaagctggattgtggtggtatgatcacggctcactgcagcctaaacctccttggcccaagtgatcctcctacctcagyctactgagtagctggtaaccacaggtgcgcaccaccacacttggctaatttttgtattttttttttgtaaggatggggttttgccatgttgcacaggctggtcttgaactcctgggttcaagcaatcctcccacctcagcctcccaaagtgctgggactacaggtgtgagctaccacacccaaccaatatattgtattcttgaaaaatgctgagagtgaatgtaaagtgtctttgccacaaaaataataactctgtgaggtaatatatatgttaattagctatagtcattctactatata

SEQ ID NO: 151216 - DNA, 601 bp, Human
gcaccatcttggctcactgcaacctccaattcccaggttcaagcgattctcctacctcagcctcctgagtagcttgaattacaggcgcataccaccacacccagctaatttttgtatttttagtaaagatggggttttactatgttggccagtctggtctcaaactcctaacctcaggtgatccgcctgcttcggcctgtgtagtagaatttttaacaggttaagtatccaaaggtcctcatagtgttagatgtgcaaactttaaaaggttcataaaaattagtaaaagtaagatgttttsgtttttcttatcaatttttatactgtttcttccgcttttatttactatgtcattttcagccattatttctttaaatatttttctgctgctttctgtccttctagtctttcattagggtatgttcacttgaaagtgttccacatttttctgagattttgtttatatttcttctgtcttctatatgtcaatctatgtccaagttttttttttttttttttttttttttttttttttggagacagagtcgccctctgttgtccaggctggagtgcggtagcaccatctcagctcactgcaatc

SEQ ID NO: 151217 - DNA, 601 bp, Human
tttatctgaagtctttttctgttaaatttaatgtgtgagccctcgcaaaggcagtttcttttacccacctttttcttgtgtgtaggtcacactttcctgtttctttacagtcataattttttgttgaaaactagatgttttagggaatatattgtagcaattttggagaatattgattctcctcctctggggcttgtttttattgttgtgtgcttgtttatttgtttagtgacttggctaaactcatgtaatgaagtctgtcttttgcaacatgaagccttcctccctcttcagagagctyatccttggctgtgcccacagtttacttgggatgatggtggttttagcagagctcactttgtctctttccctgatatgtctgtatagctctttgcttcctttgttatcacactgttggctaccctaattacttttttttttttttttttttttttttgaggaaagagtctcgctctgtcacccagactggagtgcagtggtacgatggctgactgcaacctccgcctcctgggctcaagcaattcttatgcttcagcctcctgagtagctgggactacaggcatgtgccaccatccccagc

SEQ ID NO: 151218 - DNA, 601 bp, Human
ataaagtgagttcctttggggaaggcttcggagctttttcctacggactgcctctcctctgggcaaaatctctaagccacttattctgggtgggtgcccagctgcagaggtagcctctgattattttggcttgcctctcccagtgtggaccctctgctatgtaacaagctggggtaagggagactgcagctgggacaggggacagtgcctttgggttagaacctcttatcctatgagtagggccgggtggggaaaggaagccccaaacaccctgctgcactccagtaggaaggagtccttwgttcttggctgtacccacctggaatgaaatgttcatcaagctgagccctctcagctcagggttgggaatgggagggaggagatagtggctcagatgcctcagattcttcctgtttggttttcttgaatagatcttttctcatttgctgtatgctattaggacaatttccagagacttcaaatgattgatttttaaaagttttcaccgattttgcttatctttgggagtgggtacacaagagcttatgctgtcatcctgaaagtttactatgtcattctttttctttttgcatttttaatt

SEQ ID NO: 151219 - DNA, 601 bp, Human
atatctttttgagactctgtttttaattattttgggtatatacccagaagtggaattgttagatcatacaataattccatttttaattttttgaggatgcactatactgttttccacagcagctacaccattttacattcccatgagcaatgcacaagggttccagcttctccacatccttacccacacttcttgttttctggttttttgtaacagtcatcctaatagatgtgaattggtatctcactatggcttggatttgcatttctctaaagattagtgatgttcagcatcttttcakgtgcttattggccatttgtatattttctttggaaaattgtttacaacttttaaaaaatctgtttcagctcagatttcttttatccaagatattggaaggctccctctgaagcgacactttggaaggtaagctgatcatctcaatttccaaaaagctgataatgaaatgtctactgaatatgttcaatatgaatcaataactgttacctgtaacatccaagaaagacatactgtacctagtaatttataaacataattgtattgtagacccttccttttcttaaatataacagcatatctt

SEQ ID NO: 151220 - DNA, 601 bp, Human
atatatatatatatatatatatatatatatattgttcattttattggaaagtagcttctgtgccattatcagtgattaacacaaaacttatatttcagtttgacttagcttatttgtaagatcgaattaagcacttaggaattgtttaaagattttaaaaatggccgggcgtggtggcttatgcttgtaatcccagcactttgggagcccgaggcaggtggatcacctgagataaggagttcaagaccagcctggacaacatggtgaaaccgtgtctctactaaaaatacaaaatttagcygggtgtggtggcacatgcctgtaatcccagctactcaggaggctgaggcaggagaatcgcttcaacccgggaggtggaggttgcagtgagccaagatcacaccattgcaccccagcctgggcaacaaaagcaaaactccatctcaaaaaaaagatttaaaaaaatcttgcttactgaatgcatggacaaaagtaagtgatagaaatggcacctctgactcctcctaccttttctcctatttctggtcccaaatggaaaactcctgtgatgtgagcttattccccctctttaccctccaag

SEQ ID NO: 151221 - DNA, 601 bp, Human
cagtgattaacacaaaacttatatttcagtttgacttagcttatttgtaagatcgaattaagcacttaggaattgtttaaagattttaaaaatggccgggcgtggtggcttatgcttgtaatcccagcactttgggagcccgaggcaggtggatcacctgagataaggagttcaagaccagcctggacaacatggtgaaaccgtgtctctactaaaaatacaaaatttagccgggtgtggtggcacatgcctgtaatcccagctactcaggaggctgaggcaggagaatcgcttcaacccrggaggtggaggttgcagtgagccaagatcacaccattgcaccccagcctgggcaacaaaagcaaaactccatctcaaaaaaaagatttaaaaaaatcttgcttactgaatgcatggacaaaagtaagtgatagaaatggcacctctgactcctcctaccttttctcctatttctggtcccaaatggaaaactcctgtgatgtgagcttattccccctctttaccctccaagattcattaaggcctttgtagtgttaatgtttttttctgtatactggcttagctatgtggggcccatctt

SEQ ID NO: 151222 - DNA, 601 bp, Human
tactaaaaatacaaaatttagccgggtgtggtggcacatgcctgtaatcccagctactcaggaggctgaggcaggagaatcgcttcaacccgggaggtggaggttgcagtgagccaagatcacaccattgcaccccagcctgggcaacaaaagcaaaactccatctcaaaaaaaagatttaaaaaaatcttgcttactgaatgcatggacaaaagtaagtgatagaaatggcacctctgactcctcctaccttttctcctatttctggtcccaaatggaaaactcctgtgatgtgagcttwttccccctctttaccctccaagattcattaaggcctttgtagtgttaatgtttttttctgtatactggcttagctatgtggggcccatctttcctatcgcagaaagaccatgatggatggatcttgaagcatcgtcccactgggatgtgatcagggcttacacatttcataaacactgcttttcttctcacatccctctgaatgaaagcaggaccaagtctctttgatggcttctctccccaaccccctaagattatggcatcaaaataaagacaagtatgttctattgtatttttgctc

SEQ ID NO: 151223 - DNA, 601 bp, Human
cacttcaaatactatttacttagggtgaattcctacaaatgaaattgctggatcaataggtatataccttttggggcttttcctctttattgccaaattgttggcaagaatattttgccagttttgtatccacttacagtgtatcagtatgttcttttctcctaacccttgccaccactgggttttaaaagtatctttgccagtttagaagatgacagtaataggccaggcgcagtggctcatgcttgtaatcccagcactttgggaggctgaggtgggtggatcatctaaggtcaggagytcgagaccagcctggccaacatggtgaaaccctatctctgctaaaaatacaaaaactagctgggtgtggtggtgcccgcgtgtaatccctgctactccagaggctgagacaggagaatcgcttgaacctgaagtggaggttgcagtgagccaagatcgtgctactgccctgtagcctgggtgacagagcaagactgtctcaaaaaaaaaaaagatgacagtagtagctcattatgttaattttcatttttaaaattacaaattagatttaacaatttaggaaccatttgtatttgtttta

SEQ ID NO: 151224 - DNA, 601 bp, Human
taaactgagattgcaccactgcactcctgcctgggcgatagagaaagacagtctcaatgaaaaaaaagaaaaaagaaaaattctttactgaagacattatttctttttatttttaggtgtttttgttgttgtggtttggtttggtttttttgtttgtttgttttttgtttggagacagagtcttgctctgtcgtacaggctggagttcagtggcacgagcttggctcactgcagcttctgcctcctgggttcaaacaattctcctgcctcagcctcctgagtagctgggattacagatgcrtgccaccacgcctggctaatttttctattttcaatagagatgggtttttgccatgttggccaggctggtcttgaactcctggcctcaagtgatctgcctgccttggcctcccacagtgcagatagtacaggcatgagccaccgtgttcagctcctttttgtattttaagttgtaggaacttattcagtttgtcatttaccttgtagttttgtttttatagttaaagggactagctaaacagcacaatgtaggtaaatgaaagatggcttcataatcatcacactcatggtgtaatttaaa

SEQ ID NO: 151225 - DNA, 601 bp, Human
tggtttttttgtttgtttgttttttgtttggagacagagtcttgctctgtcgtacaggctggagttcagtggcacgagcttggctcactgcagcttctgcctcctgggttcaaacaattctcctgcctcagcctcctgagtagctgggattacagatgcatgccaccacgcctggctaatttttctattttcaatagagatgggtttttgccatgttggccaggctggtcttgaactcctggcctcaagtgatctgcctgccttggcctcccacagtgcagatagtacaggcatgagccaycgtgttcagctcctttttgtattttaagttgtaggaacttattcagtttgtcatttaccttgtagttttgtttttatagttaaagggactagctaaacagcacaatgtaggtaaatgaaagatggcttcataatcatcacactcatggtgtaatttaaaaatcttctcctttggttcttattaatgcctgcactgtgaatctgacagattgaaaatggaagccctgactgacagggaacatggaatgatagaccctgacagcggagatgaagcccagcttaatggaggacattctgcaga

SEQ ID NO: 151226 - DNA, 601 bp, Human
ggcaggagaatcgcttgaacctgggaggcagaggttgcagagagctgaggtcatgccactgcactctggcctgggcaacagagactcagtcacacacgtgactttatgccattattgcagggacaaaacaggactgcatgtgaatgtatccaccttagaagcaaacagctatctgaataacagcttcaaatctttctcagcctgagattttttactaataagcatatccacatcaaataattttgcatattttaagcaaaattggaaaatcactaaaataaatttaacctttacacttgawttaaaaactgccaaaaaagtttaatcaatcttacttttgatacattggattcttctgggcaagtttttcaggaagaccatcttcatcatctagttgttcaagtggttccacaatgactggacgaggagttctaataacaaaaatggttccatcttagctttgttccagttttattgccaccattctcatataagttgatagaaattattagaataaacaagacaacttacgtcgtcagtaagaaaacaccttcactgcatcgttcaaatgcctttcttgctgctggcttagaagcaaatt

SEQ ID NO: 151227 - DNA, 601 bp, Human
agatcaaatgcacaccattagtatgcttaaaaattgttgatttttgctactctgtagcaaaatggagatgtcagttgattttagaaggtatacctacagacaggcccaacaggtgggaaacgacgagtcaaaacactcaattcccttttcataggatagaagccacaccaaatataggtcaaagtcctacacatcactaaaacgtgcctaaagcttcaaactacaagtctgattcctacttatggcaaataccagcttaaagaatgagtttgccatttgattattctcacttggatgtagmataatcagatacattatctagcatctagaatttggatttgccatgcactagagttcaaaagcacctaaatctacttattgccaaaggtaattccacataatactaacagcattgactccttgttggcaaccgttatctgtttaggttaccacacaccgagttcttctatgttgccaaagtattcctcaatattacatatttatgtatgaaattggtaggggaaactaaaagaggtccagtcacctacttaaaaaaacaaaacaaaacaaaacaaacacacctaagttgtgaaaatgagaa

SEQ ID NO: 151228 - DNA, 601 bp, Human
tcacagctgaaacatgatagcatcaagaaggttcagatcaaatgcacaccattagtatgcttaaaaattgttgatttttgctactctgtagcaaaatggagatgtcagttgattttagaaggtatacctacagacaggcccaacaggtgggaaacgacgagtcaaaacactcaattcccttttcataggatagaagccacaccaaatataggtcaaagtcctacacatcactaaaacgtgcctaaagcttcaaactacaagtctgattcctacttatggcaaataccagcttaaagaatgcgtttgccatttgattattctcacttggatgtagaataatcagatacattatctagcatctagaatttggatttgccatgcactagagttcaaaagcacctaaatctacttattgccaaaggtaattccacataatactaacagcattgactccttgttggcaaccgttatctgtttaggttaccacacaccgagttcttctatgttgccaaagtattcctcaatattacatatttatgtatgaaattggtaggggaaactaaaagaggtccagtcacctacttaaaaaaacaaaacaaaa

SEQ ID NO: 151229 - DNA, 601 bp, Human
accagtgggtcctgcctgtctagactgccccaggcttcatttcattttatagcttccttagtatctttagtgagggcaaaataaaaggaagtgaaggtacggatgtgtgtgtaattgtgtgtgtgtgtcagacagagaaagaaaatgagggggaaagaaggtcagagacagagaatgagaaagacagagaatgaatgagaaagatagtgtgagggagagcatcagcaagagagagagagtgaaagtgagagagatcatcagtgagagagagagaaagagagaaagagagcatgcacaagtrcacggcacagagcagagacagagtaaaaggcagtatgaggccaacatgcctcatttatatttctcatatatagcctttttaaaaaaaaaccatttgtatctgttgttcaatactccaaataaattgactgcagaatttgctgtagtaactctttgtgcaaataaccctgtgaggaaggtagaaaaggggtcacctccaactggacaatgaacccatcaagttccagaaacataaagttacttgccaagaacagctgattaatgtgtagcagagctcagaccagagcttcattccagaagc

SEQ ID NO: 151230 - DNA, 601 bp, Human
gtgggtcctgcctgtctagactgccccaggcttcatttcattttatagcttccttagtatctttagtgagggcaaaataaaaggaagtgaaggtacggatgtgtgtgtaattgtgtgtgtgtgtcagacagagaaagaaaatgagggggaaagaaggtcagagacagagaatgagaaagacagagaatgaatgagaaagatagtgtgagggagagcatcagcaagagagagagagtgaaagtgagagagatcatcagtgagagagagagaaagagagaaagagagcatgcacaagtgcacrgcacagagcagagacagagtaaaaggcagtatgaggccaacatgcctcatttatatttctcatatatagcctttttaaaaaaaaaccatttgtatctgttgttcaatactccaaataaattgactgcagaatttgctgtagtaactctttgtgcaaataaccctgtgaggaaggtagaaaaggggtcacctccaactggacaatgaacccatcaagttccagaaacataaagttacttgccaagaacagctgattaatgtgtagcagagctcagaccagagcttcattccagaagcttca

SEQ ID NO: 151231 - DNA, 601 bp, Human
taaaaggaagtgaaggtacggatgtgtgtgtaattgtgtgtgtgtgtcagacagagaaagaaaatgagggggaaagaaggtcagagacagagaatgagaaagacagagaatgaatgagaaagatagtgtgagggagagcatcagcaagagagagagagtgaaagtgagagagatcatcagtgagagagagagaaagagagaaagagagcatgcacaagtgcacggcacagagcagagacagagtaaaaggcagtatgaggccaacatgcctcatttatatttctcatatatagcctttttwaaaaaaaaccatttgtatctgttgttcaatactccaaataaattgactgcagaatttgctgtagtaactctttgtgcaaataaccctgtgaggaaggtagaaaaggggtcacctccaactggacaatgaacccatcaagttccagaaacataaagttacttgccaagaacagctgattaatgtgtagcagagctcagaccagagcttcattccagaagcttcatcacttgacccccgggctaatccttggtgggtcttcagtctctccctttgcctctctgtgtgccccaaaccaattcc

SEQ ID NO: 151232 - DNA, 601 bp, Human
ttttttatagatgaggagacagacacagagaggttaatcaacttgtcgaaggtcccaagttagattacggcaaagctggatttgaatccaggcagtctagtgcagcttctgtgctcttaagtagtagtttgtctagcagcttctctgagcctccctccagcccaacacacaacacaaaagcaactgaatttagtctacatgaaacacttgccaagtccacagtgccttggagaaggagggagctaagactccatcaaaaattgcgcttttctggtctctctagatccatggaaactcaccrgggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtcctgcctgtaaccca

SEQ ID NO: 151233 - DNA, 601 bp, Human
gtctctctagatccatggaaactcaccggggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcagragagcaaatggtcctgcctgtaacccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacc

SEQ ID NO: 151234 - DNA, 601 bp, Human
tggaaactcaccggggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtccygcctgtaacccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatag

SEQ ID NO: 151235 - DNA, 601 bp, Human
ggaaactcaccggggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtcctrcctgtaacccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagc

SEQ ID NO: 151236 - DNA, 601 bp, Human
caccggggaagagtcattttctatcggctttggacttctgctatgaaatggcaattcctttgagccagtctgtctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtcctgcctgtawcccaggaaggaatttctccagccttgaatttttcattctgaatttcgctctcactgttctttggcctttgtgggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagctgtaaaa

SEQ ID NO: 151237 - DNA, 601 bp, Human
tctaaagtcggcagcaaaggagaagcagatgaagggagtagaaaaggtagaggtggaaatacaaccagagaaaattccactctcgggctgacacccacctcctccccagcagcctcttccctgcctccaccattccagggccttcttggagttgcctgacagtgggaaggggctgggagtagacaaaacaaggcagaggcatcaggagagcaaatggtcctgcctgtaacccaggaaggaatttctccagccttgaatttttcattctgaatttcgctctcactgttctttggcctttgtkggcattttcagttaaactggcttattcttactctttctcagaaaagttgattctaaacagctattcctgcacctggggtacagggtacaaaaatggcaggtggaatgggcaggtttgagccttcactagaaaattgactttagatctgtcccttaacctctctgagcctcagtttcctcaccaataaagtgggactcagaatacctacctcacgagatagctgtaaaaggaaataagcaagctgtgagccgtatgcagattataaagcacaaatgagtgtagagtatttatctgagctcc

SEQ ID NO: 151238 - DNA, 601 bp, Human
gctgcccttggctagacattagacagctgagatgttagttcattggtggctaactcattttcagcattgctatctgctttttatgatatctgataaaagtttctcaatgaaattaatcatttaagcccatctgcaattcctgagtaatggctccactctcctcccagttgcccaagcaggaaactgtaagggtgattttgtctccttttcctctcatcccagctccagtaggtaccaggaccttcaaggtgaggtctgaaattcaaacctggagtgcatctctcccctcctctgcttccastgctggaccctggttccagtcctcatctaaactttggcacagacattctgattaatctcttgatcacctggctttctcatttcccctataccagtctgttttatatcctcaagccaaggtaaacttcctacgccacaactctgcgtctgtttatcttttattattattactattattattattattattattattattattattttgagacagggtctttctctgccactgaggctagcatgcagtggcatgatctcaattcactgcaacctccacctcccagactccatccatcctcct

SEQ ID NO: 151239 - DNA, 601 bp, Human
gcttccactgctggaccctggttccagtcctcatctaaactttggcacagacattctgattaatctcttgatcacctggctttctcatttcccctataccagtctgttttatatcctcaagccaaggtaaacttcctacgccacaactctgcgtctgtttatcttttattattattactattattattattattattattattattattattttgagacagggtctttctctgccactgaggctagcatgcagtggcatgatctcaattcactgcaacctccacctcccagactccatccwtcctcctgcttcaggtttgtgattagctgggactataggcacataccatcacgcccagctaatttttgtaattttagtaaagacagggttttgccatgttttccagccagacctccacctccagaaatcaagtgattcaccacctcagagtcccaaagagctggaattacaggaatgagccactgcacccggcctgtttctctacttattccaacataaataagggtttttctttgacatggtgctggagacccaaaatcataattctatacatgattcctcatcgcctacagaattaaa

SEQ ID NO: 151240 - DNA, 601 bp, Human
catacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcragggaagacactccagatacctccatgagctttgcttccacacagctcaggtgatgctgacaggtcttcccagtgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactcca

SEQ ID NO: 151241 - DNA, 601 bp, Human
cacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcaagggaagacactccagatacctccatgagctttgcttccacacagctcaggtgatgctgacaggtcttcccagygcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatct

SEQ ID NO: 151242 - DNA, 601 bp, Human; identical to SEQ ID NO: 35240

SEQ ID NO: 151243 - DNA, 601 bp, Human; identical to SEQ ID NO: 35241

SEQ ID NO: 151244 - DNA, 601 bp, Human; identical to SEQ ID NO: 35242

SEQ ID NO: 151245 - DNA, 601 bp, Human; identical to SEQ ID NO: 35243

SEQ ID NO: 151246 - DNA, 601 bp, Human; identical to SEQ ID NO: 35095

SEQ ID NO: 151247 - DNA, 601 bp, Human; identical to SEQ ID NO: 35096

SEQ ID NO: 151248 - DNA, 601 bp, Human; identical to SEQ ID NO: 35097

SEQ ID NO: 151249 - DNA, 601 bp, Human; identical to SEQ ID NO: 35098

SEQ ID NO: 151250 - DNA, 601 bp, Human; identical to SEQ ID NO: 35099

SEQ ID NO: 151251 - DNA, 601 bp, Human; identical to SEQ ID NO: 35100

SEQ ID NO: 151252 - DNA, 601 bp, Human; identical to SEQ ID NO: 35101

SEQ ID NO: 151253 - DNA, 601 bp, Human; identical to SEQ ID NO: 35102

SEQ ID NO: 151254 - DNA, 601 bp, Human
attttatcaaaaaagtacttagtacctgttaaaattttttgttctttgctctttaatgtgcattaaaatcacctggaaggcttcgtaatacacaggtaactaggtccacactcacaaagtttcagtagatctggagtttagcttaaaaatttgcatttctaacaagctcccatgtgttactgataatgctggtcctggactcatacctgagctccctactgtagctaatgaaatctgttaggaatgatcatgcagttttgatagtactaaatgaccatagccactcatccacccgatgagscttactgtaaagatacacataaaaggaacaatggaaaagagtagacaactttattttcgtcttatactccaaaccccaggtagaggtctctgtaaacagacctggaagagatggagattgtaaatatgtccacttccctaaagactgaccaaataaatatctcttcatactcgctcttaaatttattatttgtatttcttgcatatctgtacatgaaagccttgtaaacattttattttttcaacaaatgtgtattaccaggcactgttcaagccacttgaggatgtttcagtaggcaag

SEQ ID NO: 151255 - DNA, 601 bp, Human
ctgtagctaatgaaatctgttaggaatgatcatgcagttttgatagtactaaatgaccatagccactcatccacccgatgagccttactgtaaagatacacataaaaggaacaatggaaaagagtagacaactttattttcgtcttatactccaaaccccaggtagaggtctctgtaaacagacctggaagagatggagattgtaaatatgtccacttccctaaagactgaccaaataaatatctcttcatactcgctcttaaatttattatttgtatttcttgcatatctgtacatgaawgccttgtaaacattttattttttcaacaaatgtgtattaccaggcactgttcaagccacttgaggatgtttcagtaggcaagcaggacaaaaattcctgccttctggattttacattctagtatacttgtagtttacattctcatatattacaattaaaatgtaccgttctcaaactaagtttctaaatgtctatcttattctaatttttcttttattaccccagtactgttgttttcctatctttttagcttatacattatagaatcatctgcttcctccttttaatatatcaccaatt

SEQ ID NO: 151256 - DNA, 601 bp, Human
actattaagtgaaccatatgaaattacccttttaaaaagggtaatttgaatattggcaatttagtatagttcaacctaatacataatggtaatggtaaatattttgaaaatatttattttgtttgaaacagtgatcttagggaagatacaaaaacactcaatctgatttactctttataaaaactgatggcataatattaaaatacaattgaataaagtcatttctgtgaagatctaaattaatgtagctgtagttttattgtaaaaatagagcttaaaactttatagaggaatgaagatagtatggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttgaggctcattttaccttttacatgtgtcataggtgctataccatggagtagttattgctataggcatacttttttccccagaaga

SEQ ID NO: 151257 - DNA, 601 bp, Human
agtcatttctgtgaagatctaaattaatgtagctgtagttttattgtaaaaatagagcttaaaactttatagaggaatgaagatagtatggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttraggctcattttaccttttacatgtgtcataggtgctataccatggagtagttattgctataggcatacttttttccccagaagaggccatgtctcctactttttttgtttccctcaatagaccttacttcatggattaatatttatctagcatatatactgatggcataacaaaaactatgtaatgaggaaggtcagagatagattccttcaaaggttctaaaactcttatactctagtacaggaaataaaacacaagcaatatatacaacaaattttaaatacattaagtgcataagag

SEQ ID NO: 151258 - DNA, 601 bp, Human
atggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttgaggctcattttaccttttacatgtgtcataggtgctataccatggagtagttattgctataggcatacttttttccccagaagaggmcatgtctcctactttttttgtttccctcaatagaccttacttcatggattaatatttatctagcatatatactgatggcataacaaaaactatgtaatgaggaaggtcagagatagattccttcaaaggttctaaaactcttatactctagtacaggaaataaaacacaagcaatatatacaacaaattttaaatacattaagtgcataagagaaatattaacaaaatgcagaagtcttttagagaagaaagagtttgcttaacctgaaaaacaagggaatacttcctggaagtagtagc

SEQ ID NO: 151259 - DNA, 601 bp, Human
gagatagattccttcaaaggttctaaaactcttatactctagtacaggaaataaaacacaagcaatatatacaacaaattttaaatacattaagtgcataagagaaatattaacaaaatgcagaagtcttttagagaagaaagagtttgcttaacctgaaaaacaagggaatacttcctggaagtagtagcatttgaaccagacttgaaggcaaggtgggtaaaataggatgaactggtattcagggtaatagctataaagtagaccatgggatattaagaatgagatgagagctctaaargtagaattgacaaacctgaatatctaattagatatgaggagattcagtaagaaggaagaatcagagataatattaaagtttccagtgccaacctgactacagtttctaatcagcatgttagtgccttacttttaaatattaataaacagtattgacttagaaatgtttattgaacgataaacatgtaagatttggcatatttgtgtatgtgtgttatactttgacttttaaagtttaaaatatgaatataacaaggttaagaaaatatccaaaaatagaaggatatgtttccagcttgaa

SEQ ID NO: 151260 - DNA, 601 bp, Human
agtttttggaacatatgctccatgaaaactggatataaaccaaaaaagaagacataaatacaggaaagaagtgaaaggaagataaagggatactgtattgagattgaggaggacagaggctctgagagatttcttcaagattaaatgtatagactgtttatttctgagtattttgagacaagaattagttgctgaagattttaggtgcattattactaataaatacaagtcagcttgctttttaaataaggggaggagtcatgtaagaaagaaaagccatgaatagcttttagttaacatrtgaacttgtttaaagacacttggttggagtcttgattgttttgtaagaagagctaaatggtactactgtcccctctccagctgcaagaaagagaaatatgttctttgataatggcttttgtccctccaaggattgtcttattcattggattcagtgaaatagcagttggtcaaaagtctcttaagctgaaagaattgcgaggaaattagcagatagaacaccaagactcctaggagcggttctctagtagcagcacttgaattgctgaatgaatatctcccacgtggattctctatggtt

SEQ ID NO: 151261 - DNA, 601 bp, Human
aactgtagtttagcttaattgaagttattttagtttttaaaaatactttttgtttttgtctctgtaaatatttaaaaacatctttaaaaatactctattttgaaaaaaataggctggatcactgctaagtaccaaaactaagtttctatagagcaaagctttaaatattaaaaaaagaaataaaatcatgaaacaattggaaagtttttttcaaccctagggatgaagatggcatgatacaaaacccaaagatcattgaagaaaagattgagaattcaattacataaaaataaaaaacatstgtacaaaaaaagagcactaagtaaagtaaaagacagatggcacactgggaaaacatttcttaaaattagaaattattaagaaaaaatactaagcctactaaaaaaggtagtagcagttcttagaaaagaaatggctgtaaacacatgaagaatgcttgatccacttgtaagaaataaatgaaataatagatcagatgctatgttttatttactttcacactgcttaagatttaaaagtttttgttctggtgttggcaaggatgtaagaatctagtcactttcaaacaccctaagtgaga

SEQ ID NO: 151262 - DNA, 601 bp, Human
gcttaattgaagttattttagtttttaaaaatactttttgtttttgtctctgtaaatatttaaaaacatctttaaaaatactctattttgaaaaaaataggctggatcactgctaagtaccaaaactaagtttctatagagcaaagctttaaatattaaaaaaagaaataaaatcatgaaacaattggaaagtttttttcaaccctagggatgaagatggcatgatacaaaacccaaagatcattgaagaaaagattgagaattcaattacataaaaataaaaaacatgtgtacaaaaaaagagcactaagtaaagtaaaagacagatggcacactgggaaaacatttcttaaaattagaaattattaagaaaaaatactaagcctactaaaaaaggtagtagcagttcttagaaaagaaatggctgtaaacacatgaagaatgcttgatccacttgtaagaaataaatgaaataatagatcagatgctatgttttatttactttcacactgcttaagatttaaaagtttttgttctggtgttggcaaggatgtaagaatctagtcactttcaaacaccctaagtgagagtacactggaag

SEQ ID NO: 151263 - DNA, 601 bp, Human
ggactacaggtatgagtcatcatgctcagcctagatggatttttttttttaatctatcttccagtagaatgtaagcctcatagccgtagggactttttccttttaactactatgatctccctagcacctagcacatgaggcactcagtaaatatgtattgaatttgttgataaatttttagtctgttaggcaagaaaagaacttggctatttgcatctttactctgatccctctttagtttttaattatatcattttatcagttgtgtttaaggcattacctgatcatcctgtatacaatktcaaattgttcccttactccctcttacttttccctgctttacttttcttcatagcacctatcttccaacatagcacataattttcttaagcattccccaattagaatataaactacatgaagagtttacagtatttttgtatatttgggttattgttttatccgcagtatctacggtagggccactcatatactatgtatttcagtattaaatgtttgctgaataaaggattgaatcatttcatttcaaaggagacagctaaaaaaccccagcaattttataagatcttgtatataataa

SEQ ID NO: 151264 - DNA, 601 bp, Human
gaaagctgaggatgtcagggctgcggatttgttttcagtagagagtcaaaggtccagatgcccacataaaggagaaaagcagaaacagtaccaactaattgttgttagaagttacacaaagttggtaacctagaaaagtggttctcaaacctgagtgtacatcagaatcacctggaaggcctcttaaaacatgggatgctgggctctgttgagtttctgataaataggtctagagtggggcctaagaatttgcgtttttaacaagttcccaggtgatgctgatgctgctggtctgggggamtcacactttgataaccactgacatctgtgacccagtaaaacacttatggagacaattagggattaagaaattaactatactggcagagaacctagcataaagtcaggtgggcaagtctttgcttaactgctgtatttatgtagttcagtctcttcaaataggtatactggaagaccagaaccgtggtctttacatttttaagtgcttcctatgtcctaatacaatgcaatctaaatattaggcactgggatacacacacacacacacacacacacacacacacacgtaggaacacacaaa

SEQ ID NO: 151265 - DNA, 601 bp, Human
aggttgctgcttgtgaaatttcatataatttgaatcatgcagtattagggaggaggtaaaggataatcattgtttaaggggtatagagtttgagttttacaaggtaaacaatgtgaatatactcaacactactgaactgtacactttaaaatggttaaggtggtaaattttatgttacgtggctttcaccacaataacgtttatgtttggttttttttacataatattttttaggttaatccatgttgcatttatcaatagttcattcctttctattgatgagtattatgctcttgtttgkatataccacattttatttgtccattcactttttgatggtccgttaatcatgtgtttttgaaaggaatcagaaaaaaagaattgtttaccatttggctacacttaatcttgctcttaattttttctttctagtaattttcaaattcatcccttaaaagtaatttcatctaatttactattattaaataaatattataaaataatttgctatttattaaataaaaattctaaatgtttttaatctggtgcttctaaaagcagaaatgtaggagctaaaatttgtggcaacagtttttctctc

SEQ ID NO: 151266 - DNA, 601 bp, Human
ttttacaggctgggcacagtggctcatgcctgtaatcccagcactttgggaggccaaggcgggtggatcacctgagttcaggagttcgagaccagcctggccaacatggtgaaaccccgtctctactaaaaatacaaaaattagccgggcatggtggtgcatggctgtaatctcagctacttaggaggctgagacaggagaatcacttgaacccgggaggcagaggttgcagtgaaccaagatcatgccactgcactccagctgggggacacagcaagactccatctcaaaaaaaaaaaaagaagaaaaagaaagttttataaaatactgggggccaaagggaggggaaaactagtaaattatccagaataggtattggtactgatgttattgtcgtatcctctcatagttttaattctcttttttactgctgttgttatcttcatttgcttatgaagttattctcagtataagcaaatgaatgcacagttagctagctatcagactattaaagcaaattccctgagcaaggttttgaagtaagttcagagacaactctgttagtggctttgtccataaaacatcaatagtagtatgactt

SEQ ID NO: 151267 - DNA, 601 bp, Human
tgaaaccattttgtaaaaatattagcgaaagaaagtaaaattgatttaaaaaaacagtaaagaagaaaaagtttttaaaaagaatgatagttgctttaaactttaaaacaacagcaattaaaagagacagagggacattatataatgataaaaggtcttgtccaacaggaaaatatcacagtcctaaacatatatgcacctaacactggagctcccaaatttataaaacaattactgatagacctaagaaatcagatagacagcaacacaacaataatggaggacttcagtactccactgwcagcactagacaggtcaacaagacagaaagtcaacaaagaaacaatggatttaaactataccctggaacaaatggacttaacagatatatgcagaacattccatccaataaccgcagaatacacattctattcaagagtgcatggaactttctccaagatagaccatatgataagccataaaacaagccttaataaatttaagaatattgaaattctgtcaagccctctctcagaccacagtggaataaaactggaaagcaactccaaaaggagccttcaaaaccatgcaaatacataga

SEQ ID NO: 151268 - DNA, 601 bp, Human
tgctttaaactttaaaacaacagcaattaaaagagacagagggacattatataatgataaaaggtcttgtccaacaggaaaatatcacagtcctaaacatatatgcacctaacactggagctcccaaatttataaaacaattactgatagacctaagaaatcagatagacagcaacacaacaataatggaggacttcagtactccactgtcagcactagacaggtcaacaagacagaaagtcaacaaagaaacaatggatttaaactataccctggaacaaatggacttaacagatatatrcagaacattccatccaataaccgcagaatacacattctattcaagagtgcatggaactttctccaagatagaccatatgataagccataaaacaagccttaataaatttaagaatattgaaattctgtcaagccctctctcagaccacagtggaataaaactggaaagcaactccaaaaggagccttcaaaaccatgcaaatacatagaaattaaataacctgttcctgaatgagcattgagtcaaaaacgaaatcaagatgaaaatttaaaaattctttgaattgaacagcagtagtga

SEQ ID NO: 151269 - DNA, 601 bp, Human
tacatagataatatgttatgactaaatgggtttatcccaggtgtggagggttgatttaatgtttgaaaatcaatgaactaaaatagaccacctcagtagacagaaaaattatttggcaaaatccaacacccatttctgataaaaactctcagcaaactgggaatagaaggaaacttcttaccctgataagggcatatatgaaaaacctacagctaacatcatattgaaaaactgaatgtgttgctcttaagattaggaacaagacaaaggtgtctgctctcttcaccacacctggccggawttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgt

SEQ ID NO: 151270 - DNA, 601 bp, Human; identical to SEQ ID NO: 35103

SEQ ID NO: 151271 - DNA, 601 bp, Human
aaaaaaatacatagagtgttaccttgtttaagaagggtagttagaaaaaaaaaaaagaatccaaataacttttttttgttttgttttgtttttttgttttttttttttgagacagagtctcactccgtcacccaggctggagtgcagtgttgtaatcttggctcactgcagtctctgcctcctggttcaggccattctcctgcctcagcctcctaggtagctggaattacaggcgtgtgccaccatgcccagctaattttttgttttagtagagacagggtttcactgcgttagccaggakggtctcaatctcctgaccttgtgatccgcccgccttggcctcccaaagtgctgggattacagtcatgagtcactgcacccggccagaatccaagtaacttttgaatatagtattgcatattcactgggatatacagatatttcttattatggagttatatcttgaaaaactcattgtagagttgaaaaatcttaagtcgaaccattgctaagttggagactgtaatgaaaaataaaaggaactgtaaagaaatctttaactgtatttagtaagtttgtagttggtagtagattggtatag

SEQ ID NO: 151272 - DNA, 601 bp, Human
caattgtcaccctattaaagagaccctccctgaccacactatgtaatactaaccagcagagggtagctgaatgaactaccatatagccaccctatgagggactgtacagctgtgaaaaagaatgaggtggatctctatgaagtgatagggaatgattttccagatgtatggttaagtgacaaaaatgagatacaaaaaaatacatagagtgttaccttgtttaagaagggtagttagaaaaaaaaaaaagaatccaaataacttttttttgttttgttttgtttttttgttttttttttttgagacagagtctcactccgtcacccaggctggagtgcagtgttgtaatcttggctcactgcagtctctgcctcctggttcaggccattctcctgcctcagcctcctaggtagctggaattacaggcgtgtgccaccatgcccagctaattttttgttttagtagagacagggtttcactgcgttagccaggatggtctcaatctcctgaccttgtgatccgcccgccttggcctcccaaagtgctgggattacagtcatgagtcactgcacccggccagaatccaagtaacttttgaata

SEQ ID NO: 151273 - DNA, 601 bp, Human
atgcacacttctctacatcccgcctttccattaatatgtcataaaatctccttgaaatcaactggtatagctatactttattctttttaataactacataatattccagagcatgagggaaccataattaatctgccatccaccactgatgaacactccttttgtggctagctttgtctattgcagttacaccgcaataactatcctgtacatatgtcctgatgtatttatggtttcatatttatgtgggagtagagtggagctgggagttgctacatcaaaaggtaaatagattttttttattttaatagaagttgctgcattgtttacaaaaaagactttggcaatttacatctccatcagtaatgcctgagttgccctttccttggactcctgacagcattaggtaattttttttttatgtttaatttttgggcaaatagtgacatttcattgatacttgaatttgcattttcccaacctttaaaaatttaagcatctcttctgcttgttgatttggatttctttttctgagaaatgtcttttcacatcctctttttttgtattagattgtttgtttttttcttctcaaagtttaaag

SEQ ID NO: 151274 - DNA, 601 bp, Human
tggctgctgactgatcagggtgttggttgctaaaggctgcaatggctgtggcaatttcttaaaagaagacaatgatgagttttgctgcatcaatggacccttcctttcacaaaatatttctcagaggcatccaatgctgtttgatagaattttactcacagtaaaactgctttcaaaattagagtaaattttctcaaatcctgctgctgctttatcaactaaatttatgtaatactcttaaccctttgttgtcatttaaacaatgttcacagcatcttcaccaggagtatagatgccatcygaagaaaccactttctttgctcatccataagaagcaactcctcattggctcaattttcatcatgagattgtggcaactgagtgacatattcaggctccacttctatttttcttgctatttccacccttcaaagtcatccatgaggatcggaatcaaattcttccaaactcctgttaatattgatattttgacctgacgattggaatcaaattcttccaaactcctgttaatgttgatattttgatcttctcccatgaaccacaaatattcttaatgacatctagaatgctgaatcctttc

SEQ ID NO: 151275 - DNA, 601 bp, Human
tgcccgccttggcctcccaaagtgctgggattacagacacgagccaccgcgcctggcctattatgttcctttttatggcatattcatatatatatatatctcccacattttctttatccactcattgattgatgggcatttatgctgattccatatttttgcaattgcgagttgtgccactataaagatgttgtgtgcaacatgttgtgtgttgtctttttcataaaatgacttgttttcctctgggtagatacccagtaatgggattgctggatcaaatggtagttctacttttagttgyttaagaaatctccatagtggttgtactagtttacattcccaccagcagtgtacaggtgttcccttttcccaccacacccatgccaacatctattattttttgatttttaaattacggccattcttgcaggagtaaggtggtattgcattgtggtttcaatttgcatttccctgataattagtaatgttgagcattttttcatatgtttgttggccatttgtatatcctcctttgagaactgtctattcatgtccttggcccactttttgatgggattgtttgcttttttcttgctgattt

SEQ ID NO: 151276 - DNA, 601 bp, Human
ctcaatagttttgggggaacaggtgatgtttggttacatggataagttttttttttttttttagttatttgggtgtgatttctgagattctggtgtacactgtacccagtgtgtagtcttttatccctcatccccatcccacccttctccacaagtccccaaagttcactgtatcattcttacatagcttagctcccacttgtaagttagaacatatgtttggttttccattcctgagttacttcacttagaataatggtctccagttccatccaggttgctgtgaatgccattattttgktcttttttttttttttttcttttgagacagagtctcgctctgtccccaggctggagtgcagtggcgtgatctcggctcactaaaagttccacctcccaggctcacgccattctcctgcctcagcctcctgagtagctgggactacaggcgcccaccaccatgcccggctaattttttttttgtatttttagtaaagacggggtttcaccatgttagccaggatggtctcgatctcctgacctcgtgatctgcccgccttggcctcccaaagtgctgggattacagacacgagccaccgcg

SEQ ID NO: 151277 - DNA, 601 bp, Human
aaataaattaattaaataaaatggtgcaggaggaaaaacaatctccccgctgtgtggggaagcaggaactttatagagtaacatctatcagtggagcccaaagagttctaagctaactgctgtcactacatctctttccaaaacattcctagtaagacaactgatactgttctccccaccttggttagattctctcctcacccagaggaatgacaaaggaattgaaagtagctagctcctctataccagaaaaggagaaaaccctgacaacaggtaacatctaattcttttctcatagacsattaatttgtgctagtctctgaaaacagactaaaaaaatggaaatttgccattttaaacaaatcaacttatggaatactcaccaagcacataaagaaagaacttcatggtatcagtaatatttggcgattccatttcatactcatcttcatctgatgatgttaagttgtagatagtgaggctacctgacacagtgtctaaataaaccctatttttaaaagatgagaaagctctgaattcagaattttccagttctgcaactttatccttttgttttttccataggacctcttttaaaggc

SEQ ID NO: 151278 - DNA, 601 bp, Human
ggaaatcttctaagaggatactttgacatcttagcaagctgtatttgtctaaatagagtccacaggggtcagacctcacatagccttgcaagtcgctttacacattttagctttaacagagttagatggggccattagaaagttccacacagatgagtgacatgatctgacttctgttttaaaaagatcattctggtagaaccaatacaacttcctggtagagtgaatgtggtattcaagaaaaagagaggtatcaaggatgacatcccggtttcagactgaccagctgaaaggatggggytgccattaaccaaaagggaaaagatttggggaggagcagcaggttttaaggggaagataatgagcttacttttggacttgtgatatttgaaaggccaattagatgtctgactggagaggtacactgggcagtcaggtatacacataaggagctcggcggggtactctgggctagagctctagatctgtacattattagcattgagatgatatttaaagccctgacatgggatgagctcacccactggctatgaacgcagacagaaaaggaaagagacctaaggcttaagccttgatgttt

SEQ ID NO: 151279 - DNA, 601 bp, Human
gactgagaccttgtctttaaatatataggaatgaagtaaatacttgttcctatgcttgacccatagggtgctccccataattaagtggggtgcttaatatgcagaggaaatactttgtattacctttccaaaatgtaaaaaaaaattttaattccataacacgtctgactcaaagcattttgtgaaaggaaagtccataatacatctgactcaatacattttgtgaaaggtggagctacacagagccttgtcgggccctgcctattggttgggctggacctgttaataggcagtgcagggmgcagcatgtgtcacagacctgcctgtccagaggcctcactcccacccttcttctaggaagtgcctcctattggctaaggcagcatggacctacaaggatgagttaagacactaacatgtcacattctgccattgttgccctttaaaagcctcaaggctaattactttgtcctatgagtcatttatttgttaattcatatgccttcttgcgtctcagctaccctccagcaattaatcataagaggcctgaggaaacatgcaaaaacatatgtaatatacaacaatggtcatggtagcactg

SEQ ID NO: 151280 - DNA, 601 bp, Human
ttctagatccctggaacctcatcaccagacctcggcccttttagccaagtgatccccaccccatcccaccccaccccaatggggtctatggggccctcccgcagggaagggtccaggcaagtccagagctacaggcaccaaggctgcagagggtattggacaaaacctcctatttctgaaatgcatttcagttgccactgtacacattaagcaaaataataaggaaaaaggaaaagtgaaagtgaaaatcatgcacttgaaaacgattagatggagtaagcgctgtcgacgggattgtgcygcatgcggcaaagactgaggcctcccgctacaggcccggagtcgcgacagccggtctgccaggcgcccacctccacttcctactgctgcttgcattccgccggctggctgggttccttgttgggattaatttccacctcatcctcatcttctccctcctcatcaccttctaattcgtcctcttcttcttcaccttcgtcaaaattgtcatcatcctttaaggcctccccagcgaagtacagcacagcctgtggtccgctcacggaaaaagtgtccaatttcaaaatcagaggctaatacg

SEQ ID NO: 151281 - DNA, 601 bp, Human
attttgtctcttggaacacttaaaacttttcaagatttcaacttgcttgctctgtctatatgtggtcatcttcttcccccttgtcagttagatgcagcacacatataccaaaaggcaaaagcacactggttttattttttgttgttcccattataaagcaactatctgcttttacaacaaattgcatttccatatcgtatgccttgggtattatgtaacactcaaaaggtggaattaataaaggaatgtttgctccaagcttaactattttaactttgcagctcgttttaaaaacttcttscaattgtgtgacttgtacaaacagtgctcctttgagtgacacctctgtgggtttgatcttttctctgtcttcaaaaatcaaatctatcagttataaattgggactcatttgcactttttcttttttttctccgtgtttcataactttaatagaatattctaactattatgtacaaattgaaaacactgtattcagttataaatgtgttctaaggttaggctgagcactctctacaggcctggtcagcgcggacaaggccatccccggctgccacagagcgctgtcacccacttggaaacc

SEQ ID NO: 151282 - DNA, 601 bp, Human
agttatttaacctcactgtgcctcagattcctcctttataaatacccacaccactgggttgttgtgtggattaaatgtgacacatttatgtaaatcatttacaggagtttgttgtggagcaggccttcagtaagtattagttcattcccccagtacaatacgagttggacaagaactctgtcctcaatcttaactgtctctaaaattctcctttagattgtgtttaactagttagtaaccccatcgccccatttctgggttgcagtgacggtatgacagtagatgtcatgactaaaatgaygacaaaccacaaaaaggtcctactagacaaaatgttacaagaaacatgagataatgaggtaaaaaattaagttacatttgaccaatatctactatgtatatctatatagtatgggtttctctagctcattcatatgaataaatcaaagaaaactttaaaatttgatttattttgaaacgtatagagagtcaggatggtatcatacaaaaacactctggaattcaaagacctaaattttaattctatctccaatacttaagtgaccctgggcaagtcaccccacctggttgaccctgtctc

SEQ ID NO: 151283 - DNA, 601 bp, Human
agaatagtttggaccagtgctgtccaatagaaatataatgcaagccacataagtaatttaaaatttttggtatccacattacaaagtaaaaaaaaatgtaaattttaatattttatttaacacaatgtgtcacaaatataaaattatttcaacatgtactcaatataaacattttttaatgagatattttatattctttcacacacggtcttagaaacatattattttacactcacagcacatgataatttggactcccacatttcaagtgctccatagccacatgtagctcatggctacyatttcagacattaagacactgctcccacacatgcatgcatcactttcctgcccacagtaggcatccgcctgaccctagaactatgctagtggttcagaagcttagtcaatagggttgactagagcttataaagttgtctgtcaactacaactaggcagctggagctgtttccattcaactctttcctcttctgaagattccatgccaaacatctcactatttcccaattaatgactttaaggttgcttaaaggttgagatgcttgctgagtttttttgtttgtttgttttttgagacagg

SEQ ID NO: 151284 - DNA, 601 bp, Human
cctaaagaatgacccaaagcctctctcaaagtctcagcctggcccaacctgccagcccagccccatctttctctaatgcctcaacactctctgctccaaagaggatggcttgctacttcttgtcctgcccttcacaccctgggccttaactcttcccctcatccctcaacacccagctcatgcctctgcctcctgaccaccagtgggatctgccaggagggggcctcttggagcaccctacggcggtttattaaaccaacactgctgctaattgtgtttgtgtcctatcttttatatgtgwctacaggcccagctctgaccctggctcctgaagtgaaccctatccctgatccaactttttctgggatgggaggtggagggagtgtattgtagtggttaacagtataactcttggagtccaaagacctagatttaaatcccagcccatcacttactagcaacgtgactttgatatctcacttgacttctatgaatctcatatgcgctgtctctaagcaaggggtatgatactcctcctgcaaggctcattgagagggttccaggaaacgatatgcagagagtggctagtgcagtgcatggc

SEQ ID NO: 151285 - DNA, 601 bp, Human
cactacacacaacccaaaataaaaatggactccatctggaaatcaaacctaaattacaagctatctagaaaaaaatgcagcagaaacagttcatactcaactctattatttccatctgtagacttaaatgtttaaaaacaaaactaataaaacttagttctttccttgacaaattttttaaaaaaacagaagtatgagaacagaattaaatataaaagctgaaatatatacattactgaaaacaaaattgataacctaaaaattttttgagaaaaaagtaaaatctttaggaatctaatgwagagaaaaaaacatagagaagtcagaatggaaacagacaaagcaaaacaattttaaaagattactaagcctatatcagaaaatactccatgtaactctaaagcaagcaatattaaaatctagcataaatggccaattttctagtaaaatatgattcatcaaaagcaaaacaagaattaaacttgaagagacatgtaagcatacaaagattagaagacgttgccattttaaaaaaaatacaaaatccagatagttatacaggagagtaatgcttaaagaataaaccagcattccattatta

SEQ ID NO: 151286 - DNA, 601 bp, Human
aataaaaactataagccaaagatgaagaaccacaataatctctgaagatagcacttctaaataaaaccatgcaaagcacatcataatcaaactgctaaaaaacagtaataaaggataagtcttaggctaggcgcggtggcccatgcctgtaatcccagcactttgggaggccaaggcaagaggatcatgaggtcaggagatcgagaccatcctggcaaacacggtgaaacgctgtctgtactaaaaatacaaaaaaaattagccaggcgtggtgacgggcacctgtagtcccagctactcrggaggctgaggcaggataatggcgtgaacctggaggcaggacttgcagtgagccgagatggcgccactgcactccagcctgggcaacagagtaagactccatctcaaaataaaaataaatgtttaacaaagcaaaagagaatgccacttagtatgaccaagaaaaaacagcatgaaaatttcaaaagaaatctatcaacaaaaacaacaactaaataaataaaaggatccagcctaggcaacaaagcaagaccccatctctagaaaaactttaaaaactagctcagcgtgtaggtgtgca

SEQ ID NO: 151287 - DNA, 601 bp, Human
ctcactacctgtgggacaattatcaagtggtctaatatatgtgtaactgaattcccagaagaagaaataaaaacaatgagaaatatactttaagaactaatgatcaagttttccaactttaataaaaactataagccaaagatgaagaaccacaataatctctgaagatagcacttctaaataaaaccatgcaaagcacatcataatcaaactgctaaaaaacagtaataaaggataagtcttaggctaggcgcggtggcccatgcctgtaatcccagcactttgggaggccaaggcaagmggatcatgaggtcaggagatcgagaccatcctggcaaacacggtgaaacgctgtctgtactaaaaatacaaaaaaaattagccaggcgtggtgacgggcacctgtagtcccagctactcgggaggctgaggcaggataatggcgtgaacctggaggcaggacttgcagtgagccgagatggcgccactgcactccagcctgggcaacagagtaagactccatctcaaaataaaaataaatgtttaacaaagcaaaagagaatgccacttagtatgaccaagaaaaaacagcatgaaaatt

SEQ ID NO: 151288 - DNA, 601 bp, Human
ggctcacacctgtaatcccagcactttgggctgaggtgggaggatcacttgaggccaggagttcaaagccagcctgggtgacacagcaaggccccatttctacaaattaaaaaaaaaaaaaattaagccaggtgtggtggtatttgcctgcaggcccagttacttaagaggctgaagcaggaggactgcttgagcccaggagttcaaggctgcagtgagctaggatcatgccactctaccgtagcctgggtgactgagcaagaccttgtctctatttaaaaaaaaaaaaaaaaaaaaaaaggccaggggcagtggctcatgcctgtaatcccagcactttgggaggccaagaggccaaggcaggcagatcacctgaggtagggagttcaagacaagcctgaccaacatggagaaaccctgtctctactaaaaatataagaattagctgggtgtggtggcgcatgcctgtaatcccagctactcaggaggctgaggcaggagaattgctcgaacccaggaggtggaggttgtggtgagccgagatcccaccactgtactccagcctgggcaacagaagcgaaaactctatctcaaaaaaaaa

SEQ ID NO: 151289 - DNA, 601 bp, Human
aaaatacaaaaaaattggctgggtgtggtttcaggcgcctgtagtcccagctactcaggaggctgaggcaggagaatggtgtgaactcgggaggcggagcttgcagtgagccgagatcatgccactatactccagcctgggtgccagagcgagactctgtctcaaaaaaaaaaaaaaaaattcattttttttcctcagcaaggcaatttatttttatagaaggatgcgccctcacagatggagcaatggtgaacgcacacctggacaagggaggggaaggggttcttattcctgacgcacrtggcccctgctgctgtgttgttcccctattggtgagggttagaccacacaggctaaactaattccgattggctactttaaagagagtgacggggtgagtggtttggcaggaaaaatggttatggcagagcaggaaatcggaatgaatcagggtggagaatgagtcagggcagagcaggtaatcggaatgagtcagtgtggagcaggtaattggaatgagtcagggtggagcatgtgatcgaaaaagattgctttatgaggaagtttagaagtagaaggcaaagaattgaacacactgaca

SEQ ID NO: 151290 - DNA, 601 bp, Human
gttataaagttttggtgccgcaaaagaaatagcactcaaatataaaatgttctttttttggaggccgaggcgggcaaatcatgaggtcaggagatagagaccatcctggctaacatggtgaaaccccgtctctactaaaaatacaaaaaaattggctgggtgtggtttcaggcgcctgtagtcccagctactcaggaggctgaggcaggagaatggtgtgaactcgggaggcggagcttgcagtgagccgagatcatgccactatactccagcctgggtgccagagcgagactctgtctcaaaaaaaaaaaaaaaaattcattttttttcctcagcaaggcaatttatttttatagaaggatgcgccctcacagatggagcaatggtgaacgcacacctggacaagggaggggaaggggttcttattcctgacgcacatggcccctgctgctgtgttgttcccctattggtgagggttagaccacacaggctaaactaattccgattggctactttaaagagagtgacggggtgagtggtttggcaggaaaaatggttatggcagagcaggaaatcggaatgaatcagggtggagaatgag

SEQ ID NO: 151291 - DNA, 601 bp, Human
aaacaaaaggtaaaacaaaaatggaaaacatgttattttataaaaaattgaatggttgtcaagctcacatttccttatccagtttttgaaatacagaaaattattgtatgtttagctacaaaacacatttagtgaaaaaaacctgacctgaactgtcataaagctatatatatctttagttacgctatttagtgtaaatactgctgcagaaatattaaggcatttgattatagggtacgaccacagaccatgctggaaatttaagtaccatcttgccttcctaaaatgtgaacacttatgyatcccaaacactgaatatatgaataaaatttttaaacttagaaacataaatattttgttttcctatgtccacattaatcatgtaacctggctgcaattttcttaaattccaaaattaaatattttaatgacaacatatatgagcataatccaaataactctaagaaataaaattttaaaaatgaccagttccccaaagtgaaataattgctaattaaggaacaatactgtgattcaagcagaaaatttttcaagtggaatttttaagaattatcaaaatagaaaatactttataacagtg

SEQ ID NO: 151292 - DNA, 601 bp, Human
tgagtggtcagttggtctgaaattcttgcaagatgccgctgttcaaactgttgacataatcatggcctcttctctctctgtcagagagatgtgatatggggtaaggaagtgtttttcaaaattgttcactggcatctgtaagataatttagttcttataacagagcaagaaaatcaaatttaaaaaatagagacctagaaagcaatatgtatttgccaaaaaggaatgatggcaaaaaaacaataattatgttctggagcaacaggtcactgatctttactaaagaaattttatagcaatggaggtagcggcagacagacattagcatgagcgtggggaactgaagatgtgaaatgctgaatatgttgcccactcttacaaaaaacttggcaatgaagaaaagagacaaaatgacctgtcaatagagggagaataaagaagaatgctgctttatacagggaaaacttggagatatgatacagaaagtaactgaaataatttataataaaaatggcttaaatcctataaaataatatcatagagtaacatatatttagataatgtcagtaagtatttccaaagttaattttatcacttaaga

SEQ ID NO: 151293 - DNA, 601 bp, Human
aaaacaaaaaagatgtttgatactgatgaagctgaagaaggtgtaaaggatcttaagattgaaaaaatattcaagaaccagctgaaccagagtatgaccttaatattatgcttggcaataaaaagaagaaaaagaagaatgtcaagttcccagatgaggatgaaatactagagaaagacaaagttctagaagatgaagacagcaaaaaagatgacagtatctcattcaataatcatacaggccctgctagggcagtctcaaatacacataaggagctactgaagcgagtgtgcaacatcaygagggaaaagaatccagatgtggttgctgaaaaggaaatctgtcatcaaacctctacaggtcatttgagtaggaaccaagaaaacttattttgtcaactttacagatatttgtaaactattacatcatcagcccaaacatcttgcatttttgttggctgaactgggtacaagtggttctatagatggtaataaccaatttgtaatcaaagaagattccaacagaaacagaaaaagtcttcagaagatatattaaggaatacttttcacacatgctgatcactggacacacacctgcagaa

SEQ ID NO: 151294 - DNA, 601 bp, Human
aaaaaaacaaaaaagatgtttgatactgatgaagctgaagaaggtgtaaaggatcttaagattgaaaaaatattcaagaaccagctgaaccagagtatgaccttaatattatgcttggcaataaaaagaagaaaaagaagaatgtcaagttcccagatgaggatgaaatactagagaaagacaaagttctagaagatgaagacagcaaaaaagatgacagtatctcattcaataatcatacaggccctgctagggcagtctcaaatacacataaggagctactgaagcgagtgtgcaacaycacgagggaaaagaatccagatgtggttgctgaaaaggaaatctgtcatcaaacctctacaggtcatttgagtaggaaccaagaaaacttattttgtcaactttacagatatttgtaaactattacatcatcagcccaaacatcttgcatttttgttggctgaactgggtacaagtggttctatagatggtaataaccaatttgtaatcaaagaagattccaacagaaacagaaaaagtcttcagaagatatattaaggaatacttttcacacatgctgatcactggacacacacctgca

SEQ ID NO: 151295 - DNA, 601 bp, Human
gcatgggtctgctttctcttgggctttgcaccatgcaccttttctctttgctgattttaatctgtatctttcaactaaattagggtttctccatgttagtcaggctggcgtcgaactcctgacctcaggtgaccgatctgctcgccttggcctcccaaactgctcggattacaggcgtgagccaccgcaccccgccagatcagttaactcttcaagaagtttatatgtataagtgtatttagtcctcatagcagccctgtaaagtaggttctattactatccccacattaaaggtgaaaamattgaggttcggagagattaagaaacattctgaaggtcatgtggtgacgtaaatgccaagatctgaattcaactaacatgtctgtgtctacagctcatgctcttaagaactatgctaaactatttctctaattaaaacgctggtctatcagtaacaaaagagactaaactaaggcagtattaaaggaaatgtagaggataaatcagagtatcaattggacttaataaatgactgtatgatgaaggagtactaagagttacaatgaggaaacaaattagaaattctagatgattcccaagt

SEQ ID NO: 151296 - DNA, 601 bp, Human
atatatttaaaacaaaatactgttcttattaatatttcctctttattttaccaaaaacatggtataaaaataaataaaaagagccgggcgcggtggctcacgcctgtaatcccagcactttgggaggccgaggcgggcggatcacgaggtcaggagatggagactatcctggctaacatggtgaaaccccgtctctactaaaaattaaaaaaaagtcagccgggtgtggtggcacgcgcctgtattcccagctactcaggagggcgagataggagaatcgcttgaacccgggaggtggggrttgcagtgagctgagatcgcgccactgcactccagcttgggcgacagagagactcggtctcaaaaaaaaaaataaataaataaaaagatcttggtaaaaggaaacacacaaaaacaatttttcaaaccaaagggagaaatagtaaagtgaagagaaaggggaaaaggaaaaatattttcacatttgggaaagcatgacttaaaaacctcttgagaaagtgtattatataaaactacaaagaagataagtataagtaactgtagagacaaagatatgagagcaactaactcttcttagagt

SEQ ID NO: 151297 - DNA, 601 bp, Human
ggccaggagtttgaggctgcagtgagctatgatcatgccactgcattccagcctgggtgacagagcaagaacctgtctttaaaaatatatatatatatatatatacatatatttatattttatattttatatatattatatatttattattattatatatttatatattatattttatattttatatatatatattttaagtaccagaaggtgggacttaacgactggtatttgaagtggaatggcagtttgcaggactgagcccttaacttgtgggacctgactctaactccaggtagayggcgacagaactgaactgaatttctggacaccaagctggcgagaatcagtcaatatgaggggaaactggtcacacacatggtcacagaagtgctctgtgttgtgtgagtataggaggagaaaaaaaacattttttttaaattatacaagagataataaggacttagatataagtggtaaaggaaaatggtaaaagaaagggaaggataatggttaaactttgaggtggcaatgccgctgaagctattctttaatgaggaaaagtatgacatcttccttttctttttgcctctcaccatca

SEQ ID NO: 151298 - DNA, 601 bp, Human
aatagtttgcacaggatttacaaccaggagaatgcaaagaggtactcattatatttataagcaggtagcttctttttccctaaggctgactttgaaactacctgaggagctgctgatcctgtgatcggatgggtgctacactataaactactttctattaatcagtaaagagcagtttggtttatggacaattccaaggtgaatggacagcatcttgtttggagggccaccactgtgattacagaaggtaaaaaatcaactcagcgggcatgtgattttcccctatgtttgggttttcacrgaactctgcagttggtgtcagaagtaatggtgatcttgtggactgtttcgtaactttgaacagacaatgaagaaagacactggtaaaattcaataatgtatgttatacttgcaactgcctttgcaaaattataacagtgagagaaatctaacacaactgactccaccttgcttctaacctcacaagctgtctttgctcattcccatatgtgggccaacctaactatgggaggaatttattttatagtttaaagcaagcataatagtttcttcctgaaactaataccctccttgttcaggg

SEQ ID NO: 151299 - DNA, 601 bp, Human
ttcaatgaggcctgatcaaagacaggctgtatctgaactgcagaaagtagtctctctaaatactttccagccctatgatccgccatgattttgtccatgtccggccctatggacattccgccatgattttgggaagtgtcagccacacatactaatgcagactacagcttatgggcaaaaccctatgagtgccacccagcagcaaccactaggatttttggaccagaagatgtccagatgccatagtacaatgtacaacactgtagaaaaaaatagctactacaggcattaactgagactraatctatgactgaaggacataaaataatcctgaaattcaaaacagccataatatcttaggtgatgtcggagaaacactaataaggaaggcagtgtccagaagagttccctataaaatagaaatagtttgcacaggatttacaaccaggagaatgcaaagaggtactcattatatttataagcaggtagcttctttttccctaaggctgactttgaaactacctgaggagctgctgatcctgtgatcggatgggtgctacactataaactactttctattaatcagtaaagagcagtttgg

SEQ ID NO: 151300 - DNA, 601 bp, Human
gaattagacaacggagtgctggtgccaatgaattctttgtacaataatcctgtgtggcctatgaaaaaagcagatggctcatggagactaacagtgaactatgaaagcctgaagtagttccgccatagcatcagcagttcctaatatggtctcaacagtacaaaaaacatataaaatatatagcaggccaaaggaaaacagtactcagggactaatcttgtgaatttctttttttattttacctccatcctcaaaaagagccaaccacaatttgcctttgagtgggagagatcccaatttrcacttactctatcaccacagggttatttccactcaccagcttactgtcataatttgattaggagaaatttagagttgattcgggtccccacatgtaataatatagtatactgatgatgtcatgatactatcagaaactgaagaccaaggcaggactaatttaaacgcaatggtgataaaaagtttggggaattaggggaaaaaagcagtgatgacatgtgaccaacaggagctgtatgataaatccagcaaaggtctaacggcatgcctaaatggtgaaaaaatccttagaaataaccag

SEQ ID NO: 151301 - DNA, 601 bp, Human
agaagttgttaattttggacagtgtaaggtactgcctgatgaaattacctgttggacaaaaagaaattaccattttaatgaagaattagacaacggagtgctggtgccaatgaattctttgtacaataatcctgtgtggcctatgaaaaaagcagatggctcatggagactaacagtgaactatgaaagcctgaagtagttccgccatagcatcagcagttcctaatatggtctcaacagtacaaaaaacatataaaatatatagcaggccaaaggaaaacagtactcagggactaatctygtgaatttctttttttattttacctccatcctcaaaaagagccaaccacaatttgcctttgagtgggagagatcccaatttgcacttactctatcaccacagggttatttccactcaccagcttactgtcataatttgattaggagaaatttagagttgattcgggtccccacatgtaataatatagtatactgatgatgtcatgatactatcagaaactgaagaccaaggcaggactaatttaaacgcaatggtgataaaaagtttggggaattaggggaaaaaagcagtgatgacatg

SEQ ID NO: 151302 - DNA, 601 bp, Human
aggcaatatacacgtgtgggtaaaaatgccaggggtagataagagaccttactaaaactccttgacagggaggcccaaggcaccataattctaaatcttgttgaagtcctaacaggtgttaaggttaaattgaaaggtgacagctaatgggattaaggtaaacatttagattaaaactagaatgtctcagctgcctttatgtgaggtggttacgtcttcattacctgaatgtactattgggatagacagtatgtttgactgaaaagtacacctgtctaatattgaaaacagaaagcacgtmagttcaccttgaggtcaatgttgatgagaaatgctaattaggaaccaccagaaccacccaggccctcagaagttgttaattttggacagtgtaaggtactgcctgatgaaattacctgttggacaaaaagaaattaccattttaatgaagaattagacaacggagtgctggtgccaatgaattctttgtacaataatcctgtgtggcctatgaaaaaagcagatggctcatggagactaacagtgaactatgaaagcctgaagtagttccgccatagcatcagcagttcctaatatggtc

SEQ ID NO: 151303 - DNA, 601 bp, Human
gctagttcccaacattaaagggccttaaactaactatgctgtattttaccccagtttgggaagatttaaaaagccagggaacaaagatgacaataagcaacctgacctcaaattgcctgggacaatagtctggcagattactcaagatgaagacagagaggtcaaccagcaactggggaactaaggcaatatacacgtgtgggtaaaaatgccaggggtagataagagaccttactaaaactccttgacagggaggcccaaggcaccataattctaaatcttgttgaagtcctaacaggtrttaaggttaaattgaaaggtgacagctaatgggattaaggtaaacatttagattaaaactagaatgtctcagctgcctttatgtgaggtggttacgtcttcattacctgaatgtactattgggatagacagtatgtttgactgaaaagtacacctgtctaatattgaaaacagaaagcacgtaagttcaccttgaggtcaatgttgatgagaaatgctaattaggaaccaccagaaccacccaggccctcagaagttgttaattttggacagtgtaaggtactgcctgatgaaattacct

SEQ ID NO: 151304 - DNA, 601 bp, Human
cttatgcaagctacactggactgacatgatgatgggatagtcaggagatgactatgagtgacatgactatgactcagtatgccttatggtatatggtaaatactgtgattgagggggccccttttgcatggatacccccatgtaaccttactgctgtaaaatctagcaataatctgagaagccttatcagaagtattgtctaagcttccctttacaggtcttaacagatgctaagaaaatcagagttaagtcataagaaaacagggaaatagtagagtagaggtcaaggaatttatcccasgaagatggaaatctacagatggttgttttaaaatgggatgaataaattgaacacagatggaattgaaacaaaggtcttaatgcagcattaccatgggactggataaaccaatgagagccccagctagttcccaacattaaagggccttaaactaactatgctgtattttaccccagtttgggaagatttaaaaagccagggaacaaagatgacaataagcaacctgacctcaaattgcctgggacaatagtctggcagattactcaagatgaagacagagaggtcaaccagcaactgggg

SEQ ID NO: 151305 - DNA, 601 bp, Human
ttaaggttaaatggctctcctaataaatacaggtctaagaaaccgcatgtacaaagttggagggttaggtagagggttcttgctactaaagtgtaagtggaagataagagattgtttagtaaaaaagttaactttgcccaaagagagatctagcctttgccttcagtccctggcaggtaatctctaaccccctgaaatgtcctgcctgatgaaattatctttgtttgcctggggacttgagccaagctagatagtctgtgtcaacaatctgatttacagtgggagctctgggtcacacagyctcatatcaacctcaggaggagctgtcctggagactgaggtctaccatgtggctggtgaaccacatctatgtgacagagactgacccaataaaaattctggacaccaaggtttaggtgagattccatggctggcaatattttgtgcacactgtcacacatcactatcaggaggtgtttatgatgtccatggctccactgggagaagacaactggaaacttcacatttggaactctcctggactctgccctgtgcatctttcccttggatgattttaatctgtatcctttcactgtaataa

SEQ ID NO: 151306 - DNA, 601 bp, Human
cccattaggtcaaatatcagatccaccaaatcttccattcattaccctgctttaaaaaaaaaaaaaaaaaaggactgaaatccccattgatgtctcttctcccattcttagtctttgtaagtctacagattttttaattcctttaatgtgaatagaatttttggagggagatggaaaaaccccatggtttatctagaaacctagtaatgttctcaggtacaaaatttcatgcagttctatagctgctttcctttttcaaaacaacttctaaagccataaagtaaatcgaagacttcaattaaaaaaaaaatttaaataaagagaaaaaaataaaacatgtgggctgcaactgtaataacagccaataatagctaaactgttattgagtgcttactatgctaagcactttataggtacaattctcagtgcttgtaatcctcacaacaaccttataaagttggcagtatatttcacttaaaagatatacacacaaaacatagctcatctttttcactatgcagcaattattttaatttaaacaaaaattttaaaaagcagggagaggcaagaaaaaacaaaacacagttttagactgtataaa

SEQ ID NO: 151307 - DNA, 601 bp, Human
gagactgaaggtccccagagcttaatggacagatttatacttaatctccctgatttcagcctggtacttcctccccatgtggacctaatatccccaagtccagtgcctctctgattttatttctccagagaataggtccattttttgtgacacctatcatctctaggtactaggtattacaggttcctgagaaatatattgattggcttccttcatatctcctttgcatggccttagatcattcaatcccattaggtcaaatatcagatccaccaaatcttccattcattaccctgctttaaaaaaaaaaaaaaaaaaggactgaaatccccattgatgtctcttctcccattcttagtctttgtaagtctacagattttttaattcctttaatgtgaatagaatttttggagggagatggaaaaaccccatggtttatctagaaacctagtaatgttctcaggtacaaaatttcatgcagttctatagctgctttcctttttcaaaacaacttctaaagccataaagtaaatcgaagacttcaattaaaaaaaaaatttaaataaagagaaaaaaataaaacatgtgggctgcaactgta

SEQ ID NO: 151308 - DNA, 601 bp, Human
atatgggtctttttaaaaatcattgttctgggcattaaatgggacattttatcctggtgactctacattcttagatgaatttcttgcaatagttatctaataatttcccaacatttgttttcttttttctataatttatactggtctgctggaactcgtaatttttttcttttaaatattcttccgagggtgaaaaggtctctaaatcctaaaagagaggtaggaagggacagtgaaatgaaaaagcgccattactagcaatatggaagcaagtcagggagactgaaggtccccagagctyaatggacagatttatacttaatctccctgatttcagcctggtacttcctccccatgtggacctaatatccccaagtccagtgcctctctgattttatttctccagagaataggtccattttttgtgacacctatcatctctaggtactaggtattacaggttcctgagaaatatattgattggcttccttcatatctcctttgcatggccttagatcattcaatcccattaggtcaaatatcagatccaccaaatcttccattcattaccctgctttaaaaaaaaaaaaaaaaaaggact

SEQ ID NO: 151309 - DNA, 601 bp, Human
catggttccatttttttcctggagaccttcttcacaggatcctcagttttcattcctcattctaaattatcttaccccatggctgtcattttaggcattcccttaccttttactttcttggtttactaacttattttggtgaatcacattctctaatggctttccaaaaagaggtacataagaggcaaagcttctcaatacttgcatgatgaaacatgtctacattttattctcacattgatttatactttagctacagaattctagatcaaggctgggcatggtggctcacgcctgtaaycccagctacttgggaggctgaggcaggagaatcgcttgcacccggcaggggcagaggttgcagtgagccaagaccgcaccatcgcactccagcctgggcaacaagagcaaaattccgtctcaaaaaaagagaatactagattgaaaacctttgcccttcatctcccgactttcttttaacaatcctgttgttttgttttgttttgtttttggagacaaagtctcaatctgtcacccaggctggagtgcagtggcatgatctcagcttactgcaacgtctacctcctgggttcaagtgatt

SEQ ID NO: 151310 - DNA, 601 bp, Human
ttgggtatgagaaacaagtagagtcgaggatggtgccaagatttttggcctatgcaactgaaaaaaaaaatgcaactgccaaactgagatgaggaaaggctaccagtgaaaaaaggtttggagaaagtgatcagtagttgagttttggaagcgttatgtttgaaaaagtagacattcaagtgggagatgtcagagtctgtagggcagacaaatctgaaagttcaggaataaacaatgagctagaaatataaatttggaaatcaataacatatagatggtattttaagccctaagactataygtatagataatggtgtaaaccctcgtacatccaacctagaagaacaaacaaaataagcaaatgagattgagaaaaagtaatcagtaattagtaggaagaaaatgaaaacaatgtgttcttctggtagccaagtacataaatgtgttaaaaggaacattaaacatgtgaaatactgctgatacaataaggtatcaagatgaaaactgagaaaacacttctaaatttagtcatgtagtggttattcatgaccttgaaaagagcaatgttggtacaatgctgacagtcaaaagcatgtaaatt

SEQ ID NO: 151311 - DNA, 601 bp, Human
ataaagtgaaacagaaatggtaataaattggtaaatatgaaacaccagcttttactttctcttctcataacttccttaaaagacagcttttttttttaagtattgtatgttaaggtatataatgcatgaataaatgatgtggcaatagtacaaaggatagtaattgagtaaaatgaataatccttttgtaaagttactaaaaccatacaatattttaagtagacattaagttaaaattgcatatcactatccccacagcaatcgctaaaaataataaagtacagcttaaaaagccaacagkagatgtaaaatggaacaccaaaaactatttataaacttaaaataatgcagcaaagagacaacaaaagaacaaaacacaaaaaaagagaaataaaaaacaaatactaaatggtagatttaaccatatcacaagttatattaaatataacaagattatacattccaattaaaaaacagagaaaggagcctggcatggtggctcatgcctgtcatcccaacacttcgggaggcagaggcgagaggatcacacttgagcccaggagttcgagaccagcccaggcaacatggcaagaccccatct

SEQ ID NO: 151312 - DNA, 601 bp, Human
cataaaacattcaggaaggaacaatacgagtgacatccaaaacaatggaagccagaatacaaagtagtaatatcaatatcttttcaatgttgaaagaaaaaactgcccacccagaattctagagcaaattatccttctaaattgaagattttttttgtttttgtttttgagacagagtctcgcttgatcacccaggctggagtgcagtggggtgatctcagctcactgcaacctccgcctcctgggttcaagcaattctcctgcctcagcctcccaggtagctgggactacaggcacatgytcccacgcccagctaattttttgtattttagtagacagggtttcaccatgttgcccagactggtctcgaactcctgagctcaggcaatccacctgcctcagcttcccaaagtgctgggattacaggagtgagccactgtgcccagcttaaattgaggattttcatatgacaagaagatgagagtattcattgtcagcaaacctgcaaaacaagaaatgctggagaatattcattagaccaaaggaatataagagacagaaactcatatatactggaaggaataaagtgaaacagaaatgg

SEQ ID NO: 151313 - DNA, 601 bp, Human
caaagaaataggaaagcctaactcacagcaaagaaaaaagtactcaatacaaattgacaccaagatgatctagatgctgtaatgagctaaaagtttaaatgggctattgtatatttattcaaacctttaaatgaacataggttcttagtgaacaaactgacaggaaatctcaacagatagatggaaactactaaaagaaaaaaaggaaattctagaaaagtacaataactgaaatgaaaaacgtcactggatggacttagcagcaaatgggagatgtctgaagaaagggtatgtgaccatsaacacacatcaataaaaagtatccagtgtgaagaagagagggagagaataaattcaagaaaaatgaacaatcatcagggacccttgtgacaaaatcaaatagtctaacatacgtgtaactgaagtcctaggagacttggggtgttttttgtttttggagataggtctcactctctcacccaagctggagtgagcacagtggcatgatcacagctcactgcagcctcaacctcctggcctcaagcgatcctcccacctcagcctcccaagtagctgggactacaagcaagcactgccatgc

SEQ ID NO: 151314 - DNA, 601 bp, Human
atatatttttttaaatctccctacttttaatataaatttagaattgtgaatatctgctctcaagtttatccacacaaaatcttaattcaaaagtccaattctaagaaaagctattccttcccttccttttcttctttcccttctctcttcctctctccctttttttttttttaaataatggagatgggggccaggtgcggtggctcacacctgtaatcccagcactttgggaggctgaggcaggtagatcacaaggtcaggagttcaagaccagcctggccaacatagtgaaaccccatcrctactaaaaatacaaaaaaattagccaggtgtggtggcatgcacctgtaatcccagctactcaggaggctgaggtgggagaatcgcttgaactcaagaggcagaagttgcagtgagccgagaccatgccattgcacttcagcctgggtgacagagtaagactccatctcaaaatgaatgaatgaatgaatgaatgaatgaatgaatgagatggtgtttcaccatgttgcccaggcttgtctccaactcctggactcaagcgatccaccagcctcagccttccaaagtgctcagattacag

SEQ ID NO: 151315 - DNA, 601 bp, Human
actcagtatcagtctcatacagactacacaactccaagatagcaaggacagagcacattttttcattattgtatagctatcacctagcaaggtacctggtatacgatgagtacttgaatatctaccgaacaaatgagatcaatgaatactcatttgttgagtgaagttcaataaacaaaccattttgtctgacaataagtgtaccccatgaaaaaattatgcttggataggaaatctttatttgttgccatagctctgaatctagctccctaagaggactgacagtagatatgtatttacktatcacttctacaaaaaatgtattcagattcttcaactacttggattgcatctgaaagaatttttagggtcgggcatggtggctcactcctataaccccagcactttgggaggccgaggtgggtggatcacctgaggtcaggagtttgagaccagcctggccaatatggtgaaactgtctctactaaaaatacaaaaattagccgaacgtggtggtgggcgcctgtgatcccagctacttgggaggctgaggcaggagaatagcttgaacccaggaagtggaggttgcagtaagccaaga

SEQ ID NO: 151316 - DNA, 601 bp, Human
tttatctgtgaaactaacgactctgaatgtgtttcttcctcaagtcttctctcctgatattcttctctttcaagttaactcttagccatatggaattattctccttctagccataagcaatgattctgctgggtaactgactcattgaacctatgggctcttcagatagtttgatatcctaataggatcagaaactataatatgaaaattaatgaggctatgtttcagcaatacccaaatgaattaattcaaattttaaagaatactcaagggatgaactattacggaaccaaatactcartatcagtctcatacagactacacaactccaagatagcaaggacagagcacattttttcattattgtatagctatcacctagcaaggtacctggtatacgatgagtacttgaatatctaccgaacaaatgagatcaatgaatactcatttgttgagtgaagttcaataaacaaaccattttgtctgacaataagtgtaccccatgaaaaaattatgcttggataggaaatctttatttgttgccatagctctgaatctagctccctaagaggactgacagtagatatgtatttacttatca

SEQ ID NO: 151317 - DNA, 601 bp, Human
ttctttaggtatacttctgtgtataaattacgtatcttgtgactcttaaaagacttttaagactcttaaaatacaaaggccaggcatggtggctcaccccgtaatccgcaacaatttcggaggctgaagtgggaggatcgcttgcggcctgaagtgcaacaccagccagggtaataaagcgagaccctgtctggacaaaacattttaaaaaatgactgggggtggtggcacatgcctgtgcttccagctacttgagaggatcaccttagtccaagagtttgaggctgcagtgagctatgaycacaccactgctctccagccttggtgacagagtgagacctcatccccttaaaaataaaaaagtatgtagtcattatttatatgaactaaatttgcctatttgccaagaaatattcaaagggtagggataccacagtaaataaggtaaaataaggtcctgttcttcctttccttacattttaattaaggagaaaacaaaaatttgaatagggtgatgtgatagagaggacgttaagtggctaaacattctacattggatacatgcacagaagggaactcttgaagacgtgatgacaacgta

SEQ ID NO: 151318 - DNA, 601 bp, Human
taggagtgataaagatgttcactattttgactgtgatgatggattcacagtccgtcaccacaaagcagagatctaaaacctataccactacaaagcagagatccaaaagtgttatgaccttaacataagggtatactaagagtaacctgcccctctatcacctcaaaaagactgaatgacaataacaatgattctgtggaagaggaggggggagaccctcagaagttgtatccacaaaacacttcacatgtgaattttcagaccaagtgcacatcatcttggtggttcaaaacttcattcyggaaatttaactgtcggaaactggtagtgcttctaggcaatagcaacaggaaattcaatcctttattgtggaaagaaagtatcttaattttagaccaaaaaaaaaaaaattgcataatttttcaaggaaagaggaaagttcatagttttaaaagactacatatataaggaaaaacagcaccctaagcaagaatcaacagaaataacaggaagaactgactcactaacagaggcaaaataaatacatgtactctatttaaagaataaaacacagctaaaatgttcaggcaactatttaaaa

SEQ ID NO: 151319 - DNA, 601 bp, Human
atcatcatatatacatgcacaggactgtcctaagaattaaactggtcaaaacacacaaagcaaagcacttaaggcatactaaggatttaatgcttgctatcactgttattcttagcagtaattttaaaggatttatactgttagaatttatcttgttgcaaatgtatattgttccttatttaaagctctatatgaaggggagatgataacaaccataagagttcaggaaagggacagagagtaggaaatgtgagcaactgtgaggaaaatctgaaagggtagaaatttctataaagtatgrgaaagacattaaaatcctcacataaatagaacagggagcaaaagctaactctaattaaatctcaaaaatcacagtgacatcacctgatatttcaattacctaagacttcattagaacaggatgtcactttctattgctgtcttcaaaatcatttatcttttctcctgtaatatctaatcttctggctgggcacagtggctcacgcctgtaatcccagcattttgggaggccgaggtgggcagatcacgaggtcatgagtttgagaccagcctgaccaacatggtgaaaccccgtctctac

SEQ ID NO: 151320 - DNA, 601 bp, Human
aacctctgaagaattctaaccagaatgtaataatcacatttacattctaggaaaatcatcaaacagaaatataaaagacccaaagaagggaatagaagggaaagaccagctaaaactctaagacagtaactcatatcagagatcagggtacagtactggttggtacagccaaacaaacaagctggaactgactttatcagtgagatcagcagatttgagaggttatgtgtcagttatggcaaggtccatggtacaacctgaaaactaaatgcctagctaaggcacagtcaagaaacaaatmattggaaatgagttcacaattactgtgtaattgtctatatgggcactaaaatcacaaaagtaataatactatgagcatctaaatgtccattgtttcttcaatgaaagtctcagctaaggcagacaagaggaaagactatgaaattgttaacataaaggaaagtttgttaagataaagggaagtttacttagtagtgggatacaagaggtacaagaagaatggaggacagtaggagagaaaatgtagatcaatatgggaatttctgttatagaaaactgctggtgcactgactttattgtg

SEQ ID NO: 151321 - DNA, 601 bp, Human
atgagacaacaactgataaaatccacacataaatacttcaatatggccaaagaaaaatatacaaaagtcagaatatgagacaataactgataaaatccagaggcaaactgtgaagggccaagtatagcacactatttgtgcatttaattctctaagtaatggaaaacctctgaagaattctaaccagaatgtaataatcacatttacattctaggaaaatcatcaaacagaaatataaaagacccaaagaagggaatagaagggaaagaccagctaaaactctaagacagtaactcatatsagagatcagggtacagtactggttggtacagccaaacaaacaagctggaactgactttatcagtgagatcagcagatttgagaggttatgtgtcagttatggcaaggtccatggtacaacctgaaaactaaatgcctagctaaggcacagtcaagaaacaaatcattggaaatgagttcacaattactgtgtaattgtctatatgggcactaaaatcacaaaagtaataatactatgagcatctaaatgtccattgtttcttcaatgaaagtctcagctaaggcagacaagaggaaagac

SEQ ID NO: 151322 - DNA, 601 bp, Human
cagttttactttgtcagcatgaatgctatatgttaaaattttctaatcataatagtgcaaatatagactctaataacatttctttggctactaggaagctagaataatagttttctttgctacttttatttcctttttgtaaattatttattaggtttttaagttattaagtcaacaaatattatttagtttttttctatgtcctttttacatggactaaagaatccattattgtttgtactactaacaaatagtcacaaatacaaaatgataccatactgtgacaagagatataattcasgtatatataatttacaagaaaccactgcctaaatcggcctcaataccaagaaaagcacagcagagaagaacagcatcttatgctaggtacagaggcatgtttgagacatgtaaatacttcaatatggccaaataaaaatatacaaaagtcagaatatgagacaacaactgataaaatccacacataaatacttcaatatggccaaagaaaaatatacaaaagtcagaatatgagacaataactgataaaatccagaggcaaactgtgaagggccaagtatagcacactatttgtgcattt

SEQ ID NO: 151323 - DNA, 601 bp, Human
caaatcaactgtatcaccagtttaacctaaaacaactgaacatttccaaaaacaaaaacccaccaatggagtgtgtgtgtgtgtacaatctacaagctctaaggagccttttattttcttttggtgttacttaagataaaaagttctggccgggcacagtggctcaggcctataatcccagcactttgggaggctgaggcaggcggatcacgaggtcaggagatcaagaccatcctggctaacacggtgaaaccccgtctctactaaaaatacaaaaaattagccgagcatggtggtgggygcctgtagccccagctactcgggaggctgaggcaggagaatggcgtgaacccagaaggtggagcttgcagtgagcagagattgtgccactgcactccagcctgggcgacagaccgagactccgtctcaaaaaaaaaaagttctaccatgtgtaaagtactattttcattcattcattcattcaattatttaatacttttgagcatctactatgtgtcattttaatcataaattaatgaactttaatattcattagaagtcctaatatttttgagtctataaacacatattaaccttattc

SEQ ID NO: 151324 - DNA, 601 bp, Human
tttttgttttattttggctttgaaccatacctctagctgttgtaagagagattttcctttcttattaatttcattgataagggtgaaaatggccactttaatttcctgttctactcgtttgttagtctcatttacttcttttatcctgaataagagaaatgcatcattaggttatcaacttatcctaggtctctgaatcatcaactgttacagaaattcatccaactgggcacttaaccgagtaattaaaatgaaaactttgtcaaaatgtacaactcatgtttcagcagacctgaccaayttggtccaaacaagttatgtacatagacaaataatgaaactaatatttagtaattttaaattatgctcataaaggacagtttattaagctggatggcaatctacttaagtaactatgacatgaatgtgatgcacaaacaccagtgacttctggatagtgtcaaatgtggcacattggttctgtttaaccttgacgttttccaagaacaatgtgcaaaaggacaatgtcacaagcaataattatcttttgaaaggataatagttaaacatagaagcatttattttcatttataacttagcc

SEQ ID NO: 151325 - DNA, 601 bp, Human
gttgggattacaggtgtgagtcaccatacccagtcttagtaacaattatttgatttctaagaggacatcactatttcctaaggtatacagctaaagtcagtgttattaaattgggccgcaaagtaactaactagaaaaggtctcttccaaaagtaaattttaaaaaccttattttacgttttcctttatttccataccccccaatccatctaaaatagttttcaataaacattaaaaacagctaaagagcaagagaagcagtttttgttttattttggctttgaaccatacctctagctgytgtaagagagattttcctttcttattaatttcattgataagggtgaaaatggccactttaatttcctgttctactcgtttgttagtctcatttacttcttttatcctgaataagagaaatgcatcattaggttatcaacttatcctaggtctctgaatcatcaactgttacagaaattcatccaactgggcacttaaccgagtaattaaaatgaaaactttgtcaaaatgtacaactcatgtttcagcagacctgaccaatttggtccaaacaagttatgtacatagacaaataatgaaa

SEQ ID NO: 151326 - DNA, 601 bp, Human
atctagaaacttacacctacaaataaacttcaaaatatgcaatataaatacctaatatcacaaaattttcactaagtttaaggtttataaatttcaaaaagagcagcattttctgcaaaactatggaaatatttttaaaataaggtaaaatacacaaatgactcaagcagaagcccaacatgaatctatatggtaaaattaaattgaggccccatcttaagggggtggggaagaaatgtggtgggactactttgcctttacgtacatcacattttagtaacatttcttttttctttttctktttttcattttggagacagggtctcactctgttgcccaggctggagtgcaggacacaatcacagctcattgcagccttgacctcccgggctcagtcgatcctcccacctcagtttcctgagtagctgtgactactggtgcatgccaccaccctggctaatttttgtattttttgtagaggcaggtttcgccatgttgcctgggctgggctggatcccggggctcaagcgatctgtctgccttgggctcccaaagtgttgggattacaggtgtgagtcaccatacccagtcttagtaacaa

SEQ ID NO: 151327 - DNA, 601 bp, Human
ttgattaaaaatttagatttcatgaactgactagattttcatctagaaacttacacctacaaataaacttcaaaatatgcaatataaatacctaatatcacaaaattttcactaagtttaaggtttataaatttcaaaaagagcagcattttctgcaaaactatggaaatatttttaaaataaggtaaaatacacaaatgactcaagcagaagcccaacatgaatctatatggtaaaattaaattgaggccccatcttaagggggtggggaagaaatgtggtgggactactttgcctttaygtacatcacattttagtaacatttcttttttctttttctgtttttcattttggagacagggtctcactctgttgcccaggctggagtgcaggacacaatcacagctcattgcagccttgacctcccgggctcagtcgatcctcccacctcagtttcctgagtagctgtgactactggtgcatgccaccaccctggctaatttttgtattttttgtagaggcaggtttcgccatgttgcctgggctgggctggatcccggggctcaagcgatctgtctgccttgggctcccaaagtgttgg

SEQ ID NO: 151328 - DNA, 601 bp, Human
aagaagcatcttttaattcagaaactcttgaaatggttttacaaatactattttagacgtacagctcaaatgtattacagtaagtttaagtgtatcaaaaatagttactaagtgctctctattcacatgggtccttttggggggaaaaacctattagggttaaatgcaacagactggtgtacagtaggaaaagggacccacaactttaacaatctgcacaagagtactttttttttttttttgagacggagtctcgctctgtcgcccaggctggagtgcggaggcgcaatcttgcctcacygcaacctccacctcccgggttcaagcaattctcctgcctcagcctcctgagtagctgggattacaggcatacaccaccacgcctggctaatttttgttttttttttttagtagagatggggtttcaccatgttggccaagctggtctcgaactcctgaccttgtgatccacccacctcagcctcccaaagtgctgggattacaggcgtgagccaccgcacccggccaagagtacttttaatctcacaaattgtgtttcactggaaagatgtattccattcagagataacattctactgac

SEQ ID NO: 151329 - DNA, 601 bp, Human
catttctcttccatgtgaaaagagctactcttatctttcaaacattcctcaggacctaactactggacacattagcatcctaaaagtctgttgctaatgcacaatttggcttaattaaacaactaaaaatctatgaaattattccagacaatgaatcatttgctaagatttctatatgaaacagtcaatataaatttaaaagatggagggtcgggggactagaaacagcacacattaaaaaacaatatacagagtagacgctcaactttcttaagatgtaataacagccacacaaaaccayagctaaagtgagtttccaatgaataacaacatatttttacataaaatgtaaaacattagttttataaagttaaaaattttatctaaatttgctttaagtattttctccttctaattcagtgttccaagttatattcataaaactcattatttctcacctaaattgactacattctttgcccagaaggtgggatcacaatggaaacgtattgctccattagcagcagggacaggatcacaccgtgctttcaaaatatgacgcaactggaaagtaatcttaaagggaaaaaaatccacatta

SEQ ID NO: 151330 - DNA, 601 bp, Human
tggtctttaggtccatactacgctgtaacaaaaggaaaatccatttctcttccatgtgaaaagagctactcttatctttcaaacattcctcaggacctaactactggacacattagcatcctaaaagtctgttgctaatgcacaatttggcttaattaaacaactaaaaatctatgaaattattccagacaatgaatcatttgctaagatttctatatgaaacagtcaatataaatttaaaagatggagggtcgggggactagaaacagcacacattaaaaaacaatatacagagtagackctcaactttcttaagatgtaataacagccacacaaaaccacagctaaagtgagtttccaatgaataacaacatatttttacataaaatgtaaaacattagttttataaagttaaaaattttatctaaatttgctttaagtattttctccttctaattcagtgttccaagttatattcataaaactcattatttctcacctaaattgactacattctttgcccagaaggtgggatcacaatggaaacgtattgctccattagcagcagggacaggatcacaccgtgctttcaaaatatgac

SEQ ID NO: 151331 - DNA, 601 bp, Human
gagccattgccttctagggatagaagccaaattttaggaagatgtgatttaaggcacaggttgacaggctttccctgtaatgggctatagagtaaatatttcatgcttggcaggccacataagatctgtctcacagtccttggtttttgtttgcttttacaaccagttgaaaatgtaaaaaccattcttagctactacgtcacacaaaaacagctggctgatgtcagaactaaggctatagctaaatttgaatataatttttttttattatatgcaaagattactttttttttttttttawaaaaaaagggcaaccagcctctgcttttacaattcccactgtttaggacttaactgttctgaaagtgagtttactcaatctgtaaatagctctctaattgctaggaagtttgtgtgcatgtgttttaactgagctctctgtaactttcatctatggtctttaggtccatactacgctgtaacaaaaggaaaatccatttctcttccatgtgaaaagagctactcttatctttcaaacattcctcaggacctaactactggacacattagcatcctaaaagtctgttgctaatgcacaatt

SEQ ID NO: 151332 - DNA, 601 bp, Human
ggagccattgccttctagggatagaagccaaattttaggaagatgtgatttaaggcacaggttgacaggctttccctgtaatgggctatagagtaaatatttcatgcttggcaggccacataagatctgtctcacagtccttggtttttgtttgcttttacaaccagttgaaaatgtaaaaaccattcttagctactacgtcacacaaaaacagctggctgatgtcagaactaaggctatagctaaatttgaatataatttttttttattatatgcaaagattactttttttttttttttwaaaaaaaagggcaaccagcctctgcttttacaattcccactgtttaggacttaactgttctgaaagtgagtttactcaatctgtaaatagctctctaattgctaggaagtttgtgtgcatgtgttttaactgagctctctgtaactttcatctatggtctttaggtccatactacgctgtaacaaaaggaaaatccatttctcttccatgtgaaaagagctactcttatctttcaaacattcctcaggacctaactactggacacattagcatcctaaaagtctgttgctaatgcacaat

SEQ ID NO: 151333 - DNA, 601 bp, Human
ctgagccagtctcatctgatgggcttgaaaagctccacagttcatgttgcctctttgcattgtttgcacactgatcaatcgaggaggctacaaaaagtagaaattgcaatttatgtaataattttaaaataaatttatctcaattataaaatgtaatcataaaaataattcagtcaagataaaagggtataaagtaaaaagtataaataattcttatcgctagccccaatccccagaggactggtaatgactagtttgtatatcactccctaatttcccttgtctctctctctctctcttwcctgttccccctctttttctctatatgtgtgtttaaagcgtatcaacattaacgtatcccatcctggagtaatagttttgattgggatggcagtggagagagcaaaagacacacaggtataggaaagatctgaacaaatgcctaaggaacatatcagatcctaggcagaaacagtctggtcctttggtccacaaaattatacgtggaaaacaaaaaagatttgatgtgaaaggatgagaacttacatcctttcagagtattagtgaattaattttgtttcccaagacaatttacttactg

SEQ ID NO: 151334 - DNA, 601 bp, Human
tcccaaatacataattttgtaaattatgtatttttgtaatttgtaaattttgtaaacgtttcctaagcattacataaaaacaaatcccaaaaaactagtaataaaaaccaatgttgaattctgacttattttaaaaataagtaacagcatacaaacatacataaccagaagcaggaggtaaaaagtctccatctagctcaaagaaatgtatatccaaaagagttttgtatcttctaatagtcttaaaccatgtaaacacacccattttgtttcaacaattgtggagatataacgataattyggtccacagaaaaagtttcaaatcttaataataaccctattgtcactggaaatttaacaatttattataaaaaaatttttttcctgcagaaatttacaataggctaatctatatctatcaaataaagctatcttacagtaagataaaactctgttgaagaagtagaagtgtaattcaagtccaaggagagcttgctagggtatctggaattccagcggattcatttaaaataatgcaaaggtttttttaactttatagcatcaatatttacaatatgctataaagtacagcttttgaaac

SEQ ID NO: 151335 - DNA, 601 bp, Human
agaaggaaattctgtcatcttgcaacaacatgaatggaaccaaaggacattatgctatgtataatcagccaggcaccgaaagacaaatgctgactaatctcacttacatgtggaatctaaaaatgtccatctcatagaaacagaggatagaaagatggttaactggaggctagaggagagggtaggcggggaatgcggaaagagaggatgttgatgaaagtttcacttagactggaaggagacttttagtgatttagactttactcttcagaaatttcaaggaaatgttgatcctgaattaaaaaaaaaaaactctgaaataaatactctaactctgtaattaacattaagtttaatgaagcctcattcaactcaaatacaaacctgtatgggtggaatatctggcagcgatggaaggttttctggattggtaactgaggggattagctctattgctgtaacagatgggctggtgggacctcggtttgcatttgccatagttgctgtagtagggctcgttgggttgattgtggtgttgtgtaccgatactacgggaaagggtccagcatgccctgggtttgagtgctaataagaaagaaga

SEQ ID NO: 151336 - DNA, 601 bp, Human
tatacagcctctaaaaagaaggaaattctgtcatcttgcaacaacatgaatggaaccaaaggacattatgctatgtataatcagccaggcaccgaaagacaaatgctgactaatctcacttacatgtggaatctaaaaatgtccatctcatagaaacagaggatagaaagatggttaactggaggctagaggagagggtaggcggggaatgcggaaagagaggatgttgatgaaagtttcacttagactggaaggagacttttagtgatttagactttactcttcagaaatttcaaggaartgttgatcctgaattaaaaaaaaaaaactctgaaataaatactctaactctgtaattaacattaagtttaatgaagcctcattcaactcaaatacaaacctgtatgggtggaatatctggcagcgatggaaggttttctggattggtaactgaggggattagctctattgctgtaacagatgggctggtgggacctcggtttgcatttgccatagttgctgtagtagggctcgttgggttgattgtggtgttgtgtaccgatactacgggaaagggtccagcatgccctgggtttgagtg

SEQ ID NO: 151337 - DNA, 601 bp, Human
cctttgaaaaacccctaagctgccaggcgcagtggctcacacctgtaatcctagtaccttgggaggccaaggcagaggtcaggagttcaagaccagcctggtcaacatgatgaaactccatctctactaaaacacaaaaattagccaggcctgggggcgtgtgcttccagctacttgggaggctgaggaaggagaacagcttgagcctcagaggcagaggctgcagtgagtcgagattgcgccactgtactccagcctgggcaacagagctagacaccatctcaaaaaaaaaaaaaaaaaraaagaaagaaagaatgaaaaagaaaaagaaaaagaaaaactcctaaactacaagcctgcaaagagactgatttgagtaataactccacctcctgcgtggcgtgagtggcctcgcgtcattaaactctttactgcagtgccatggtctccgtgaattgattttgtttgtgtggtgggcagataacccgtcaggcggttatacgaacctctcttactcttatccataaaacagggatattacatatcaggtgattttaagcattaaacttatatattgcctgtgaaagcgcttcacaaacta

SEQ ID NO: 151338 - DNA, 601 bp, Human
cctgacagccagagaagaaaagcaaatgttcaatgatgaacaaatgatatatgtatacaatgaaatattattcagccataaaaaatgaaatcctaatacatgctaaaacatggatagacctggaaaacattatgctaagtaaaagaagccagacatcaaaggccaaatataattccattcacatgtggaatgtccacagagacaaagtagattagtggtttccaggggctggaagagaaggatatgagtgactgctaatgagtaccatttcttttgaggtgatgaaaatattcttgaattmgtggtaatggttgtacaatcttgtgaatgcattaaaagccactgaactgtacatttttagagtggatctcatggtatatgaattgtatttcaataaaaaagtagatgatacttgcctctccctttctaagtttcttaagaactagaaccaagtcttgtttatcttatcctcaatgcttgaggactttagcatacagtaagtgcttagtaaaaactgaatgacattgttatactgtacatacctctggctgcccaaagctgtcaataccatgtgtttccaggcctacaatcccacactgcc

SEQ ID NO: 151339 - DNA, 601 bp, Human
cttgaggtcaaggaccatttccgtttgatccttctataatcagtacttagggtcttaatacatggtaagttctcagatatttgttaaagaaaatatacaagtgcattaatagtgatccaagtttccagaaatgttctagtgttatgcagtattgaagacttggccttgaacctaataaaaggattccatatttaggtgctgttctactgattatcaggaaaatattacattttaccaacaaacagaaatgttctaaaactgattaatgagatacatgtactgtaccataagtgaaacactmaatatactacaaaacattccctgttttccatttactatctcctattaccttcttgcataaataaaatgtaaatgctaaaattcttcattttaatatatttcttctagttacctaactatatcaccattaatacatctgacttagtataatcaaaagctatacaaataattcctcatctattctattttgtataacaactcacttctgtattactccagttgtgccttctcactccctcaagccattgcatataccatactctatcttgaccaacaaatatatctcatatctacacactaa

SEQ ID NO: 151340 - DNA, 601 bp, Human
actgtctccctattatataagaaactccttgaggtcaaggaccatttccgtttgatccttctataatcagtacttagggtcttaatacatggtaagttctcagatatttgttaaagaaaatatacaagtgcattaatagtgatccaagtttccagaaatgttctagtgttatgcagtattgaagacttggccttgaacctaataaaaggattccatatttaggtgctgttctactgattatcaggaaaatattacattttaccaacaaacagaaatgttctaaaactgattaatgagatamatgtactgtaccataagtgaaacactaaatatactacaaaacattccctgttttccatttactatctcctattaccttcttgcataaataaaatgtaaatgctaaaattcttcattttaatatatttcttctagttacctaactatatcaccattaatacatctgacttagtataatcaaaagctatacaaataattcctcatctattctattttgtataacaactcacttctgtattactccagttgtgccttctcactccctcaagccattgcatataccatactctatcttgaccaa

SEQ ID NO: 151341 - DNA, 601 bp, Human
ataagaattgcttgagcccaggaggcagaggctgcaatgagccaagactgcaccactacactccagcctgagcaacaaagactccatctaaaaaaaaaaaaaaaaaaaagcacaacagcaataaaaaagaacaaaagaaaactgtctccctattatataagaaactccttgaggtcaaggaccatttccgtttgatccttctataatcagtacttagggtcttaatacatggtaagttctcagatatttgttaaagaaaatatacaagtgcattaatagtgatccaagtttccagaaatgytctagtgttatgcagtattgaagacttggccttgaacctaataaaaggattccatatttaggtgctgttctactgattatcaggaaaatattacattttaccaacaaacagaaatgttctaaaactgattaatgagatacatgtactgtaccataagtgaaacactaaatatactacaaaacattccctgttttccatttactatctcctattaccttcttgcataaataaaatgtaaatgctaaaattcttcattttaatatatttcttctagttacctaactatatcaccattaatac

SEQ ID NO: 151342 - DNA, 601 bp, Human
agtagctgggcgcagtggctcacgcctgtaatcccagcactttaggaggccgaggtgagcagatcacctgaggttgggagttggagaccagcctgaccaacatgaagaaaccccgtctctattaaaaatacaaaattagctgtgcatggtggtgcatgcctgtaatcccagctactcgagaggttgagacaggagaatcatttgaacctgggaggcagaggttaaggtgagtcaagatcgtgctattgcacatcagcctgggcaacaagaatgaaactccatctcaaaaaaaaaaaaaaaraaaagaaaagaaaaagactttttctgaaaagaaaaagtccaaaagcaaaactgtaaaaaaaaaaaaaaaaaaaaaaaaggtaaaacttgcaacacagtatttatagcactaggtgtgtacatgtggtataatctcattttctgttacttaaaaaaattacaggatggccaggttggctcatatctgtaatcacaacactttcggataccaaggtaagaggatcacttgagactaggagttcaaaaccagtctagtcaactattagtagcaagaccccatctctacaaaagaaaaatttaa

SEQ ID NO: 151343 - DNA, 601 bp, Human
atgaaaaagtccaaaagtagctgggcgcagtggctcacgcctgtaatcccagcactttaggaggccgaggtgagcagatcacctgaggttgggagttggagaccagcctgaccaacatgaagaaaccccgtctctattaaaaatacaaaattagctgtgcatggtggtgcatgcctgtaatcccagctactcgagaggttgagacaggagaatcatttgaacctgggaggcagaggttaaggtgagtcaagatcgtgctattgcacatcagcctgggcaacaagaatgaaactccatctcaaaaaaaaaaaaaaagaaaagaaaagaaaaagactttttctgaaaagaaaaagtccaaaagcaaaactgtaaaaaaaaaaaaaaaaaaaaaaaaggtaaaacttgcaacacagtatttatagcactaggtgtgtacatgtggtataatctcattttctgttacttaaaaaaattacaggatggccaggttggctcatatctgtaatcacaacactttcggataccaaggtaagaggatcacttgagactaggagttcaaaaccagtctagtcaactattagtagcaagaccccatctctac

SEQ ID NO: 151344 - DNA, 601 bp, Human
atttacatgtgaattgttcttcctctagaaagaagtaggtggtgtgtttcagtaagaaaaaaataacatttaatttacgttagaaaaatacattcaataacacttctagactgttaacctgtttggagttgcttcaatcatgtattcaagagtcccaattgaatcactgagtaatagggttaataaaaccgctgggattttggaagagagctacatatcatggctattttaatagttttcagcaaaatgtttattttaaaattacagtttgaaaattaacctgcccttctttagctcttaytttttaaataatttttcaatgtttcattattttactaagtgttttaaagttgacttggaaccaaagaactcttcaactgactctgtattgtaaaatataagattaaacccatgaaagactgtgaatatactaagggttgagtaatttggagttccaaatagtgtagactacagatatatattaatatggcttcagttactgaaagagtaccaatagtatttgaacaaaaataattacaaagaacaatcaagaaaaaaatatgttattgtgtcaacttggctaggatatgacacccagcag

SEQ ID NO: 151345 - DNA, 601 bp, Human
tggtaataaataaataagtaaataaattatcactgttgctcctcatggtaattccttagacaggcaagacaaatgttgaaagttatcatcccctttcttcaaatgattccagtcaggttcaaaatgaaaatggccttctcagtctaactccaaaaatatttttttacccaatcatgagtaaactgaaatgcattttacattcacagtcttctatttatctaaacttcttttaatacaagtttgtataccctaaacacgtatcttgtcttcacagatagtggatgagggtttttaccagtayatacaccagagtagagccaaacttaactctaatgaccacacgacaatgcaaaagagtctgtctttggcaatcagactacaggccagattggtaaaaatctgagtaaagtaaggagagagtttccatttttaatatgatgagaagctattagaggattttaagcaaggaaatgatagacttgtttacttttttaaaaagaacactgtttaatacagaaaacaaactataaaggtcaagagcagaagcggggagagcagttaagagatcactacaatagtccagatgagaaattatgatgta

SEQ ID NO: 151346 - DNA, 601 bp, Human
atgccatctggatgcttccagaggcagctataggaatacgttacaggatccaatgtgatttattttagtaataatcatatggcacccaaattacaccagcaataaagagactttagtattaatcttttaaaagattttgtggattctcattaaattccattttcttctcctacaatgaaactcttccataacaataatagaatcgattttatccctaataaaaacaatttccctgaaacaggtatataatacatttcttctcaaggcatggctaactcaaacttaccctcaaaaaaaaaamaaaaaacaaaacaaaacaaaacaaaaaacaaaaaactccccaaaccaaaaaacataaccaaaattaatcaaagtcacactgctgaaataagaaaacttagtattatatactctgggctactattcaagatgggtcaccagagattagtttgttattttaaggttctacattcatgttgtcaataataaaatgcaaggacatgggtacagataactttcctaatagtacccaaaacgtaagctgtttataatcatattccacaaaatatacgtaactactgacagtactttccatacttat

SEQ ID NO: 151347 - DNA, 601 bp, Human
ttcatcagagtcctcagttacctcaccatcatcctcttcctgctcaaactctggcaaaggtgcgaaggtcctgtctgagtagatctctgtgagtttatcttcaaagtacaatgcaactgctttccctgcctgagctacttctgaatcagcctgcaagcaaaagataggaatattcacctattggtaatgcatattccttcaccaagtttgcatggtctgaaaagcttaccttcaaattaatctcttgtgtgtctgcataaacttgaacaactttcatcatctaaaaaggataccagagtcaaaaaaaaaaagggaaattataatcctttctaaagttatgagactgcataggattggcgacgaaaagtcagccatactagggagaacaaattgctataaccagataaagtgcttttctaaaattctacagaacatggaaccattttctttacaaagccctgttactaaagctactgtgaaacctcagtaattgtcttattttgaattatcaaggtcaatctgaataggaattggtctgaacacatcaatctatccaagagaaaaatatttgtgaagcatattatacaagaaacgttgcttt

SEQ ID NO: 151348 - DNA, 601 bp, Human; identical to SEQ ID NO: 151285

SEQ ID NO: 151349 - DNA, 601 bp, Human; identical to SEQ ID NO: 151286

SEQ ID NO: 151350 - DNA, 601 bp, Human; identical to SEQ ID NO: 151287

SEQ ID NO: 151351 - DNA, 601 bp, Human; identical to SEQ ID NO: 151288

SEQ ID NO: 151352 - DNA, 601 bp, Human; identical to SEQ ID NO: 151289

SEQ ID NO: 151353 - DNA, 601 bp, Human; identical to SEQ ID NO: 151290

SEQ ID NO: 151354 - DNA, 601 bp, Human; identical to SEQ ID NO: 151291

SEQ ID NO: 151355 - DNA, 601 bp, Human; identical to SEQ ID NO: 151292

SEQ ID NO: 151356 - DNA, 601 bp, Human; identical to SEQ ID NO: 151293

SEQ ID NO: 151357 - DNA, 601 bp, Human; identical to SEQ ID NO: 151294

SEQ ID NO: 151358 - DNA, 601 bp, Human; identical to SEQ ID NO: 151295

SEQ ID NO: 151359 - DNA, 601 bp, Human; identical to SEQ ID NO: 151296

SEQ ID NO: 151360 - DNA, 601 bp, Human; identical to SEQ ID NO: 151297

SEQ ID NO: 151361 - DNA, 601 bp, Human; identical to SEQ ID NO: 151298

SEQ ID NO: 151362 - DNA, 601 bp, Human; identical to SEQ ID NO: 151299

SEQ ID NO: 151363 - DNA, 601 bp, Human; identical to SEQ ID NO: 151300

SEQ ID NO: 151364 - DNA, 601 bp, Human; identical to SEQ ID NO: 151301

SEQ ID NO: 151365 - DNA, 601 bp, Human; identical to SEQ ID NO: 151302

SEQ ID NO: 151366 - DNA, 601 bp, Human; identical to SEQ ID NO: 151303

SEQ ID NO: 151367 - DNA, 601 bp, Human; identical to SEQ ID NO: 151304

SEQ ID NO: 151368 - DNA, 601 bp, Human; identical to SEQ ID NO: 151305

SEQ ID NO: 151369 - DNA, 601 bp, Human; identical to SEQ ID NO: 151306

SEQ ID NO: 151370 - DNA, 601 bp, Human; identical to SEQ ID NO: 151307

SEQ ID NO: 151371 - DNA, 601 bp, Human; identical to SEQ ID NO: 151308

SEQ ID NO: 151372 - DNA, 601 bp, Human; identical to SEQ ID NO: 151309

SEQ ID NO: 151373 - DNA, 601 bp, Human; identical to SEQ ID NO: 151310

SEQ ID NO: 151374 - DNA, 601 bp, Human; identical to SEQ ID NO: 151311

SEQ ID NO: 151375 - DNA, 601 bp, Human; identical to SEQ ID NO: 151312

SEQ ID NO: 151376 - DNA, 601 bp, Human; identical to SEQ ID NO: 151313

SEQ ID NO: 151377 - DNA, 601 bp, Human; identical to SEQ ID NO: 151314

SEQ ID NO: 151378 - DNA, 601 bp, Human; identical to SEQ ID NO: 151315

SEQ ID NO: 151379 - DNA, 601 bp, Human; identical to SEQ ID NO: 151316

SEQ ID NO: 151380 - DNA, 601 bp, Human; identical to SEQ ID NO: 151317

SEQ ID NO: 151381 - DNA, 601 bp, Human; identical to SEQ ID NO: 151318

SEQ ID NO: 151382 - DNA, 601 bp, Human; identical to SEQ ID NO: 151319

SEQ ID NO: 151383 - DNA, 601 bp, Human; identical to SEQ ID NO: 151320

SEQ ID NO: 151384 - DNA, 601 bp, Human; identical to SEQ ID NO: 151321

SEQ ID NO: 151385 - DNA, 601 bp, Human; identical to SEQ ID NO: 151322

SEQ ID NO: 151386 - DNA, 601 bp, Human; identical to SEQ ID NO: 151323

SEQ ID NO: 151387 - DNA, 601 bp, Human; identical to SEQ ID NO: 151324

SEQ ID NO: 151388 - DNA, 601 bp, Human; identical to SEQ ID NO: 151325

SEQ ID NO: 151389 - DNA, 601 bp, Human; identical to SEQ ID NO: 151326

SEQ ID NO: 151390 - DNA, 601 bp, Human; identical to SEQ ID NO: 151327

SEQ ID NO: 151391 - DNA, 601 bp, Human; identical to SEQ ID NO: 151328

SEQ ID NO: 151392 - DNA, 601 bp, Human; identical to SEQ ID NO: 151329

SEQ ID NO: 151393 - DNA, 601 bp, Human; identical to SEQ ID NO: 151330

SEQ ID NO: 151394 - DNA, 601 bp, Human; identical to SEQ ID NO: 151331

SEQ ID NO: 151395 - DNA, 601 bp, Human; identical to SEQ ID NO: 151332

SEQ ID NO: 151396 - DNA, 601 bp, Human; identical to SEQ ID NO: 151333

SEQ ID NO: 151397 - DNA, 601 bp, Human; identical to SEQ ID NO: 151334

SEQ ID NO: 151398 - DNA, 601 bp, Human; identical to SEQ ID NO: 151335

SEQ ID NO: 151399 - DNA, 601 bp, Human; identical to SEQ ID NO: 151336

SEQ ID NO: 151400 - DNA, 601 bp, Human; identical to SEQ ID NO: 151337

SEQ ID NO: 151401 - DNA, 601 bp, Human; identical to SEQ ID NO: 151338

SEQ ID NO: 151402 - DNA, 601 bp, Human; identical to SEQ ID NO: 151339

SEQ ID NO: 151403 - DNA, 601 bp, Human; identical to SEQ ID NO: 151340

SEQ ID NO: 151404 - DNA, 601 bp, Human; identical to SEQ ID NO: 151341

SEQ ID NO: 151405 - DNA, 601 bp, Human; identical to SEQ ID NO: 151342

SEQ ID NO: 151406 - DNA, 601 bp, Human; identical to SEQ ID NO: 151343

SEQ ID NO: 151407 - DNA, 601 bp, Human; identical to SEQ ID NO: 151344

SEQ ID NO: 151408 - DNA, 601 bp, Human; identical to SEQ ID NO: 151345

SEQ ID NO: 151409 - DNA, 601 bp, Human; identical to SEQ ID NO: 151346

SEQ ID NO: 151410 - DNA, 601 bp, Human; identical to SEQ ID NO: 151347

SEQ ID NO: 151411 - DNA, 601 bp, Human
gtaacttctcaagtatatctaattctacatgacaatcaagtggatgaaatcaacacatctctcatcttgccctgtgcagcccagcccagcctcccaagtgtgggtgataggatagagggctttgttagggaaaggctgactcctgcagacctgctctgacaagggaacagagagagagagagagttctgttcctcttctcctcccctccctctgctcccagggaagttaatttcccccttgggtgggcatttaccctatactgattctctgaacacagcactagacatgaataaagaccaygtgggcacaaaagggaagaaacttaacttcataccggtgtctccctctccactcctgagatagccagatgggctctccttcaaaattcgggaagcaggaacttcagttagctcggacttcagttcctggaaggccaaagtgtccaaattccacgtagaaactgcattaaaagaaagagacaaaattttactgtaagaaaaaatggcccaaggattgactatgttgaggatgacatttaaataggctgccggccaggcgtggtggctcatgcctgtaatcccagcactttgggaggccgag

SEQ ID NO: 151412 - DNA, 601 bp, Human
agtgacctctacctgtatcctggggaagcaacccacactgccctgaaaacaagcaacgtaggggattctatgactggacttgaaaatggttgcaaaacattattattagtctggagggatcactttgtcttcatttgtcaagttgaccgggcaagatttcccacctgaaatcgtgcttcacttgaccagggaagtgctgctaatcccaatcctgaccatcagctgtgcaaacttgggcaagaaacttaccctctctgggcttcgattttttttctgcaaagtttagggaattaattaattatatatatatattatagaaatatatataatatatatataaatgtttaatgaggtggaagtgctgaatagtgcaagagaggagcagatgaaaatattaatttcagtggttcttaaaaattaggggtgataggtccttttgagaattagctgtgagtcctcttcctgggggaaaatgcatatggcatgtacataaaattttacatgcaatccctgagggtttgtggatactccctgaaagccatgcctgaatcccaggtgacaatcccttattcctcctcctgtatcaagaccacccagccaa

SEQ ID NO: 151413 - DNA, 601 bp, Human
gcaacccacactgccctgaaaacaagcaacgtaggggattctatgactggacttgaaaatggttgcaaaacattattattagtctggagggatcactttgtcttcatttgtcaagttgaccgggcaagatttcccacctgaaatcgtgcttcacttgaccagggaagtgctgctaatcccaatcctgaccatcagctgtgcaaacttgggcaagaaacttaccctctctgggcttcgattttttttctgcaaagtttagggaattaattaattatatatatatattatagaaatatatatwatatatatataaatgtttaatgaggtggaagtgctgaatagtgcaagagaggagcagatgaaaatattaatttcagtggttcttaaaaattaggggtgataggtccttttgagaattagctgtgagtcctcttcctgggggaaaatgcatatggcatgtacataaaattttacatgcaatccctgagggtttgtggatactccctgaaagccatgcctgaatcccaggtgacaatcccttattcctcctcctgtatcaagaccacccagccaactccttgctgctggttgggctgactgt

SEQ ID NO: 151414 - DNA, 601 bp, Human
aatcgtgcttcacttgaccagggaagtgctgctaatcccaatcctgaccatcagctgtgcaaacttgggcaagaaacttaccctctctgggcttcgattttttttctgcaaagtttagggaattaattaattatatatatatattatagaaatatatataatatatatataaatgtttaatgaggtggaagtgctgaatagtgcaagagaggagcagatgaaaatattaatttcagtggttcttaaaaattaggggtgataggtccttttgagaattagctgtgagtcctcttcctggggsaaaatgcatatggcatgtacataaaattttacatgcaatccctgagggtttgtggatactccctgaaagccatgcctgaatcccaggtgacaatcccttattcctcctcctgtatcaagaccacccagccaactccttgctgctggttgggctgactgtgggagtaatccacagccttcttgggggtctggagtcagccacgctgctgaaggagacagctcccctgtcatgggtgagctccccacatgctctctccagagctctaccagcctctgactccaggggacccctcctcacaac

SEQ ID NO: 151415 - DNA, 601 bp, Human
aaattttacatgcaatccctgagggtttgtggatactccctgaaagccatgcctgaatcccaggtgacaatcccttattcctcctcctgtatcaagaccacccagccaactccttgctgctggttgggctgactgtgggagtaatccacagccttcttgggggtctggagtcagccacgctgctgaaggagacagctcccctgtcatgggtgagctccccacatgctctctccagagctctaccagcctctgactccaggggacccctcctcacaaccctttttaatgactctcctaaggygacagtccttacccctagaattttcagtcccaccaaccctggagagccatctaaagaggatcgctgtctgaatcagagtgctcttcaggtcacctagctggatggcagggaggccaaggctttgtttggaaatgaagcagtctttgctccctgaggcatagtatgagtaggcagccatattcttttgaacctctgtactttgcctttagaggactaaggactcacatctctggggaccctgggtgttccactagcagtgccagcaaggcacatcagaaaacacacagggctttggagctc

SEQ ID NO: 151416 - DNA, 601 bp, Human
aaagtaaggaagccgatagaaggagaatatcaaaagtaaattaagtagctgaatgctgacaacgatttgtatttgatgtcccaaattccagttagtgcacctacaactgaactgtccaatacagtagccactagccacatgtgcctattgagcacttgaaatgtggctatttcatattgagatgtactgtaaatgtacaacgcaccccagatttttaagacctagtattcccccaaaaaagtaaactgtcttggccaggtgtggtggctcatgcctgtaatccaagcactttaggaggccraggcgggtggattgcctgagctcaggaattcgagaccagcctggggaacacggtgaaaccccgtctctattaaaaatgcaaaaattaggcaggcatggtggtgggtgcctgcaatcccagctacttgggaggctgaggcaggaaagtctcttgaacccgggaggcggaggttgcagtgagccaagattgcgccattgcactccagcctgggtgaaagagtgagactccgtctcaaacaaaaacaaaaacaaaagtaaactgtctcaatttttatattgattgtgtgttgaaatgataata

SEQ ID NO: 151417 - DNA, 601 bp, Human
cagctacttgggaggctgaggcaggaaagtctcttgaacccgggaggcggaggttgcagtgagccaagattgcgccattgcactccagcctgggtgaaagagtgagactccgtctcaaacaaaaacaaaaacaaaagtaaactgtctcaatttttatattgattgtgtgttgaaatgataatattttaggtatactagtttaaataaaatatattaaaattaatttaacctttttcctttaatgtggcttaatagaaatgtttaaattacatatgtgactcacatgatatttccgttgaayagcactgatctagactaataagttgacaaatacatgataggacctttttcccccttcttccaaacgtgacttcttcctctgttcttgtgtcaggctccttctcatctgcccccatattcagttatttggtgaagcacgagagaaaagaggtccctcttccttctcccccaccctcatgctgctggttagcaggtgatcatttgaagtccactataccatgtcactttgggatctgataaaatagactcagtgattatattcatcaccaagaccaatcctctcactcaggtaaatctcaag

SEQ ID NO: 151418 - DNA, 601 bp, Human
aagattgcgccattgcactccagcctgggtgaaagagtgagactccgtctcaaacaaaaacaaaaacaaaagtaaactgtctcaatttttatattgattgtgtgttgaaatgataatattttaggtatactagtttaaataaaatatattaaaattaatttaacctttttcctttaatgtggcttaatagaaatgtttaaattacatatgtgactcacatgatatttccgttgaacagcactgatctagactaataagttgacaaatacatgataggacctttttcccccttcttccaaaygtgacttcttcctctgttcttgtgtcaggctccttctcatctgcccccatattcagttatttggtgaagcacgagagaaaagaggtccctcttccttctcccccaccctcatgctgctggttagcaggtgatcatttgaagtccactataccatgtcactttgggatctgataaaatagactcagtgattatattcatcaccaagaccaatcctctcactcaggtaaatctcaagaggctttcaaacgtcctacaatgaaagggtcattttaaatctggatttaaagttttacctttaaa

SEQ ID NO: 151419 - DNA, 601 bp, Human
accctcatgctgctggttagcaggtgatcatttgaagtccactataccatgtcactttgggatctgataaaatagactcagtgattatattcatcaccaagaccaatcctctcactcaggtaaatctcaagaggctttcaaacgtcctacaatgaaagggtcattttaaatctggatttaaagttttacctttaaatcacttcctagtacattgtctttgtagttttgggcactttgtaaaatcagacgaggagacaactagagcttcatgtttttgtgcaaagctcattaaataagtaayctcatgcagtaataaatgtttctccctgtcctcttgcttaaaacagcatgaacaaaaagtagtcccagttgccagaagggctactccaggggcatcacaaaagaccacctttggtttctttcttttgtccactagctaaagtggccctcaaatatgtcaatgaaataaagatatattttttttcctgcagtttcatttatttcaaaaaaaagagcagtcagattctggtattgctggagaaagcctctgaagagcaaagacctggattctgcttttgtgtactctactggtttgcatgtt

SEQ ID NO: 151420 - DNA, 601 bp, Human
atctgtcactggtagactgagttctttctctagtctgtataggttccagagagagaacacccaattgaaaaaggacaagctggttttattcactggccagaaatggaaaatgagagacctcttgctctaaaaagtcaccttctccctagctgtgggaagctgcaggattgtgatgagttagatgtggggcggggagctatgtaaacacatgcagggagaaagtacagaggcacagacacagataaacatgtttctccatgcgtcctatggagagaaaatggcggcagttttcttctagggrtggggagcccagcattgtaacgctatgttaatgacctaaacggaacaaggggtagccagttctggtttgcactggtttcctgcaggcctcttgtatttggcaaaggatcaccaagctcctgcgacatcccaggccatctggagttctttaagcaagagtatctatagataaagaaactagggaagataacaatttaagaaaataatgagctttcccagctatttctctagggctgccctggtaatatttctacatcaacagcaacacatatttttcagcattgtgtaagccaggaaatct

SEQ ID NO: 151421 - DNA, 601 bp, Human
gcaaaggatcaccaagctcctgcgacatcccaggccatctggagttctttaagcaagagtatctatagataaagaaactagggaagataacaatttaagaaaataatgagctttcccagctatttctctagggctgccctggtaatatttctacatcaacagcaacacatatttttcagcattgtgtaagccaggaaatctatgctagactccacggggaaaatagaagaataaaacatggttcttgctctggaggagcatagttcctagttgggaaggtggacagaaacataaaagaccrgtagcatgtaaagaacattttctaagtgttacataaatgatgcaaacaaagttttgcaattctggagggcagcatgcccataacctctaaggtatattaagaaagacaaagtagaaaatgggcattgagggctggaagcctaaagacacaaggagagaaggagagagccacctcacataagaaaaaatgcacagtggtgtggcagtggaaatgtacatgggttcgggggtgcgtgatgtggaaaagaacagttggcttaatccagtggctccagatctgagctttacatcagaatcacct

SEQ ID NO: 151422 - DNA, 601 bp, Human
aaaacatggttcttgctctggaggagcatagttcctagttgggaaggtggacagaaacataaaagaccagtagcatgtaaagaacattttctaagtgttacataaatgatgcaaacaaagttttgcaattctggagggcagcatgcccataacctctaaggtatattaagaaagacaaagtagaaaatgggcattgagggctggaagcctaaagacacaaggagagaaggagagagccacctcacataagaaaaaatgcacagtggtgtggcagtggaaatgtacatgggttcgggggtgsgtgatgtggaaaagaacagttggcttaatccagtggctccagatctgagctttacatcagaatcacctgagaagcttttaaaaattacaaatgcctcagccccactccagagcttccatttaattagtttaagactggggactggtctcagtggtgtttctgattgattttgttttgtttttgtttctgtctcaatttcccagaatattctaatgtgaagtcagagttgagaatcactgagcaaaaaccaagatttttatatcatagtcatgggacataaaatgaaagaagtaatctttt

SEQ ID NO: 151423 - DNA, 601 bp, Human
gtggcagtggaaatgtacatgggttcgggggtgcgtgatgtggaaaagaacagttggcttaatccagtggctccagatctgagctttacatcagaatcacctgagaagcttttaaaaattacaaatgcctcagccccactccagagcttccatttaattagtttaagactggggactggtctcagtggtgtttctgattgattttgttttgtttttgtttctgtctcaatttcccagaatattctaatgtgaagtcagagttgagaatcactgagcaaaaaccaagatttttatatcatartcatgggacataaaatgaaagaagtaatcttttaaaggagattaaatggacaaccaagagtgtgacctttaatttgtagaaactgtatatacatgcacatttgtatgtagtcttttaaattcacagataattcctcgtggtgattctgtctacttggatgatgtggctgaaagcctttgtaaccagctgcctactcttgtcctctgtgtactttgggggtgtcctatagtggatcctagctaagtggggcacaatgggcatctcacaggagcttgtttctaccaggctttttgtaatcat

SEQ ID NO: 151424 - DNA, 601 bp, Human
cctatagtggatcctagctaagtggggcacaatgggcatctcacaggagcttgtttctaccaggctttttgtaatcattgccaagggctttattatcatgcctaatagtgcccacagtagctattttataagcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaragtgagtctacccactctcctgttggtgttagaatgttatttcttacatgaatgaatcagtgtcacagatcagtaggtgaagatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgtt

SEQ ID NO: 151425 - DNA, 601 bp, Human
ctatagtggatcctagctaagtggggcacaatgggcatctcacaggagcttgtttctaccaggctttttgtaatcattgccaagggctttattatcatgcctaatagtgcccacagtagctattttataagcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaawgtgagtctacccactctcctgttggtgttagaatgttatttcttacatgaatgaatcagtgtcacagatcagtaggtgaagatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttc

SEQ ID NO: 151426 - DNA, 601 bp, Human
atagtggatcctagctaagtggggcacaatgggcatctcacaggagcttgtttctaccaggctttttgtaatcattgccaagggctttattatcatgcctaatagtgcccacagtagctattttataagcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaaagkgagtctacccactctcctgttggtgttagaatgttatttcttacatgaatgaatcagtgtcacagatcagtaggtgaagatgactggtttccctaagctgccaacactgtgattatctgagtgtcaatgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttctg

SEQ ID NO: 151427 - DNA, 601 bp, Human
agcatctgcaatcttccctcacctctccaactttacaaattgagaaatggagtttaattacttgccttgggccaggagactagctggtgatgaaggtgaaatgagaattctcagggaggtgaaattagaatttccagctactgaattccacataccttattaaactcccaaagtgagtctacccactctcctgttggtgttagaatgttatttcttacatgaatgaatcagtgtcacagatcagtaggtgaagatgactggtttccctaagctgccaacactgtgattatctgagtgtcartgacccataggcagtcacagtggtcccgagagccccgtccctgatgcctgggagctctcagtctagtgaagtttggccttgcatatttatagtttatccactctaacatctgggaagtgaagactctggttgctattccactgctcctagccccacactttacggctgttctgatttcccttctctgaagctcttgttcactgaaaggatatcagctttttgctacacccctgaaaaaaagaggagaaagcccagcattttaaacagctgcttttttttttcttttggatggagtcttgc

SEQ ID NO: 151428 - DNA, 601 bp, Human
ctcaccgcaacctctgcctcccgggttcaagctagtctcctgcctcagcctcccgagtagctgggactacaggcacgcgccaccaagcccggctaatttttgtatttttagtagagatggggtttcaccatgttggccaggatggtctcgatctcttgacctcctgatctgcccgccttggcctcccaaagtgctgggattacaggcatgagccattgcacccggccaacagctacattttaaagaatcctttatatgtgttgggagcttctgggttcactgcccacggtgagactagggstggggacggaggttcttctgaaggacagtgcggggaaaaagccagagtcttggcaatacagcctctttagacaaaaagataggtcaatttgtaccattcccaaatggttgggttttcttttctctgtctcaaaatccattactgatttaaaacaatttccaaaagctttagcaatagcaaaaagcaagcctcttaaacagtgttgctccacactgattgcacgtgagaatcacctagggagctttagaaacaactatagactcactgaatcaatattctgggaaggggcctggacattcg

SEQ ID NO: 151429 - DNA, 601 bp, Human
ctctgcctcccgggttcaagctagtctcctgcctcagcctcccgagtagctgggactacaggcacgcgccaccaagcccggctaatttttgtatttttagtagagatggggtttcaccatgttggccaggatggtctcgatctcttgacctcctgatctgcccgccttggcctcccaaagtgctgggattacaggcatgagccattgcacccggccaacagctacattttaaagaatcctttatatgtgttgggagcttctgggttcactgcccacggtgagactaggggtggggacggargttcttctgaaggacagtgcggggaaaaagccagagtcttggcaatacagcctctttagacaaaaagataggtcaatttgtaccattcccaaatggttgggttttcttttctctgtctcaaaatccattactgatttaaaacaatttccaaaagctttagcaatagcaaaaagcaagcctcttaaacagtgttgctccacactgattgcacgtgagaatcacctagggagctttagaaacaactatagactcactgaatcaatattctgggaaggggcctggacattcgtatttatttac

SEQ ID NO: 151430 - DNA, 601 bp, Human
gtttcaccatgttggccaggatggtctcgatctcttgacctcctgatctgcccgccttggcctcccaaagtgctgggattacaggcatgagccattgcacccggccaacagctacattttaaagaatcctttatatgtgttgggagcttctgggttcactgcccacggtgagactaggggtggggacggaggttcttctgaaggacagtgcggggaaaaagccagagtcttggcaatacagcctctttagacaaaaagataggtcaatttgtaccattcccaaatggttgggttttctttyctctgtctcaaaatccattactgatttaaaacaatttccaaaagctttagcaatagcaaaaagcaagcctcttaaacagtgttgctccacactgattgcacgtgagaatcacctagggagctttagaaacaactatagactcactgaatcaatattctgggaaggggcctggacattcgtatttatttacagttctccaggtttataatgtgcatccagggctaagagctactactggtcagctatgatccaaatcttaattacttatttgtatttcttcttttgccttgttttagagtc

SEQ ID NO: 151431 - DNA, 601 bp, Human
ctggacattcgtatttatttacagttctccaggtttataatgtgcatccagggctaagagctactactggtcagctatgatccaaatcttaattacttatttgtatttcttcttttgccttgttttagagtctcatggcccagaaaaccatcaaactatatttttgttgagtagcaatttcatcattctgttctttaaaaaacatgattttgagcataatttaagtttgctacttctatagagagacctcacactcagtagcctcatcactaaaattttctgtgtgcaatttagaaatcasattgccagaagcttgctaattaattatgagactgaaagataaaggttaagctttcctgccacctatatattagatttcccaattgctatgttaatctttagttaaccaagacttgctttcttgtctcagccattttaaagccaattaactctgttcctgttcacacccttattaaaaatataattacagcagtagtctccagggactgtcattgggtaggctttaccaaggtaaattagccaagaaataactaggctgtgtaacaccctctcagaccctggaaatcattttggttgcaga

SEQ ID NO: 151432 - DNA, 601 bp, Human
tatttacagttctccaggtttataatgtgcatccagggctaagagctactactggtcagctatgatccaaatcttaattacttatttgtatttcttcttttgccttgttttagagtctcatggcccagaaaaccatcaaactatatttttgttgagtagcaatttcatcattctgttctttaaaaaacatgattttgagcataatttaagtttgctacttctatagagagacctcacactcagtagcctcatcactaaaattttctgtgtgcaatttagaaatcacattgccagaagcttsctaattaattatgagactgaaagataaaggttaagctttcctgccacctatatattagatttcccaattgctatgttaatctttagttaaccaagacttgctttcttgtctcagccattttaaagccaattaactctgttcctgttcacacccttattaaaaatataattacagcagtagtctccagggactgtcattgggtaggctttaccaaggtaaattagccaagaaataactaggctgtgtaacaccctctcagaccctggaaatcattttggttgcagaagctacttagtatca

SEQ ID NO: 151433 - DNA, 601 bp, Human
gcagaagctacttagtatcagagtaggctggggtactcataaatttggatttggaaaaagccaattccaagtcatcctaaatgtggaagaatctgtgattttgagaatgattctggaatcagttatccagggtccagccaagtctgatacaccgatcctcagaaggttgtattaataacaaaaagaaaccaggtttttgtattagatttgatggaagaggctgggggacagaaggtgatgtagcattttgttttctggggtgctgagattgtgggattaggagaaaataagaaaaaagatygcaggggagaacgatggacagaggcctcctgttagtcaactatcatgggcatcagaatttctttattcactcaactaatgtttatggaggttctgctttgttccaaggacccattataggagctggagatagaaggatgaagttcctactctagtgtagtttagattccagtaagaggaaacagatatccacactaaaaacaaacaataaataaaacccaataaattagtcagtactatgaaaaaaatgcaatgaactgaagggaatagagtttgctgaaggctgctttcaatagcttgt

SEQ ID NO: 151434 - DNA, 601 bp, Human
tgggcatcagaatttctttattcactcaactaatgtttatggaggttctgctttgttccaaggacccattataggagctggagatagaaggatgaagttcctactctagtgtagtttagattccagtaagaggaaacagatatccacactaaaaacaaacaataaataaaacccaataaattagtcagtactatgaaaaaaatgcaatgaactgaagggaatagagtttgctgaaggctgctttcaatagcttgtacaagttgcactgtctgaggaggtgcccttcaagctagcacatcartactaaaaagaaaagcatgccgagagctggcagaaagaaggcttcaggcagaaagaacaacagcaaaagtcctaagactggaaaaggtctgagttgttcaggaaacagaaaggagaccattgtggctggacccgaggtaagaagcaatgagggaaaggtgggaaaagagcaaggagggcccgaggtcatgggatggagttaggctgttaagtgctttgagagcctaacatcctaactcattgggaggttttcagcagggtaggaacatggttggcattgcctttgagagctcttcccagc

SEQ ID NO: 151435 - DNA, 601 bp, Human
ttagattccagtaagaggaaacagatatccacactaaaaacaaacaataaataaaacccaataaattagtcagtactatgaaaaaaatgcaatgaactgaagggaatagagtttgctgaaggctgctttcaatagcttgtacaagttgcactgtctgaggaggtgcccttcaagctagcacatcaatactaaaaagaaaagcatgccgagagctggcagaaagaaggcttcaggcagaaagaacaacagcaaaagtcctaagactggaaaaggtctgagttgttcaggaaacagaaaggaraccattgtggctggacccgaggtaagaagcaatgagggaaaggtgggaaaagagcaaggagggcccgaggtcatgggatggagttaggctgttaagtgctttgagagcctaacatcctaactcattgggaggttttcagcagggtaggaacatggttggcattgcctttgagagctcttcccagcttctgtgtggagaatggcttgaagactgaaagcagagggtttgtaggaggctgatcggaagtacaagcaagaggggagggtggatcatgccaaggtgacagcaagcaaggtggaa

SEQ ID NO: 151436 - DNA, 601 bp, Human
tagattccagtaagaggaaacagatatccacactaaaaacaaacaataaataaaacccaataaattagtcagtactatgaaaaaaatgcaatgaactgaagggaatagagtttgctgaaggctgctttcaatagcttgtacaagttgcactgtctgaggaggtgcccttcaagctagcacatcaatactaaaaagaaaagcatgccgagagctggcagaaagaaggcttcaggcagaaagaacaacagcaaaagtcctaagactggaaaaggtctgagttgttcaggaaacagaaaggagmccattgtggctggacccgaggtaagaagcaatgagggaaaggtgggaaaagagcaaggagggcccgaggtcatgggatggagttaggctgttaagtgctttgagagcctaacatcctaactcattgggaggttttcagcagggtaggaacatggttggcattgcctttgagagctcttcccagcttctgtgtggagaatggcttgaagactgaaagcagagggtttgtaggaggctgatcggaagtacaagcaagaggggagggtggatcatgccaaggtgacagcaagcaaggtggaag

SEQ ID NO: 151437 - DNA, 601 bp, Human
gtaccactaggagacactaaaactgggccgggcttccgggagttggactggtggggagatggcataatctagaggctgaatgatccaacccccctccaggaaggcctcacatctaaaccacctgccatctgccaaggtgggaggataaaccaccccccaccccgccgccaacagggcactggctggtgaaagttgccaataccagaggagtcttgatgaaatgccctctcttttcctcaaactctttctgcctactattcatagtatctgtgttgtacccacccacctgccacttatcaawgactgaagaaaccaaagttattcaacaagccatgaagcaaattctaattgctccccacggccatctgaggctggcctttggaaacttaaaaaaaaaaaattaaaaaaagagagtcatattaatttatttgttaccacattatttgctttaaaattctggtggcttctttccagtgttttattagtagaagcgaaataagcctaggaaacacaatatttcattctgtcttctctgcttttcactgcatatctaccttcaaaaatgtcttctctcaagttacttggtttctcaataactagc

SEQ ID NO: 151438 - DNA, 601 bp, Human
ccactcagttctatttcacacccttcttgtacttcaccaacaaaccagcaacatgcttctggttggcagcccttataaaagaatttaccttctatagtcaagtccaaagctcttaactgcttaccacatgacagccaataagacaagatattggggcaaggaagatgactttttttcagggagccagcaatcctagaagatggcagactgatgtactaaagaaccatcttaagttgatagattgttaggctccttttatgttaggggaagggggaataggtagggggttaaggtccacagktgactggtgaccacaggcatctgggcatcagcagggatctaggaggttgcaaaacttctttgttcatggtcaactattttccagattgaccttgtttctataaatttttaagatggcattgttatttgtgtgcatactttctaatctcctcaggggtctgtttcaaaagagagatggtcattagttctgaagttaaactataatctaaattctttccatcattagcttggcctatgtataggaatgagcaaaggcagttagcctgtgaggttagaagcaagatggagtcagctatgtgat

SEQ ID NO: 151439 - DNA, 601 bp, Human
gggcagtgtacaattcccagaaataaggaaagggtagaagcacctgtttttcctctagcaaaaccaaggcaaatggaaaagctcagaaatatatcagcaccattagcaagaggcacaacggggaaggctggaaatgtgctgaggaaaatcacattgccggtcaacgcatagctacctgctggagaagagagtctgcagacacacctcagcctggacaaaggcctccaggaccgggagctgtgctctgcaggaactgggccccaggcactgaggactgaaaaccagcccaacaaagcatacytgtttccatttgtgagagatgaaatgatatgggttttgtgactcactaaaccacttggaaggccaaacaattacaaaagcaagatgcctggcttcttctagccacatggaggggccctcagacttgagtagctgtgtgccacttgtctggggtggctgcaccaaaaggaacagtgaggtttagatgcttgttattgttcattgttcagttttggttctgtctatttacttctaattcctcaaatattattgtgattagtggtatagaaaggaaacgttcatttgtgagcaaagtgtgtaa

SEQ ID NO: 151440 - DNA, 601 bp, Human
aaatcagaagccccagaccttaatttcaactaatctgatgacatcattttgtactcagagtttcatttcccaacaatttcatgtttcttagtaggtggggaacccagaattgaaaggcatcaaaaacagctaaatataaccaaaaacctgctaactcaccagctttctaaaattcaggaagtatctttaacttgattgctgaatctccaaagacatgatgatcagatgactggttaatgggtattttttcagactctacatgattatcagaaatggctgccctggccaattgtatacctaygaagaggtattatgtagaagaacttatattcatctacttaatgtggacctcaaatattaaggatgttcctaatgtgttctagaccggagtcagcaatacttttcataaagagccagatagtaaatatttctaggctttttgggccatatagcctctgtcacaattcctcaactctgctcttgtcacacaaaagcagccatagacaatgcataggtgaatgaatgtggctgtgtttcaataaaactagactctcttaatgccaagtatttgctggaataacacaaattaatttatcctcaa

SEQ ID NO: 151441 - DNA, 601 bp, Human
cacaaaagcagccatagacaatgcataggtgaatgaatgtggctgtgtttcaataaaactagactctcttaatgccaagtatttgctggaataacacaaattaatttatcctcaaatctgtttaacctattaatatgtcagtcaatattacattaatattttatgaatctggtatcatattatacatgaatttatctgaacatttggttaattcatgaatatttactcaatattaatactacatcatgaatctgttatcaagtcatatacagatttcttaaaaaatttcccttatttagcrtacttgtgaataacatcaataagcaagtatcttaagttaactatcaggttatatagcagatcctctcccccttttgtaactctttctgttacaagggattttacattattatggtattgggaagtaagtctatttatcctgtccctatctgtcttcgtattaaccatattctgttatagcttttatctttgcagacagaatagttcaaatcttcatgatttgtccttaaacaacccccacttcctcatcctcttgaacattttatgcctccatcactgtctcttcaggtcttgtgagtcc

SEQ ID NO: 151442 - DNA, 601 bp, Human
cccccacttcctcatcctcttgaacattttatgcctccatcactgtctcttcaggtcttgtgagtccttgaagtgcagtgactaggctggaacatggtgttccaggttggtcacatcacctcttcctaatgatgccccattgtaccttttgactatagcaaggaataaacaaagtcagaagtgtgaaagtgggggagaaattgagaaagtgcaggggatttaggggagagaaaaatggactacaggaaaagaaaacattgacttttgcaaagtgctctaaactggctacaaatgcattccktaattctttaaaccttaattgtaaccgcagttaagctttccggtgtgttggaataagaacaaaactaaaatccttctttgtatagaaattatcctgcagtaacttagagccaatatctctagttaggatgagcgcagtggctcatgcctgtagtcccagcactttgggaggctgaggcaggtggattgcttgcacccaagtagtttgagaccagcctgggcaacatagcgaaatgctgtctctacaaaaaaattaaaaaattagacgagcatggtgtcacgcacctgttgtcctagctac

SEQ ID NO: 151443 - DNA, 601 bp, Human
ctctcctcttctctcctgactctgtgagaaaagtttgcatgaatttactgagattagttatagaaggaactgtgtgtcattgaaagtcttgtacagaagttcacattaaaatatatcatagtcatctttgggaatgattctgcaaaattcataaaacaaagatctctgaaaccctaaggcacactgtgctggaggctaagggaataatagtgagctgagtggtttctgcctacacagagcttctaatatattgaggaaagagatctcaatcaaattcaattgcatttataagtatggtaargacaacaaaggagagagacattattctgtaggagaataaccctgtcaaagtgatgactgatttaagatcaaaatgggaaggtaaaattttctcagtacctgcaaaggcactgaggtgggagggagcatgccaatgtagggaaatgaagaaacccagtgtgtatgagccaagctgaataaaacatgagaagaagctggagaatgagagagaccagtccccaagctctcaaggagcaagaggaagccttttcggcatttgaagtggagggatggcatgatctcgtgcgtagtttttaaaaga

SEQ ID NO: 151444 - DNA, 601 bp, Human
agccttttcggcatttgaagtggagggatggcatgatctcgtgcgtagtttttaaaagaaccactcaggctactcttttgagaatattgtgggaggccagagtagatgcctatagacttatacagaggttaaggcagttgataagagtataaacaatgatggtagcttacctcacatgctttttagattataggctagaaggtggcccaagcccatataccatcatggcacagtgaatacgttttccttctggatcgtggaaatgaatattgtgccacacagcttgattgacactccccartgacttttaatactgtgggatctctggcacatacttcagaagatgagaaaggagttttaattaacctctgtttaggaattccatagacataattttcattaacatctacttggtatttcatctccatgaattctttccagtgataaagctagttggtttatcctccaggactgctcagttctgaacagtgggtcttaagtactctttggatttctttgaaggcttttttttatttttgttgactacctctctactcattttgccccagaaaaaatgtagtcatttctttgataagtgaaa

SEQ ID NO: 151445 - DNA, 601 bp, Human
ttaaggcagttgataagagtataaacaatgatggtagcttacctcacatgctttttagattataggctagaaggtggcccaagcccatataccatcatggcacagtgaatacgttttccttctggatcgtggaaatgaatattgtgccacacagcttgattgacactccccaatgacttttaatactgtgggatctctggcacatacttcagaagatgagaaaggagttttaattaacctctgtttaggaattccatagacataattttcattaacatctacttggtatttcatctccatraattctttccagtgataaagctagttggtttatcctccaggactgctcagttctgaacagtgggtcttaagtactctttggatttctttgaaggcttttttttatttttgttgactacctctctactcattttgccccagaaaaaatgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaa

SEQ ID NO: 151446 - DNA, 601 bp, Human
agtgaatacgttttccttctggatcgtggaaatgaatattgtgccacacagcttgattgacactccccaatgacttttaatactgtgggatctctggcacatacttcagaagatgagaaaggagttttaattaacctctgtttaggaattccatagacataattttcattaacatctacttggtatttcatctccatgaattctttccagtgataaagctagttggtttatcctccaggactgctcagttctgaacagtgggtcttaagtactctttggatttctttgaaggctttttttwatttttgttgactacctctctactcattttgccccagaaaaaatgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaaatggattcttatataggcttaaaatttttataatttttttggcattctagaatgaaataaagaaaatcggtatcatcttgatctcatcacccagaagaaaaaa

SEQ ID NO: 151447 - DNA, 601 bp, Human
cacacagcttgattgacactccccaatgacttttaatactgtgggatctctggcacatacttcagaagatgagaaaggagttttaattaacctctgtttaggaattccatagacataattttcattaacatctacttggtatttcatctccatgaattctttccagtgataaagctagttggtttatcctccaggactgctcagttctgaacagtgggtcttaagtactctttggatttctttgaaggcttttttttatttttgttgactacctctctactcattttgccccagaaaaaawgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaaatggattcttatataggcttaaaatttttataatttttttggcattctagaatgaaataaagaaaatcggtatcatcttgatctcatcacccagaagaaaaaaaaaacactgatacatggtgaaatattttcctctctcatttttaa

SEQ ID NO: 151448 - DNA, 601 bp, Human
tgataaagctagttggtttatcctccaggactgctcagttctgaacagtgggtcttaagtactctttggatttctttgaaggcttttttttatttttgttgactacctctctactcattttgccccagaaaaaatgtagtcatttctttgataagtgaaatctaagaaaggcttatttcatttggtacattaaagagatggaagaaagtaactttacataagaatataaatgccagctgtccagcatattacagaatagatttctaaatttgctgaaaggttaggaaaatggattcttatrtaggcttaaaatttttataatttttttggcattctagaatgaaataaagaaaatcggtatcatcttgatctcatcacccagaagaaaaaaaaaacactgatacatggtgaaatattttcctctctcatttttaaaaagaatcaggaatagattgtatacatatttttcaaattctttctacttagtgttatatgatagtcaataatatatgtgtatgtaagtagcaataaatcattcctgaaaacttgttttttaagcttgtataacattccgtcatatggatgtactgattttgctaat

SEQ ID NO: 151449 - DNA, 601 bp, Human
atggactatgatttgggtttacttttaatttttttcaataattgagaagctcgtcacccttctttttatttctacaagtggttacacttaaagtttccaagacatttctatccatatcttatacttagcaaagtcaaagacatgaccatacagttttctaatcaacttcaaaatgaaatgttatctttgaataaccccatcaaaagaaatttaatccatttttacttccttccaacctttcctcagtattggtaagaataatttaacattttttattcatgttactgtcagtaaatatttyatattatatgacttctcttttgtgaattatgtgatctgttcagcaacataatcctttacaatacattcctgagcagttctatggttatctgatttctgtgtccataactattgtctttttataccataaatttctcatttttttactttttaattttaatatcttaagattcgccaccttttatcccatttatccttttagggtgtataatgtaggtcatctacattttgagaagtgcctgattctgtttactatagtgtcagttttaccccttactgccttcagtggacaaattagtac

SEQ ID NO: 151450 - DNA, 601 bp, Human
cataagacatgatctttttcagtgggtaatttaaggtctttcttctactgctagcattgtcatgtgtaaggctggtgggttgagtctttggaatttgtgaagattcttccaggttgtttaaaaaatcttttgattctcacaaatgtattttttctatttcttagaattatgttctttatggctaccaggaaatcctttgaaactggaattagattgcattattccactggggtaataggattggtaaggtaggagtgtctttgaagaataatgctaaataacccagacactaaggctgaawcttcagcacagctcttaaggcatcctgtaagtaccctctgctgcttattagaaatcccaaagccctgctcccttaggaaagcggcccatccccatcctcatcataagatgcaaggcatagctaaacatctcaacttctcacttgagtattatatactctcaggccaggatactttccaactcaagagtaagataacattacattctgatcttcttgtgtgtgtttttatgttttttttttcattttatttattatttttttttttgagacagaaattttactcttgtcacccaggctgga

SEQ ID NO: 151451 - DNA, 601 bp, Human
agtctttggaatttgtgaagattcttccaggttgtttaaaaaatcttttgattctcacaaatgtattttttctatttcttagaattatgttctttatggctaccaggaaatcctttgaaactggaattagattgcattattccactggggtaataggattggtaaggtaggagtgtctttgaagaataatgctaaataacccagacactaaggctgaatcttcagcacagctcttaaggcatcctgtaagtaccctctgctgcttattagaaatcccaaagccctgctcccttaggaaagyggcccatccccatcctcatcataagatgcaaggcatagctaaacatctcaacttctcacttgagtattatatactctcaggccaggatactttccaactcaagagtaagataacattacattctgatcttcttgtgtgtgtttttatgttttttttttcattttatttattatttttttttttgagacagaaattttactcttgtcacccaggctggaatacaacggcgcaacattctgatcttcttttgagagaaaagtttcacacaattagcctttgaaatacacattcctttaagta

SEQ ID NO: 151452 - DNA, 601 bp, Human
ttctctacccctctccttcaggccacagataggaagaatgacattgggtccaaagttctggcacaaagaatgatgtctgccttcctgtgatgatttcaaattcagggtaataattccaactatctttccctggccatgatagaaagctcaagaaatcttggttccttgtctcttttcttccatccagttggtctttctaattacacactcaacacaatgttctgctgagcaagacatctgctgtagccactatcacccttggcataaccagatatttaaaggtacctaaaggagtttagcyatattttgccaagatcctaagttctatggcataagaatccatccacttctctattgcctatagaaaaggacagctcagtctttctgaaagaattgttctcaaacaagaaagcatttgaggtaacatgtcaacaaggtggactggtaattggtgttcctttcagagccagttggaggaaatggccagctcagacattctcttctccccagtgtcctatgggaacaagatttacccagacacagctgactatgagaagtcttcagggatttacaacctgtctaagaacaaggccaatggggg

SEQ ID NO: 151453 - DNA, 601 bp, Human
gttctggcacaaagaatgatgtctgccttcctgtgatgatttcaaattcagggtaataattccaactatctttccctggccatgatagaaagctcaagaaatcttggttccttgtctcttttcttccatccagttggtctttctaattacacactcaacacaatgttctgctgagcaagacatctgctgtagccactatcacccttggcataaccagatatttaaaggtacctaaaggagtttagctatattttgccaagatcctaagttctatggcataagaatccatccacttctctaytgcctatagaaaaggacagctcagtctttctgaaagaattgttctcaaacaagaaagcatttgaggtaacatgtcaacaaggtggactggtaattggtgttcctttcagagccagttggaggaaatggccagctcagacattctcttctccccagtgtcctatgggaacaagatttacccagacacagctgactatgagaagtcttcagggatttacaacctgtctaagaacaaggccaatgggggactcactttgcaacacgtccctatttgattgtcagaggacagatactctattaa

SEQ ID NO: 151454 - DNA, 601 bp, Human
aaaggaatttgcactggtattttcagggacacatcaagtaattgccacttgaacgtttttccaggctttcaaaggaatgtaagaatggcctaaggctaaattacattcatgtctttagtgagtcattatattactggcaataaagtatattattactttactttcagatgccctcacatatttttttaaagtagaaaggagacatattatggtcaccattcttaagagacttaactaaaagacactaatttaatcttttagttacttaaaaatagctgttgctcacccactatgtgccagkctctataccaggcaccaatatgaaaaggtgagtattctctggtctccctaagcacagtctagtggaggagacagacaaaatgcagccatggccagaagggggagcagttaatgaacaagtaggcagagagtagggaggggattctgagagacagtacggacggactgagggtaagttgtacatccctgatattttgggcaattgcaaatagtttgatgaccaaatcacaaggagaagaagtgacagcaagcatggctgaaaatgtaggttggtgtcaaattgtaaaaagccttgaatact

SEQ ID NO: 151455 - DNA, 601 bp, Human
ggaatttgcactggtattttcagggacacatcaagtaattgccacttgaacgtttttccaggctttcaaaggaatgtaagaatggcctaaggctaaattacattcatgtctttagtgagtcattatattactggcaataaagtatattattactttactttcagatgccctcacatatttttttaaagtagaaaggagacatattatggtcaccattcttaagagacttaactaaaagacactaatttaatcttttagttacttaaaaatagctgttgctcacccactatgtgccaggctstataccaggcaccaatatgaaaaggtgagtattctctggtctccctaagcacagtctagtggaggagacagacaaaatgcagccatggccagaagggggagcagttaatgaacaagtaggcagagagtagggaggggattctgagagacagtacggacggactgagggtaagttgtacatccctgatattttgggcaattgcaaatagtttgatgaccaaatcacaaggagaagaagtgacagcaagcatggctgaaaatgtaggttggtgtcaaattgtaaaaagccttgaatactgtg

SEQ ID NO: 151456 - DNA, 601 bp, Human
aattcatcccatcctgtctctaaatacttttttctttaccaatttatgggaatttgagaccagatatctggaaccaagcagcctcaccctattaagggaaagaaaaagaacagaagaaaagaggagaggagaagagaagagaagagaactaaaagtatctgcaaaaatattaaaggatttgaccgagatctctgagatgctccaaagattgcaattgtgcttactatccaagttaatggctgtaaatctaagagaattatgatgtgcctggtaaatattggttgttttgttttaagtcttcatggagaaaatggaaaagacattggcatgtaggatgaagtcacagcaggacagacaggtcctgcaagtgtttctttagatgcattgatattcataacatccaaacaggccttaaggctgtcttcttactttacacttaccaaaggggtaaaatatcattttccttggacacacaaataataaacgtactctcacaacatcacttgaatgttgtggttttgcaaatatactatgttttaaaagctatagccctcaaatcccttactagacatcaatatttgttggaatttcaacatcaaag

SEQ ID NO: 151457 - DNA, 601 bp, Human
aagaaggatgaacaatctgcagatgaagtactctgtaaaggaaagatctgggtttgaattctaaccctgcctccgttcatctgtgtgatcttcgcaaagtctgttaactctttaaactgttggatatttataaaatgggactggtgctatttggcctgatatcttacaggggaagattcagtcaggccaggcgtatgtagggtctctctgacctggaaagccctatataaagacatggtaccattcttagtgttaggactgaaactacatccctagtgtcctgacacctcataccaatacmcagaaaccctaggctcttccttcaatcccatactccttcctcagctgccaggacagcttggttaagaaaagccttgttcttggggagtatatccatgaaagtatctctatttcgttgcagtttcacattaagtaaaattagagtgcccttcacgaagaatatataattgaaagccctcccactgactgctggacaaagcacttgtcagtcaacaaaccaggtagattgagtctgccctcagagtttttgtattctgagagtgactagcaactttctctcatcctagagcaacagggcttt

SEQ ID NO: 151458 - DNA, 601 bp, Human
tcttcgcaaagtctgttaactctttaaactgttggatatttataaaatgggactggtgctatttggcctgatatcttacaggggaagattcagtcaggccaggcgtatgtagggtctctctgacctggaaagccctatataaagacatggtaccattcttagtgttaggactgaaactacatccctagtgtcctgacacctcataccaatacccagaaaccctaggctcttccttcaatcccatactccttcctcagctgccaggacagcttggttaagaaaagccttgttcttggggagyatatccatgaaagtatctctatttcgttgcagtttcacattaagtaaaattagagtgcccttcacgaagaatatataattgaaagccctcccactgactgctggacaaagcacttgtcagtcaacaaaccaggtagattgagtctgccctcagagtttttgtattctgagagtgactagcaactttctctcatcctagagcaacagggctttcagaggacaggttctggggcagcgtgtagccacgatagaattggtttgcttttgtgtccaaagtcatgattatcaggagagctgccat

SEQ ID NO: 151459 - DNA, 601 bp, Human
tattctgagagtgactagcaactttctctcatcctagagcaacagggctttcagaggacaggttctggggcagcgtgtagccacgatagaattggtttgcttttgtgtccaaagtcatgattatcaggagagctgccatttatcaaccacctctttgatacttggtgtataggacaggcgtgttaactatattatttctaaaccacaagataagtctgtgaagtatttttatccctggtttacaaaggaagaaatgaggctctgcgagacatgccagaaagaacatgctctacacaaccarctggttacaatgtgcggctttgtccagcactacctcttctttcttggcaatcatcagagccactcaaggcttggaggactgtgctggcaaaaaagaaatcttgtattttctaaaactcacacccacactttggaggggacaagattgagatcaaccccatttcctactcttttctttatgacagtttatcagagcattttttccttatattcactcagtcctgagtttctatttagttgtgataatagatacatttttgaatttttaataccttcgggtgcaaatttggaatctatggag

SEQ ID NO: 151460 - DNA, 601 bp, Human
agaaagaacatgctctacacaaccaactggttacaatgtgcggctttgtccagcactacctcttctttcttggcaatcatcagagccactcaaggcttggaggactgtgctggcaaaaaagaaatcttgtattttctaaaactcacacccacactttggaggggacaagattgagatcaaccccatttcctactcttttctttatgacagtttatcagagcattttttccttatattcactcagtcctgagtttctatttagttgtgataatagatacatttttgaatttttaataccttsgggtgcaaatttggaatctatggaggataagggagtaacaaaatgttatggaaattgaaatatataaattattaattttccctctcctctacagatttacaatcactttatttggggatatcaagtaggttatgtggttactgtagtactcatttaataatcagattttatttagagaactataaaaggtacaacttaagggggaaatatattttagatgatgtttttttttcaatttccaatttttgaagaatgacgtgtttttaaaaacttttaaagaatttctcccacatttcactc

SEQ ID NO: 151461 - DNA, 601 bp, Human
gttgtgataatagatacatttttgaatttttaataccttcgggtgcaaatttggaatctatggaggataagggagtaacaaaatgttatggaaattgaaatatataaattattaattttccctctcctctacagatttacaatcactttatttggggatatcaagtaggttatgtggttactgtagtactcatttaataatcagattttatttagagaactataaaaggtacaacttaagggggaaatatattttagatgatgtttttttttcaatttccaatttttgaagaatgacgtgkttttaaaaacttttaaagaatttctcccacatttcactccctttaaggtaaattgatagctgtgaaaatggcaccttggaaacatttctgtcataatcataggagagagtgagaattattaatattctcagccatgtagcatcataaagtagatcacagctgtttctttcagaaaatgtcatttgattttcgatcagatgtatggtccatctcacaatctaaccgcttccacatctggaatatcttaactgaaaatgtccacagcattacacggcctggctcagggggagaaaagaacta

SEQ ID NO: 151462 - DNA, 601 bp, Human
aaaggtacaacttaagggggaaatatattttagatgatgtttttttttcaatttccaatttttgaagaatgacgtgtttttaaaaacttttaaagaatttctcccacatttcactccctttaaggtaaattgatagctgtgaaaatggcaccttggaaacatttctgtcataatcataggagagagtgagaattattaatattctcagccatgtagcatcataaagtagatcacagctgtttctttcagaaaatgtcatttgattttcgatcagatgtatggtccatctcacaatctaacygcttccacatctggaatatcttaactgaaaatgtccacagcattacacggcctggctcagggggagaaaagaactagggcctgcatcgaattctgtctctcactcagctgatctgcattcctcctatagcatttccttataattaagaagagctcatagatttgggaactgcatgagcctctgtaaccttctggtgagggtgagaagctcagaactgcatttctatgcatttttccctagtctttcctgcttcggaggagaagccctgcaagagcttcctgccaagggaccctgctttct

SEQ ID NO: 151463 - DNA, 601 bp, Human
gagagaggcaaagagaagatactggaaatgccaatatccagtcaatgaaataaacagaggctactgtaggcatccccagaagcttgccttttgtccagtgccatgggaaccacagaaggcactcagctttgcagcttcactcagaattggggcaatgctccacagagtcaagggcatgttattataaagtgctccatttgtttactttggcaagtggaagatgactttgctaagcgatactctgctggggctcagggccagcactgctggagtaggaaaagggagacttcctggggcaagscttctcaatcttcctgccagcagcattgcagtcggagcggcactgaggtgtcaacaaaaggatgatgaactgtgtcagcagtgttagcaaatggctgaagtagaacggagctgcccaggatgctgccctgtcgctggggaatctgagggaggctgaaagatattgtaaaagagattgaagggctggactggctggaggaatggtgccatcggcatccatgccacaatactccaggactgccctgcctttgtcaggacagccatcagaggcggttttccctctaaccaggatgggcatcac

SEQ ID NO: 151464 - DNA, 601 bp, Human
gaaggactagtgtgagtgatggaagcagctgagctgaggagtgctggcacctgtgcaaatccagcaagaatgacatctggctgagcttcagtcattcacctaagcaccaatcgggggtcactcccagatctgagcaatgagggaaacttcccagggggaaccccgcacttgggtagacctgggggagcagccagaaggaaaggggttgaacctgtagttgattaagattcagagaaagaaaaaacaaaaacagaaaacgatcatagtttcagacactcccaatgagcctgtgacctccccraaatcctatagccaaacacacgggtggatctggcctcactttcccattctcccacttgtgacttttgattccacatcatagctaaggtcctcggcaaattggattaaactttggatttaaaaataaaatagaattaaaataaaataaaaaagttggggacaggagaaagtggtttccaagaacctacacctctctaccctgaaatgactgaatattgtgttcccctcaaaattcatatgttgaaatcctaacccccaatataatggagcctttgggaggcttcatgaatgagattagtgc

SEQ ID NO: 151465 - DNA, 601 bp, Human
ttgcttagagcctgttaaagactgaggccctctctctgtcccttctactcccagccaaacccaatagacacatgtgagcaagttgtcacctgacccgaagctccagcccctggaaccaactgaaacaaaatgtatccttgcattttccagcaaggaattgccttgcctacaaaaatactctgtactttaatatgcagatcaattattaacagtaggctgtacctttcaccaggttgtaaaaggatgactgcgtagagccacagcattctccttgtcagtgtaggaaatgcagaggaggatgttacctccggcacttgcctctaagacacctaataaagatgaggaaggctccagcctgaagcgtgggtgaggtgtccagctgcccaaaggcgacaggtgagatactcaggtccccttcctctttttgctgtcagttctgattctctcctttcaatctttctcatctgtgattgggaatggcaggggtggggtgtgtttggggcatcagtggtggtaaaaatggtcttatgggcagggccatgttgaataagagatgagcatggagacagcgtattaacttaaaaggccaacaccgaggctc

SEQ ID NO: 151466 - DNA, 601 bp, Human
ttgaataagagatgagcatggagacagcgtattaacttaaaaggccaacaccgaggctcatttgagaccgtaggaattccagggagacagtgttgttcaggcatgggatcgaagatcaggagggcggctcaataacacgctggcccggtcacatgacagaccagtccttggagtgaactgggagacaaggaggctgctttggcatggagctgagaacatctctagatcgcactggaaggcagagagaggccagacagggaactctgaagagctgccacagcctgtgccagggtgacatcarggtgagttgagatgatttttttaacaaacttcattttttgcagcagtcttaggcttacagaaaaattgaacagaaagtacagacagttcccacatacccgttttcccccacagagtttcttctattaataacatcttatgttcgtgtggtatgtttatcatgatgaaccgatgttgatatatcattattaactaacaagtccagagtttacattagggtttactttttgggtcgtatggttctatgagttttaacaaatgtataatgacctgtatctatcattacagtatcatacagaat

SEQ ID NO: 151467 - DNA, 601 bp, Human
cttaaaaggccaacaccgaggctcatttgagaccgtaggaattccagggagacagtgttgttcaggcatgggatcgaagatcaggagggcggctcaataacacgctggcccggtcacatgacagaccagtccttggagtgaactgggagacaaggaggctgctttggcatggagctgagaacatctctagatcgcactggaaggcagagagaggccagacagggaactctgaagagctgccacagcctgtgccagggtgacatcagggtgagttgagatgatttttttaacaaacttcatyttttgcagcagtcttaggcttacagaaaaattgaacagaaagtacagacagttcccacatacccgttttcccccacagagtttcttctattaataacatcttatgttcgtgtggtatgtttatcatgatgaaccgatgttgatatatcattattaactaacaagtccagagtttacattagggtttactttttgggtcgtatggttctatgagttttaacaaatgtataatgacctgtatctatcattacagtatcatacagaatagtttcacttccctaaaaatcaccctcccttcctt

SEQ ID NO: 151468 - DNA, 601 bp, Human
tctgaagagctgccacagcctgtgccagggtgacatcagggtgagttgagatgatttttttaacaaacttcattttttgcagcagtcttaggcttacagaaaaattgaacagaaagtacagacagttcccacatacccgttttcccccacagagtttcttctattaataacatcttatgttcgtgtggtatgtttatcatgatgaaccgatgttgatatatcattattaactaacaagtccagagtttacattagggtttactttttgggtcgtatggttctatgagttttaacaaatgtrtaatgacctgtatctatcattacagtatcatacagaatagtttcacttccctaaaaatcaccctcccttccttcctgcaaatctctgacaactgctgatctttttactgtctctatacttgtgtcttttctgaaatgtcatgtagtcagaatcatgcagaatgtagtcttttctgactgcttctttcacttagcaatatgcttttaagcttcctccatgtttttccagggcttggtagcttctctccgttttagcactgagtgatactccattgtatggatgtactgtagtctgtttatc

SEQ ID NO: 151469 - DNA, 601 bp, Human
aatctctgtatccaaacctttctatatgaaagatacagtgtctgtgtctcacaagaatctgttttcttcgggtgtctgttatttgagtgctaaccagaacagaatttctaaagatggtctttgaggccaggtaacaaggctgaggctaagaagaactatggaaggtctgttggcaggagagatgtatgattagatctgcattagcagaaggaaagttctggctgaaatctgcagagcagtttggaggggacaagacagatgacatggagaacacttaggacgctgttataataaaataggmtagaaatgatgttcctcagaagtccctttctccctgcacacctggccacctcagacttcctgttcaaggggaaggcaggctggggagagaggtttcttgaaaataacacatctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgagg

SEQ ID NO: 151470 - DNA, 601 bp, Human
atttgagtgctaaccagaacagaatttctaaagatggtctttgaggccaggtaacaaggctgaggctaagaagaactatggaaggtctgttggcaggagagatgtatgattagatctgcattagcagaaggaaagttctggctgaaatctgcagagcagtttggaggggacaagacagatgacatggagaacacttaggacgctgttataataaaataggctagaaatgatgttcctcagaagtccctttctccctgcacacctggccacctcagacttcctgttcaaggggaaggcaggytggggagagaggtttcttgaaaataacacatctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacaga

SEQ ID NO: 151471 - DNA, 601 bp, Human
ttgcttaggccaaagcagaactttttttttttttcctgaggcaaagtctcagtctgtcacccatgctggagtgcagtggcacaatctcacaatctcggctcactgcaacctccatctccccagttctagcgattctcctgcctcagacttccgagtagctaggattacaggcacctgccactatgcccagctaatttttgtatttttagtagagacagggttttgccacgttggccaggctggtcttgaactcctgacctcaagcgatccactcgcatcagccttccgaagtgctgggatyacaggtgtgagccaccatgcccagccagaattatttttagtactgtagttaagagggcacattctggagcaaactgcctgctaagtgttcgctgtggggcattggggaagaacttaatctctttgtgccttggtttccacatgtaaaatgggataattatattgtccccctgtactggtttgctggggctgccataacaaagtaccacaactgggtggcttaaacaacagaaatgtgttgtctcatagtgctggaagccgactcacctcagaagcatggactcccttacctccaagtcca

SEQ ID NO: 151472 - DNA, 601 bp, Human
tctagcgattctcctgcctcagacttccgagtagctaggattacaggcacctgccactatgcccagctaatttttgtatttttagtagagacagggttttgccacgttggccaggctggtcttgaactcctgacctcaagcgatccactcgcatcagccttccgaagtgctgggattacaggtgtgagccaccatgcccagccagaattatttttagtactgtagttaagagggcacattctggagcaaactgcctgctaagtgttcgctgtggggcattggggaagaacttaatctcttygtgccttggtttccacatgtaaaatgggataattatattgtccccctgtactggtttgctggggctgccataacaaagtaccacaactgggtggcttaaacaacagaaatgtgttgtctcatagtgctggaagccgactcacctcagaagcatggactcccttacctccaagtccaaggcaatggggctctctccctcttgcctcttgaattcctgcatctcatttcactgggtaaacagggaggctcctgtgctccagcaggaaaaccctggactgggaagcaggatgtctactctgat

SEQ ID NO: 151473 - DNA, 601 bp, Human
aatcatgaactcttcacactgagaggaatcttcataatccattttgtagataacgaacctaaggctgaagaggtcaggggcttgcacccagtcatagagctaaatgaggtgcaaagaacctagaactccggcgtcttgactcccacctgggacacattttatcagtaatagtgaactctcatctgttgatagtgttagaattctcacatttactccccataacaactttctttttttttttttaaacggagtttctctctgtcacccaggctggagtgcagtggcacgatctcagctcacyacaacctctgcctcccgggttcaagctattcttcagcctcagcctccctagtagctgggaatacaggcatgcaccatggcgcctggttaatttttgtatttttagtaaggatggggttttgccatgttggccagactggtctcaaactcctgacctcaagtggtccacctgcctcaacctcccaaagtgctgggatcacaggtgtaagccaccatgcctgaccagcacccttctgaagtaggtgctttcagaaatctgaaagcatagtgtcggttagcagggttggatctcttctggtac

SEQ ID NO: 151474 - DNA, 601 bp, Human
agtgaactctcatctgttgatagtgttagaattctcacatttactccccataacaactttctttttttttttttaaacggagtttctctctgtcacccaggctggagtgcagtggcacgatctcagctcactacaacctctgcctcccgggttcaagctattcttcagcctcagcctccctagtagctgggaatacaggcatgcaccatggcgcctggttaatttttgtatttttagtaaggatggggttttgccatgttggccagactggtctcaaactcctgacctcaagtggtccacstgcctcaacctcccaaagtgctgggatcacaggtgtaagccaccatgcctgaccagcacccttctgaagtaggtgctttcagaaatctgaaagcatagtgtcggttagcagggttggatctcttctggtactgtgaggaagaatctgtgccatggctgtctgctagcttctggtggtgtgctggtcatccttagtgttacttggcttgcagaagcaccatcgatctctgctttcatcgtcgtgtggtgctgcccctgcatgcatgtatctgtgtccaaatttcccctttttataagagca

SEQ ID NO: 151475 - DNA, 601 bp, Human
gctgaactcgaaaagcccgactttccaggcacggctagtttcttcctagcaagttcctgacggagctgggtggctgccccaggtgactgcagtagcaggagattaaggagacagcacctgcctgacaaaaaaggttgctgacacaataggccaaagttaaattgagctgccaagggaaaatgattggggatatgcagttaacagttgagggagataccagaagaatttgtgtccacagagagattttgatggggctgactttgccgctgaccgactcacctcagaagcatggactcccttrcctccaagtccaaggcaatggggctctctccctcttgcctcttgaattcctgcatctcatttcactgggtaaacagggaggctcctgtgctccagcaggaaaaccctggactgggaagcaggatgtctactctgatcctgctgccccaaagctatgcggcttcagacaagtggtttgacctttctgggctcagtttccttgattttcactattatttgaagggcttggggtcatggaaatcatgaactcttcacactgagaggaatcttcataatccattttgtagataaggaacctaag

SEQ ID NO: 151476 - DNA, 601 bp, Human
gctgaagaggtcaggggcttgcacccagccatagagctaaatgaggggcaaagaacctagaactctggcgtcttgactcccacctgggacacattttatcagtaatagtgagctctcatctgttgatagtgttagaattctcacatttactccccataacaaccttcttcttcttttttttttttttaaacggagtttctctctgtcacccaggctggagtgcagtggcgtgatctcggctcaccgcaacctctgcctccagggttcaagctattcttcagcctcagcctccctagtagcygggaatacaggcatgcaccatggcgcctggttaatttttgtatttttagtaaagatggggtttcaccatgttggccagactggtctcaaactcctgacctcaagtggtccacgtgcctcaacctcccaaagtgctgggatcacaggtgtaagccaccatgcctgaccagcacccttctgaagtaggcactcttatacccattttactgatcaggagaccggcttgcccaggatcctgcagctactgaatagaggggccagaactttgctggtttggtgcgcttcctggtacacaccagct

SEQ ID NO: 151477 - DNA, 601 bp, Human
ctgaagaggtcaggggcttgcacccagccatagagctaaatgaggggcaaagaacctagaactctggcgtcttgactcccacctgggacacattttatcagtaatagtgagctctcatctgttgatagtgttagaattctcacatttactccccataacaaccttcttcttcttttttttttttttaaacggagtttctctctgtcacccaggctggagtgcagtggcgtgatctcggctcaccgcaacctctgcctccagggttcaagctattcttcagcctcagcctccctagtagccrggaatacaggcatgcaccatggcgcctggttaatttttgtatttttagtaaagatggggtttcaccatgttggccagactggtctcaaactcctgacctcaagtggtccacgtgcctcaacctcccaaagtgctgggatcacaggtgtaagccaccatgcctgaccagcacccttctgaagtaggcactcttatacccattttactgatcaggagaccggcttgcccaggatcctgcagctactgaatagaggggccagaactttgctggtttggtgcgcttcctggtacacaccagctg

SEQ ID NO: 151478 - DNA, 601 bp, Human
tgcttcttgagggcaggcaggtttatcacacagcggggtgcagaagagtagtattcatcttcctagtgtaaccacttataactacttttcagtgaatcaaatagatttttaagcaagaacattgtaaaaatctgcttaatcaagggtggagcaaaatgagttagccagggccaccctagctcagatggggtggtagctgcctctgctccacaatgaggtatttacacttgctccccaccctctcctttgccccattatcttttagttaaagggccaggtgcaccagaacacaggtgccttragtagcaccagcacctctcagggtcatagggaagagctgtttcctctgggtaaactgaggcctcaataaggcataaatgccttctctgggtgaagaagatatgccctctaagatctctccagggtgaatctagaataagttgtagtctagatggcttggcagcactagccagtgtgacagtaagtcttgatgaacatcagtcagcgtcatgctgagggacaacctcgaggagagggaatgtgtacttgttacaacagcacacccaatagaaatagcatgtaagctacaaatgtaacttta

SEQ ID NO: 151479 - DNA, 601 bp, Human
cacctctcagggtcatagggaagagctgtttcctctgggtaaactgaggcctcaataaggcataaatgccttctctgggtgaagaagatatgccctctaagatctctccagggtgaatctagaataagttgtagtctagatggcttggcagcactagccagtgtgacagtaagtcttgatgaacatcagtcagcgtcatgctgagggacaacctcgaggagagggaatgtgtacttgttacaacagcacacccaatagaaatagcatgtaagctacaaatgtaactttatattttctagcaaaaaaaaaattttttaaagaaaccagtgcaattcattttaatagatcttatttgtttcaatatatcccaaatattgtcctttcaatgtgtgataatatagttattagtgagatattttccattccctttttcatacaaagtctttgatactcagtgtgtatttcactctgacagtgcacctcaatgtggtgcaataggcgagggtctatgtggtacatcccgtgcccagtgtgcacttaaaggctgtagatccatatatggcgactgtctcctagatagatgagcccagcaaggctcagt

SEQ ID NO: 151480 - DNA, 601 bp, Human
atatggcgactgtctcctagatagatgagcccagcaaggctcagtgggtgttttgaggtccatggtctctcaggtcccgttccaccccgacattcgacgaatcagagaacactaatatggttgggaacacttttatcttgctccccatagtctgaacagaaagagacgccacagaatacaatcacgactctctccctcctacggactccctccccacaagcaatcaatgggctggtctcagacaaagacacctagtcaaggctggtgaaacctgctctatttcctagtaggcctccacctrtaattctcagcagtttgtgtgtatagatagaattcctgccttctactaatgtgactgttcctgctcagagatctagagttaattattagcaaattcacagtgaaccagagctaggtcttgctgtaaggctcctgtgttttttagaagtacgttgccatggggatttttgtccccactgggttcctcctcaggaccccagacagatagatacacaaaccctgggcccataattttagttagaaaaggcccaagcctagaacctcagggaactcatttggaagctttttttttttaggaaac

SEQ ID NO: 151481 - DNA, 601 bp, Human
gacacctagtcaaggctggtgaaacctgctctatttcctagtaggcctccacctgtaattctcagcagtttgtgtgtatagatagaattcctgccttctactaatgtgactgttcctgctcagagatctagagttaattattagcaaattcacagtgaaccagagctaggtcttgctgtaaggctcctgtgttttttagaagtacgttgccatggggatttttgtccccactgggttcctcctcaggaccccagacagatagatacacaaaccctgggcccataattttagttagaaaagrcccaagcctagaacctcagggaactcatttggaagctttttttttttaggaaacttacctttcctatttgacatctcaatcaaacaggtgtttggggagaataaaagcatactaccttagaagggactggggtcatctggccagacttgtggaataaagagaatttcattccttgtataaaataactctaaataatggtaagctcttaggagacttgatctactggctacatatacccactatgaaattaacacattctggaatttagatggaagaatatggaaattggtccttctcagt

SEQ ID NO: 151482 - DNA, 601 bp, Human
tgaggaggggaagaggataagaaacaggcagagttgaccttacaggtagacacaacaggcgagggtccatgtggtgcaatggatcccatgcacatgcctgattcagtcattctagttgagtaggattgtctggttggttgttattattttgttttttgtttgtttctttcttttgttttataagatggagtctcactctgtcgcctaggctggagtgcagtggctcaatctcggctcactgctgcaacctcttcctcccgggatcaagcaattctcctgcctcagcctaccgagtagctgrggctacaggggcatgccaccacacctggctaatgttttgtattttagtagaaatggggtttcaccgtgttgcccaggctggtctcaaactcctgagctcaggcaatcctcccacctcagcctcccagagtgctaggattacagacgtgagccaccgtgcctggccagtttttatcttgaaagcttaagggtctcccacttaaattcaaatactcttctgaggataaccttttaatcagccaactatcatgaatctcaattatcaggaattccagttattccaattatcaggaattcttta

SEQ ID NO: 151483 - DNA, 601 bp, Human
taggagcagtgaaatgagcttataaggtggccgggtttttctagcaattggagctctctgcagtgagtggacacttggcagggtagtgcctactccgcatttgatgtgttcacaccacggctagaagtaggtgtcgcaacttccagttgaagagggaattcttttccttgggtgggagaggggctagagaacgtctcaggttgttgctaactatgagcatggttttataattgtttaaaagtgggtaaacaagaagagtgtgtttatggtgtctgtattccacaaactattatttcccacrttaactgtttcatatatggaaaatctgagaaacaggaatgctaacaaggttgcagtataatttaaaaatacttctgagagatcattgtatcccaaaggcagtgcccagtgaggttaagagcgtggtttgtggaatctgagcccacaggggtttaaatcctgcctctgcccttcttagattctgtgaacttggacagattccctcacttatttaagacttcacttttcagcccttgagatcccacctgctcaattatctaaatgaaatctatcactgtggaaagagcaaaggcctcctgct

SEQ ID NO: 151484 - DNA, 601 bp, Human
caatgccaggattattaagcatgattctgataagttttaacccctaatgagattatccttggttaaataaattgaatggctagtggaattccaatgtaaagtcagcagaggttagctggttgctagatatttaactatacataccaggaagctatgaggacaaatttccatttgcacagagccttgagaattggccattttaggactaaatgtgctgctcattacttttactcaaggacatactaatgaccaatatatgtttaaatacctactatgtacaactgctttcaaaaacactttsaatcttgaattgagaaggtaggagatccatacctgtattaggccatcctcacagtgctataaagaaatatctgagactgggtaatttattaaaaaaagaggtggatgaagctggaaaccatcattctgagcaaactatcacaaggacagaacaccgcatgttctcactcataggtgcgaattgaacaatgagaacacttggacacagggtggggaacctcacacaccagggcctgtcatggggtggggagagtggggagggatagcattaggagatatacctaatgtaaatgacaagtta

SEQ ID NO: 151485 - DNA, 601 bp, Human
cacagaaaattgggagacaaatagatgataacaagggacagtacagaaagactcaactgagttttatcaaatcactcaggcagataaacatgggggctgcatgtgcatccgtatgtgtgtatatgtttatttacatctaatatacacacatgatattacatgaaatattataacatataataaatatatattcatactggaaaaattctcaaagaatataccaccaaatgttaacaatagctgtccctgtttagtgggatttcaggtgacttagatcctttccccctttggcctctcagtrtcttataactttgtgtgctaagatcattgatagttgaacaataagaagaagaaagtgagtgtggaaggatgttgctagagaaagtgtattcttgattatatggaggaagtgggggcagtttgtgaagtcttccttacgaatagcatcctatttgagaagaccagtcttcacactggaaaaaatgcatagagcaaggtgggcatcacttgcagaacagtttggcacaggactacctctgaaatattaaggcttaggagacttgttcttagaaactcttcaggcaaagtttacaaaaggcct

SEQ ID NO: 151486 - DNA, 601 bp, Human
aaaattgggagacaaatagatgataacaagggacagtacagaaagactcaactgagttttatcaaatcactcaggcagataaacatgggggctgcatgtgcatccgtatgtgtgtatatgtttatttacatctaatatacacacatgatattacatgaaatattataacatataataaatatatattcatactggaaaaattctcaaagaatataccaccaaatgttaacaatagctgtccctgtttagtgggatttcaggtgacttagatcctttccccctttggcctctcagtatcttrtaactttgtgtgctaagatcattgatagttgaacaataagaagaagaaagtgagtgtggaaggatgttgctagagaaagtgtattcttgattatatggaggaagtgggggcagtttgtgaagtcttccttacgaatagcatcctatttgagaagaccagtcttcacactggaaaaaatgcatagagcaaggtgggcatcacttgcagaacagtttggcacaggactacctctgaaatattaaggcttaggagacttgttcttagaaactcttcaggcaaagtttacaaaaggccttttcc

SEQ ID NO: 151487 - DNA, 601 bp, Human
tgtcctcacgctgcttataaagacatacctgagactgggcaatttacaaaagaaacaggtgtaatggacttacagttccatatggctggggaagcctcacaatcgtggtggaagacaaggaggagcaagttgtgtcttacatgaatggcagcaggcaaagagagagagcttgtgcagggaaactcctgctttcaaaactatcagatcttgtgagaattattcactattatgagaacagcatgggaaatacccgcccccattatttaattatttcccaccaggtccctcccacaacacgtgsgcattatgggggctacaagatgagatttgggtggggacacagagccaaaccatatcaactatctatctatctatccatccatctgtccatccatttatctttaattgggatacgtctacaagacaactgatacctaaaagtatgggaatttcatttgctaagtcacaaaataacttttaaaccatccttatattatacctaacatgatctgagcacataatattgtctaagtcagacccattcttgcctctctgagcttacactcttgtcaagtgtgagccagaaggagttggtccaagt

SEQ ID NO: 151488 - DNA, 601 bp, Human
ttcttatccatatggttaaaaagtcaaaatgaatttattacattttcacagaaccatttcctgggccggaactcatttctccttaaataaatactataaaattttcctcagaacaaatcaagtcccctctataaccccagaagacaaagtacatcggcagtaaaaacagacacaaagtctccactgttgtcagaggtagcatggcctggtgggaggacagggagctcatgctgccgcatcagtcgggaggagggatttgtcttctccacagggcaggatccctacaggaaacaggacaaaytgagaagggcttgacaatggaactctttacaaaggtgtcagcagagtattcaaaaccacaggagaattgagtgtcagggctagcaactgtacggttccagagccaacccatgtcggaagggtcagagggtgggacagtcaccacaaccccagaagggagagttctgtagaaagggccatctggagggaagcagtgaccttcagtcagcccaaggtgacagccaggcagcaaggagatgagtaccctcagcctcactccttcccttcctccaacctcctaccaagcctccctgtgggtcaa

SEQ ID NO: 151489 - DNA, 601 bp, Human
cacggccctgtcatgcctgcagtcactgtagtacagactgaatgttcactgtgtcctgctttcagcatttaagatgcctctgagataaagagcctgccttgagtctcacgggacatgctcacattttctgaaaccatgtagcttgcactgttaacctcttcctcggtttagaggttttaggggctcgtttcacaaagctgccccagcccctcatgttaaacaacctgagggctgtgactgggcaaaaaataaataaatacatttgcattcaacattgacaaaatacacacttaagtgagayttttttgcatcacaaaaaaataagtttttacttttttcaaaaagtaaaggttctttaaaagatatcatctagagtagaattaagggctattattagaaaatcacagtggtccctaggcaagacattttgagggatgaacttaagcaggccccagactcacgtcttccatgtcctacaacccaggcataccccatcatcccataccttcaatttatccaaatacttcctgtttcagttggcaaattccactgccccaagcttccaaatgtcttccactgctggcttagccttcttcctaaa

SEQ ID NO: 151490 - DNA, 601 bp, Human
agacagtactttgtccgtttgttcaatactttattcttagtgcctattacagtgcctggtacatagttggccctcaatatatgtttatttaatgaactgattaaataaactagactcaggctctgacccttgtgctaaatctgtgctcacaatagatgttttagggcatattaaattttgaagtcagttcatctctatggaatttataggcaaaggggctttctttttttagaggtaggttcttgttctgtcacccagactagagtgcattttgcattttgagtgcagtggtgtctgccastcagactagagtgcagtggtgtgatcatagctgactgcagcctcaaacttctcggctcaaacaatcctcccacctcagcttcctcactagcagactacaggcacatgccattgcacctggctaattttttaattttatttttttatttttgtagagacagaggtttgccacattgcccaggctggtctaaaactcctgggctcaagctatcctcctgcctttatttctattttgaagcaaacaaaatgatgcaaatgaataaagagtcctaggaagaagtgtcctctgctcttgactgtc

SEQ ID NO: 151491 - DNA, 601 bp, Human
cccagatatttataagcctgaagtatatttttgccttactgataaaccaataagaaagaacttgaatatctcataaaataaggtctttccgcaagccacacatatctagatatggataatagagctaaataatcaggtgtcgagtccaatacactgtcaatctatgtttgacaagcatccagttccttgccttgagtcattcagttcttcgttgttcttgctggaatgaaagcctatacaaaacctagcattaatgaagttaatatgaaactaattagctgcaatgctactgcgggaaaayggccaatcatcatttaatgaatgattctcagttaagcacttcagaaaagtatttcctctgccccataatcacccagcttcatgaagatcctgctttccaggtttgaggtgtgggatccagattcacttataacctaatcaggaaatgaacaggatgatcttgtactgaagtcctatattagtaatatatcaaatgaataaagaaaaatgtaaataaagttagaacttgtagtatcgttttatcaactcgcagtatgtgaaatccatgatgtacctgcaccataaataaaacaagatcttc

SEQ ID NO: 151492 - DNA, 601 bp, Human
atttagggatattttagttacttgtctgatattgattcctaattcagtttctctgtggtcagaatgcatgttctgtatgacttcaaccctttgaaatttgctgaaacaatgttatgattcaggatatggccttggtgaatattccatgagtacttaaaaggaacatacattctacagttgttggctgtagtgttttattatataaacgtcaattaagtcatttcttaatcatgttgagaaatcatctatgcccttactaattttttattttcatgtttaatcagatatgagaatggtgcgytaacatcttctatgattgtgtatttgtctatttctgcttttagtcttggaagtttttgctttgtatattttgggtctatgtaattagatgaatgtagatctttattttcctgatgaattgacccttttatcattatgacatgtcactttttatatttaatagtatttcttgcattaagttttaatttatctgatattatgtataactctaccaactttcttcagattagtgttatgatggtctttttttcccatatctttattttcaaccttcttggtccttattagagtatttaatcca

SEQ ID NO: 151493 - DNA, 601 bp, Human
taatcatgttgagaaatcatctatgcccttactaattttttattttcatgtttaatcagatatgagaatggtgcgttaacatcttctatgattgtgtatttgtctatttctgcttttagtcttggaagtttttgctttgtatattttgggtctatgtaattagatgaatgtagatctttattttcctgatgaattgacccttttatcattatgacatgtcactttttatatttaatagtatttcttgcattaagttttaatttatctgatattatgtataactctaccaactttcttcagrttagtgttatgatggtctttttttcccatatctttattttcaaccttcttggtccttattagagtatttaatccatttacatttagtgtaattactggattatttgaatttaaacctaccatcttagtatttctttttctgttgtctcacctattctttgtttctattttaatccctgcttgcctttataaaaattttaaacaatgacaatttttaaaatattttcatttatcttctttgttaccttattaattaggcctctgttgtaattcacctagtgctaacccagggattatagca

SEQ ID NO: 151494 - DNA, 601 bp, Human
gcagtgtggccattatatgtgtgcctcacaacttgtattcattgtaagcttcctttgagaatttttatctaagaataagtctaccctcattttttgtggagtatcagagcttcttctcctatttgtcttcaagattgaaaggagaatattgaatgctgattctctgaacatctgcaataatgtattccaagatattggcaaaatcagtccaaaggctcaaccatcccagctaattaaattacctggttaactctgtggactaccaaatctaaatggatgtaagagaggaagaaatttgaaraaaataaagattacacagttgaaaaaacaagatattctccagttatgaattcttttccccaagagtgtcttttgtgtacattgttattacaaaatccagttgtcacattaaacaagccatgctatccaaagcagagttgattgtggctggaaatttattccaatattgaaaagatgtgaaagggctataacacgtatcagacaatctagaattgaccactaggggacatgaccatgaagccttagacaataattcatatttagtttgaagtactattctgaggcaaaacaaacaaaaaag

SEQ ID NO: 151495 - DNA, 601 bp, Human
caagcatgtcttgttctgtctcaaaccttggcctcaacaatcaaagctctgtatcattatttgcaacacatgaatgctaaatggtatcatttctgactatggacctatgtgtagttaagttgtgtgtaggaatatgaggatagaaactattactatcaaccaaatggtaatattggacatgtttcaaagattgtctgaaagagcttgtccatggagactaacccttaacaagtcccaggtttctcctctcctagaatgtgaattccacgttcaccagcagaattcagttctgctgaaatartcatggaacagtattgttttaatttctcaaacttttcaaccatatgtttataaaggtttataagacaaataagactatccctggcatataattctttcagtaaatacttcacatattcttccataagaattagcctcttctgtaaactctggagctaccccaaggtaagatcgtactactgtaaataagcccgaatcactagattccaaaggccaatggttacccaggcattatttgtttatgacctaagaaaataagtccatagaaataaattggcttgaacagaaccatcaaaaaccc

SEQ ID NO: 151496 - DNA, 601 bp, Human
atgtaaatgtactaaggggactctttatttccctctcattcgtaagtggaccatcctcaacacagagacccaaaccagaaacttaggaatcatctttgattactctctttcaatcttatcaaatcttattagcaaatcttatccctgaaatctttgtccctgaaatatatctcaagtcttacctgtcctcaccagttccaccgctaccatcctaatcctggcatcaactctgaactggactgagtcctccagcagcctggttccactgcttctattttttttccattgtctctctccattycattgtacacacagttgccaaaataatattttaaaatctgtatcactaatttaaacgcttgtggcttttcagtgtacttagaagaaaatccacacttgtagaccctgatgcattcagcccctacctgcctccccagtcttataccagactccatttctcatatattgcagccatgcttgccttttcaacatctcaagcaatcgaagtgctttctcgatttgagactttttgtgcttgctattttcattgcccggaatgccttttctgagaatctcaagcagttgactcctctgcattttt

SEQ ID NO: 151497 - DNA, 601 bp, Human
tttcagccacatgttttcagtatatgaattgccagagcttcctaccaactagtcatatagtgtgtctaccttaacctggtacctttacttgggttgcatttcatcagcagccaagtccatctatttgtcacagtgtctctagtacactgcttctacatagtcagcaatcagtgaatacttgatgcctgcatgcatgaataaatgaacttctcaggaatgctagggccagagaaagttgatgtttaaaaagttagaaaatgtaggcacttgagaaggattaagaaattaacataagccttcyttgaatttatcattgaaatctattattcaatttacatgtacaatttcagcaatacatatacttcctttagtcaaatacatctccctgtagcacttaccatgtctctgaccctttgccttgcaaattccactctgataataccagcagtgaatagaaatttaaaaagccactgtcctcactccttccactcatgttctaatgtaagcctttcttttatgcagcctgaatgcacaattcacttgtcattatctcgcatcctagctgctcctcatgaaatggcattcctctggatttgctgag

SEQ ID NO: 151498 - DNA, 601 bp, Human
atgtgtgattcaacaagatccactggcagaaaatagaggcaaattaactcaaggagtccattggaatatatcaacgtactccccttccactcacaaggcaatgatttctaaaacagtgaatcattttacttacaaggggtcacaatggagacaggatagaggaaactgcccgggagacacagggacgaggcatgtggagaggtagaccttggatccagttctgcagccagtgagctgctcactcagacctgttgctcccctccagagcctccctttcttcatctggggtatgaaacaactrgaccagcttatctctgagatcccgctcagctctgaccctcctgttggagaaggcttgcattctgagactgcagtcccaagtagcaatctcttcggagggcatgtatgtgattacgtacttagtgtgctcacatagtttcataagaatccggtaaaattcattcttatgctacttttgtattcccacttattttgaatggaaaatccttgtacatatttcctcaaattatggataaaaagtatacaaaatacaccctagaggccaagaagctccttttggtagaaagaatgttgagcccta

SEQ ID NO: 151499 - DNA, 601 bp, Human
aaactaccatgttgcaatggaataagccctggttctagcttcacgccctgggagtgacttctattagctttggaatctccggtaactcctttaatcctttgaattctcactttctatgtcttaaaggtgatggctgcccatttcatcaactgtgaaatggcatccaagtcccaggtatcgttaagaaccaacggcttccattttaaacagaagttttgttaaacaaatatttggttttacaagggtattataattcatacccttattcattgttcttccttgctcccaatagtcgatgggttttttttttagctgtggcttatgtgatcaaagaggtgaaacaagttagctcaattggttatattctgaaattaataaggtgttctttttgcatgtgtatacaaattaacttccctctgtttcttggccacacacctcacctcagcttcacaaatgagtagaattgattacaacatgaatcagacaagagagtgtagatctatcactgttattgagaaagcagttcaaaaaacaagcattcccgcatgttagtaacatgtttttataaaagctgtaaatgtatatttattcatatgattta

SEQ ID NO: 151500 - DNA, 601 bp, Human
gggatctgagaaaattattatcaaaaccaattaaaggaatcatctattttgtgcgattggttttgaaatctgtccagtgggctctttctggaggcaaggatcctggttaccaagagactttgctgcaaataaggcaaactgggatgacatttggggttgggatccttctcaggaccaaatgggcacccatcatctttgggtctagaagactgcactggcataaagcagctgacttcctgtagccttgcagaaataacaatggggtgtgtgtgtgtgtgtgtagtgtgtgtagtgtgtgcattgtgtgtgtgtgtgtgtgtgtacaatggtggggaacagttggcagagcaatgagcaagaaatgggaaacgacactcagaaaagcagcaacctaccctgagcaaatcaaagaatttcttagaatgcaacactagctgtgtgtatgaataattggcttgcaaatcacttcctctatttgcttgttatataataccaatcatttcagtgtcactgacgaaagcccagaagggaattaccacttaccagccagttttacatatggcttttgtgaggaataaggccttgaggatgagggtctaaa

SEQ ID NO: 151501 - DNA, 601 bp, Human
ggagagtgtcaaattcacacagaagttgtatgcaagctattcttggtcatcttgctcatctatgaaatataccctcctccatgcattgacttacaacaagggtttatttcttgctcaaagtctgctgtgaatctaggcaattctccagagcagctgttcttttgttggcttagcaatccaagctgctgcttccatcttacagcttttccatatcaactcatgattccacaaccattgctacgaggcaagagtagtatggaggatcacacactactcttagaaaccaccagctggaagggamttatatcactcctgcttacatttgatggctcacatagccatgcccaaattcagtagagcaagcatggccctcctgtgtacccagaaaggaaggagagctagaaatattggtaaatagcaatattgtttaccatagcctcagagatattgcctcgtggtgaaaccctataattcccctcaattctgatttttgccctttatcaaatcattttattcattccttcatccatccaacaaagatgttttatatgcctactattagcaacaatcagtagcttgttcctggagggaatgcagctgc

SEQ ID NO: 151502 - DNA, 601 bp, Human
cacactactcttagaaaccaccagctggaagggacttatatcactcctgcttacatttgatggctcacatagccatgcccaaattcagtagagcaagcatggccctcctgtgtacccagaaaggaaggagagctagaaatattggtaaatagcaatattgtttaccatagcctcagagatattgcctcgtggtgaaaccctataattcccctcaattctgatttttgccctttatcaaatcattttattcattccttcatccatccaacaaagatgttttatatgcctactattagcaacwatcagtagcttgttcctggagggaatgcagctgctccccgccaaaacaccatataattcactctagaaaactaaaatttcagatgctttgtcattgattattgtggggagaaaatgtctctttcagctccgactttgtcctgtctcctctaaggcatgtgaaataagatttttttttcctattcttacctcctatggtcccattttatggttttcatgcactactgtcagtcaaatatttatcatatgtctttcaatatctttccaatatttatcatatatctttccccttgtaggcctt

SEQ ID NO: 151503 - DNA, 601 bp, Human
tcattccttcatccatccaacaaagatgttttatatgcctactattagcaacaatcagtagcttgttcctggagggaatgcagctgctccccgccaaaacaccatataattcactctagaaaactaaaatttcagatgctttgtcattgattattgtggggagaaaatgtctctttcagctccgactttgtcctgtctcctctaaggcatgtgaaataagatttttttttcctattcttacctcctatggtcccattttatggttttcatgcactactgtcagtcaaatatttatcatatrtctttcaatatctttccaatatttatcatatatctttccccttgtaggccttaactttatgacccactattaagcacgcagctgtatttccagaaaatgtagatggtttaattcaatactgcatggcaattaactgtcttataaattaaatcattttaatccatcttagagttatcatgcataattagtctgacagcacaattctgtttgttgttgttttaaaggaaatttagatatcaaggctgcaaagaatgcgtaagtctaggcagaaggctcttattttccaaaagcagagcccat

SEQ ID NO: 151504 - DNA, 601 bp, Human
tagaaaaaaatgtgtttctgatggaaaaccatagaacaatcctcactctgtggtaagaaagaataaagagaaagaagtgggctctatgatagactgaagcaagaatactattttagactaggtagtggccgggcgtggtggctcacgcctgtaatcctagcactttgagaggccaaggtgggcgtatcacctgaggttgggagttcgagaccagcctgaccaacatggagaaaccctgtctctactaaaaatacaaaattagctgggcgtcgtggcgcatgcctgtaatcccagctactcrggcgcactggctcacgcctgtacttgggaggctgaggcaggagaatcgcttgagcccaggaggcagaggttgcagtgagctgagattgcgccattgcactccagcctgggcaacaagagtgaaactctgtctcagaaaaaaaaaaaagactaggtagttatcttcctgggtggttttggctatgtagaaaatcactcttactctcgattaatttatgtaccaaatcatgctttgaaatatcccactgaaaaggtctaaattattgatatcttgggtcaagttctgacttgaaggcaaata

SEQ ID NO: 151505 - DNA, 601 bp, Human
gagaccagcctgaccaacatggagaaaccctgtctctactaaaaatacaaaattagctgggcgtcgtggcgcatgcctgtaatcccagctactcaggcgcactggctcacgcctgtacttgggaggctgaggcaggagaatcgcttgagcccaggaggcagaggttgcagtgagctgagattgcgccattgcactccagcctgggcaacaagagtgaaactctgtctcagaaaaaaaaaaaagactaggtagttatcttcctgggtggttttggctatgtagaaaatcactcttactctcrattaatttatgtaccaaatcatgctttgaaatatcccactgaaaaggtctaaattattgatatcttgggtcaagttctgacttgaaggcaaatagtaggaaatacaatggcatttattggaggcacacactacaaatattgtagtatctttaagatgtgtttaaataaacaagtagatgataaaactataaattagagtcactaagactctctagcagagacccttaccttttgaagtgcaccttaaaatggcaacaacacttatcagaaattccataagaagcttagttgtctgctact

SEQ ID NO: 151506 - DNA, 601 bp, Human
tttaactcccacagtaataaatcttgggtcttttaaagttggtcagatgtacacagagctgcttactaattatactaaaatagttactaagcaactcgacattttgatttccaagaatttcagataaagattatgaactttatttatttggtgctttagagtccaaggcactattttacagcctaaagctgtatttctcaaggccatcttcttgcattcttctaaaacttaagagggatcatctgtcctcaaaaatataagaaattctgtaaatgtgtatttttgtgtatatatatatttratatttaaaattctgtatctatatatacttccaagaccccttagaacttacacggtacctgtaatttgtttcttttttatacttaagtacaagtaatgttagtgatacatttaaaactaggaattaccttgtttgcaatatcaaatttttgtaaaatattgagttaaaaaagtctcctaaaattaagatttgaactattataaatggcttcaaagatcctttcgtttctaagagaaggaaggaattaggatttattgtgcatgtatttcataccaggtgctcatctacagttattgaatc

SEQ ID NO: 151507 - DNA, 601 bp, Human
ctgtatctatatatacttccaagaccccttagaacttacacggtacctgtaatttgtttcttttttatacttaagtacaagtaatgttagtgatacatttaaaactaggaattaccttgtttgcaatatcaaatttttgtaaaatattgagttaaaaaagtctcctaaaattaagatttgaactattataaatggcttcaaagatcctttcgtttctaagagaaggaaggaattaggatttattgtgcatgtatttcataccaggtgctcatctacagttattgaatccttgcaacaatcrtatcaggtaaacgctgttattcttctcttacagatgaaaaatctaaaccttctaaaatgaaagtttgtccaagttaacatgaccaattaggagagcttggattccaacccaaatctgttcagtatcaaagctcactctcttccatccttgccccttctcagctcacatagtagctttcagaaaacagtagctatctaccccagataaaattaagcctttttttccttaggagaggctagaaactgaatcttctaccccctttattggcatcacacaggcacaaaaatcaccaattctcaa

SEQ ID NO: 151508 - DNA, 601 bp, Human
actattataaatggcttcaaagatcctttcgtttctaagagaaggaaggaattaggatttattgtgcatgtatttcataccaggtgctcatctacagttattgaatccttgcaacaatcgtatcaggtaaacgctgttattcttctcttacagatgaaaaatctaaaccttctaaaatgaaagtttgtccaagttaacatgaccaattaggagagcttggattccaacccaaatctgttcagtatcaaagctcactctcttccatccttgccccttctcagctcacatagtagctttcagmaaacagtagctatctaccccagataaaattaagcctttttttccttaggagaggctagaaactgaatcttctaccccctttattggcatcacacaggcacaaaaatcaccaattctcaaaaaccctatactcccaagttcaacccaaattgaatggttggaatattgttggtttgtatggaataattaacccacatctaaaaattaattatacaaagtgaagtggagattgaagcagttttctagataattaaggcaaaaataactgcaatttttttaaaagacagtttgaaatatttag

SEQ ID NO: 151509 - DNA, 601 bp, Human
caaagatcctttcgtttctaagagaaggaaggaattaggatttattgtgcatgtatttcataccaggtgctcatctacagttattgaatccttgcaacaatcgtatcaggtaaacgctgttattcttctcttacagatgaaaaatctaaaccttctaaaatgaaagtttgtccaagttaacatgaccaattaggagagcttggattccaacccaaatctgttcagtatcaaagctcactctcttccatccttgccccttctcagctcacatagtagctttcagaaaacagtagctatctamcccagataaaattaagcctttttttccttaggagaggctagaaactgaatcttctaccccctttattggcatcacacaggcacaaaaatcaccaattctcaaaaaccctatactcccaagttcaacccaaattgaatggttggaatattgttggtttgtatggaataattaacccacatctaaaaattaattatacaaagtgaagtggagattgaagcagttttctagataattaaggcaaaaataactgcaatttttttaaaagacagtttgaaatatttagaagggtagattgcaaaa

SEQ ID NO: 151510 - DNA, 601 bp, Human
ttgtatggaataattaacccacatctaaaaattaattatacaaagtgaagtggagattgaagcagttttctagataattaaggcaaaaataactgcaatttttttaaaagacagtttgaaatatttagaagggtagattgcaaaattatccaacttaaggtagtcatattcagggagtttagccaaaacacctctgaagttcattgccttacaaatgagtataaaacttaaacctatgattaattccctgttgtttttctatctgtattatacatataaatatattttatatattgtcctyctgagatttcaagagcaattttcttctaattcttctaatttcttctatggattcaccatagtgaatccaccgacacgtctaccctgtgacaatcttgttctccatttgattgcatgaaaaataccatatgaatttgacaaatcattggtttttttgtttgtttttctcttttgctgcatatcattgcctatgcttcttgagcactagaatatatttgtgcatgtataaaccaaggcctttcttctgaaaattaatagtactttgaatctcttctatattctggttcttttaaactgtggt

SEQ ID NO: 151511 - DNA, 601 bp, Human
acccatgtactgaacacaatagtgctttggaaagagctctgttaaaagtgagtctcaaaaatgtaaaggcctttacgagaggaacttaatctccagtgtgataaaacgatgcacacattacaaggagatggatgttatgaaaacaataagtacacccaagagtacacgtacaaatctgcattgcaattgatttatttggatgcctgtttcttcctacactatgagctccttggggccatgaaattcatttgttttatctatatatactctctttgatatcccccaccctgacagctagtgyagtcctttctaaatagttgttactaaatatgtcaaatcaaatgcctacaaggactggttggtagaaccagattctggaagtgaccaagcaggtctagcttcataagaatgccatcatcgtagatttgagggtcatgatgaagttgtactaggatttatggaggttctttgtcaaccagttcacaccaccagtgacttaaggaaactatatgtcgtctattgggaacagtcctgcttaaagcaattagcagggacaattaatttggagggaagtctctctccactcaacagcattcaaata

SEQ ID NO: 151512 - DNA, 601 bp, Human
attaatttggagggaagtctctctccactcaacagcattcaaataccctctgcattagccatgttttgaaaaactccaattgcctgagtcactgatagacaaacagaaatgcagactattttgtatgcagttttataaagaagtttctaaccagagaagaaaggtgttattttgaaatattaagctcttagttgttctttcatttcagtgaacatttgttgagggcctgacatgagctaggcacatggcaaagttttagagatgcaaaggtaaattaagacccctgtgttaattctcatgygggcaaagcaagcacattttttaagttgcaataatgcaacaatggtggtgtgtacatagtagggcaaaagcatagagaaagccatggaaatcctcaagccaagttcaaagagtcctctaatgtatggcataccacaacaaggaccttcaaagggtgcatttggtaagaaaaggcaacctccaaagattcatccaatcctaaggtttcatagagtagggacttcttcccttagctggaaaggaaagaagtcatttggtgtgcagtagacataaattaggggccgtccactttttcttgcaa

SEQ ID NO: 151513 - DNA, 601 bp, Human
tttataaagaagtttctaaccagagaagaaaggtgttattttgaaatattaagctcttagttgttctttcatttcagtgaacatttgttgagggcctgacatgagctaggcacatggcaaagttttagagatgcaaaggtaaattaagacccctgtgttaattctcatgcgggcaaagcaagcacattttttaagttgcaataatgcaacaatggtggtgtgtacatagtagggcaaaagcatagagaaagccatggaaatcctcaagccaagttcaaagagtcctctaatgtatggcatrccacaacaaggaccttcaaagggtgcatttggtaagaaaaggcaacctccaaagattcatccaatcctaaggtttcatagagtagggacttcttcccttagctggaaaggaaagaagtcatttggtgtgcagtagacataaattaggggccgtccactttttcttgcaatgattcatctaatggaggagcagaccctggagagaaacatatctcttcttgtcttcattttgttcttcttttattaaatcacccgcaggacaaccggatgctccagcaatagattatagaaaaaacagatg

SEQ ID NO: 151514 - DNA, 601 bp, Human
attcatccaatcctaaggtttcatagagtagggacttcttcccttagctggaaaggaaagaagtcatttggtgtgcagtagacataaattaggggccgtccactttttcttgcaatgattcatctaatggaggagcagaccctggagagaaacatatctcttcttgtcttcattttgttcttcttttattaaatcacccgcaggacaaccggatgctccagcaatagattatagaaaaaacagatgggtatttctgtgcagtcagaaggctcctgtgcccttttccagcataaaacgtttrtgaaaatcaattttcagtgcctgctgaaccaggctgatgtgagaactagctttccacagttcataatattcactccgggatgatttgacagggctgatattttatcacgaatacaaaggagatgagcaccattctcctaatatattcattacttgtctcaccaccctggtaaataatatgcatatggtaatttgagagacacagtgttcccattgctcttttttattcccagaactctggctgtcttttctaaatgctgcaaatcaaaggcaaagttacctcacgcacctgtagtcccag

SEQ ID NO: 151515 - DNA, 601 bp, Human
agacacagtgttcccattgctcttttttattcccagaactctggctgtcttttctaaatgctgcaaatcaaaggcaaagttacctcacgcacctgtagtcccagctactcaagagacagaggctctagaccaggacttgaagttcagcctgggcaacacagtgagaccctatgtctttaaaaaaaattgcctaaaaatttggccaggtgcggtggcccatgcctgtaattggaggaactttgggaggccaaggtgggcagatcacttgaggccaggagtttgagaccatcctggccaacatggctaaaccctgtctctactaaaaatacaaaaaaaaaaaaaaattagccaggcatggtggtgtgcacctgtaatcccagctacttgggaggctgaggcataagaatcacttgaacctgggaggcagaggttgcagtgagccgagattgtgccactgctgtattccagtctgggtgatagagcgagactctgcctcaaaaaaattaaattaaaatttaaaataaaaaattacttaaaaatttgattttacattcctcctattctcactttctggtgcccatacaacacataaattacattc

SEQ ID NO: 151516 - DNA, 601 bp, Human
gtgcggtggcccatgcctgtaattggaggaactttgggaggccaaggtgggcagatcacttgaggccaggagtttgagaccatcctggccaacatggctaaaccctgtctctactaaaaatacaaaaaaaaaaaaaaattagccaggcatggtggtgtgcacctgtaatcccagctacttgggaggctgaggcataagaatcacttgaacctgggaggcagaggttgcagtgagccgagattgtgccactgctgtattccagtctgggtgatagagcgagactctgcctcaaaaaaattamattaaaatttaaaataaaaaattacttaaaaatttgattttacattcctcctattctcactttctggtgcccatacaacacataaattacattcttctctatgtttacctgcatctctagggaacaaagcccctttcacttgttctgttactatagaatgttctacaataccccaataaagattcattcatttgttcatttacaaatatctattaagcacctactgtgtgtcaagcagtatgctaaatcttaagcatgaaacaaaagaaagataaaagtatctgattcagggactggttg

SEQ ID NO: 151517 - DNA, 601 bp, Human
tcatttgttcatttacaaatatctattaagcacctactgtgtgtcaagcagtatgctaaatcttaagcatgaaacaaaagaaagataaaagtatctgattcagggactggttgttctgttgttctgggttttttttttttttttttggaagcttgttgaaaatctgtggcatcatacaaaacaaaaaagaatgcaaaactggtgccttaaatagaaatgtattaataatgagtgttagagctaagagaaggcaaaatgtctacagaacacatgatttcaattaacaacagtgagtaaacgratgatctggaaaaaaattatgatcgggcccatgatttttttttgtcgttttttaaaaattttgtttgtttttctcatactcatattattctaaggcccattgattttagaaagaaaatctgttttataaacttagcatattaaaagcaaatgcatagctccattttcttagaaatgcgtgaatacataaacatgttttactgagagtaggacttaatttatatgtattaaactgtcagaatatacaagttctttgtggtcagtaattctttcattcatttaacaaatatttcttttgcta

SEQ ID NO: 151518 - DNA, 601 bp, Human
tgttcatttacaaatatctattaagcacctactgtgtgtcaagcagtatgctaaatcttaagcatgaaacaaaagaaagataaaagtatctgattcagggactggttgttctgttgttctgggttttttttttttttttttggaagcttgttgaaaatctgtggcatcatacaaaacaaaaaagaatgcaaaactggtgccttaaatagaaatgtattaataatgagtgttagagctaagagaaggcaaaatgtctacagaacacatgatttcaattaacaacagtgagtaaacgaatgakctggaaaaaaattatgatcgggcccatgatttttttttgtcgttttttaaaaattttgtttgtttttctcatactcatattattctaaggcccattgattttagaaagaaaatctgttttataaacttagcatattaaaagcaaatgcatagctccattttcttagaaatgcgtgaatacataaacatgttttactgagagtaggacttaatttatatgtattaaactgtcagaatatacaagttctttgtggtcagtaattctttcattcatttaacaaatatttcttttgctaccatg

SEQ ID NO: 151519 - DNA, 601 bp, Human
tgaataggctgaagagatttgccgaaggttggtgtaagcttccaaaagtcacttgtacttaaacattttcacatccagtgaaaaaattaaacattcgagaattgccattttttccaactctgagtgtgggttatgaatagctattgagttatgacatggtgctgagcagtacctaatcacacaggtgggcaggatccctgccctcacagagtggaggagacgggaaccagttaagagaaaatgaacacgcaatgtaacaagtgctgtcatgaatgcaggatgatagagtggtccaggggcmtggcatccaatgaggagttgggggtgggagggcatagtccagaaaggctccctaaagcatagacttagaaggtaaaattgactagacttagagtgtggggagggggaggattggaaatcaatgattcaaggatgacatctggtttcatcatttacatttggttgaactattagccttttttcagtatatgtttctagacacacctgaagttgatacctgtctgttcaaatggccacacattctttcattcttcatggttgcttttttgtttcaagatagcaagaaaaccaatctttcctc

SEQ ID NO: 151520 - DNA, 601 bp, Human
agaaaaccaatctttcctcattttgccagtaaccggctgtgggattttggacaaactactttgctcagcctcagtcttttcatctccatagggatattgaacaaaattatgtctgtggttctctcctcatctgaaattctaccttttaaaccccttccatgtcatagtgctttcatgacccccatagattcatgcggcatttcccaattctgagccttaggatagtgtgtctgttagaattgtgttacactttgtgtcagttaccaaacctaattaaccaaggacttaagcacattagggktttgtttttttttttcaggtattaaggaatccagatgtaagcaatacatgaatgatgaaatagccaaacaacagtgttggggacccagactccttctatctttgttctcagtcatccctgttcccaagatagctgccccatctccagcttcaagtctgtactccaggcaagaagaaagatagcaaaaaaggcaaaatcaagggccagctgaattggcttagtttgaaagagctttcccagaagttcttagtggaatttatttaaatcttattggccagaactatgtcataggccacccct

SEQ ID NO: 151521 - DNA, 601 bp, Human
aaccaatctttcctcattttgccagtaaccggctgtgggattttggacaaactactttgctcagcctcagtcttttcatctccatagggatattgaacaaaattatgtctgtggttctctcctcatctgaaattctaccttttaaaccccttccatgtcatagtgctttcatgacccccatagattcatgcggcatttcccaattctgagccttaggatagtgtgtctgttagaattgtgttacactttgtgtcagttaccaaacctaattaaccaaggacttaagcacattaggggtttktttttttttttcaggtattaaggaatccagatgtaagcaatacatgaatgatgaaatagccaaacaacagtgttggggacccagactccttctatctttgttctcagtcatccctgttcccaagatagctgccccatctccagcttcaagtctgtactccaggcaagaagaaagatagcaaaaaaggcaaaatcaagggccagctgaattggcttagtttgaaagagctttcccagaagttcttagtggaatttatttaaatcttattggccagaactatgtcataggccacccctagat

SEQ ID NO: 151522 - DNA, 601 bp, Human
cctcattttgccagtaaccggctgtgggattttggacaaactactttgctcagcctcagtcttttcatctccatagggatattgaacaaaattatgtctgtggttctctcctcatctgaaattctaccttttaaaccccttccatgtcatagtgctttcatgacccccatagattcatgcggcatttcccaattctgagccttaggatagtgtgtctgttagaattgtgttacactttgtgtcagttaccaaacctaattaaccaaggacttaagcacattaggggtttgtttttttttttcaggtattaaggaatccagatgtaagcaatacatgaatgatgaaatagccaaacaacagtgttggggacccagactccttctatctttgttctcagtcatccctgttcccaagatagctgccccatctccagcttcaagtctgtactccaggcaagaagaaagatagcaaaaaaggcaaaatcaagggccagctgaattggcttagtttgaaagagctttcccagaagttcttagtggaatttatttaaatcttattggccagaactatgtcataggccacccctagatgtaggagggga

SEQ ID NO: 151523 - DNA, 601 bp, Human
aggacaggattacactttgcatgtgttctttacagctctcaagaaagattcacacagagtaagtgttcacttttgtgaaagagaattaattgttgaattattcaaattgtaatccagggatgagacaacccaaccaagaagtgttcaaattattacctagtctattttctcaggaatgaatgatttatgtgattggtggctgtatcttcccaaattccacaattgattataaacctggccaatacagatggactttgaaggttgctcaaatctcttacagctactcaaaaggattattacrgactagaaaaagtattgcctgcagtgaaaagcttcaggaataatagagttcagtagccctttttcttcatttattacattgaataaaactaataaggagccaccccaataatcaaatcaagtcagttccttaaagacttgcatctggttcttccagcctataatgaacataatagcgcatcatttcttttcactcagatcttgagtaatcataatgctcagaagttgggatggagcattatagttaatttaattttcttaaaagcttgaggtcaattggaaaattcatgtgttaattcta

SEQ ID NO: 151524 - DNA, 601 bp, Human
cttgagtaatcataatgctcagaagttgggatggagcattatagttaatttaattttcttaaaagcttgaggtcaattggaaaattcatgtgttaattctaattctttaaaaaattacatttttaatgtttgtggtttaattttcaccaatgtaattacttcaaagacttttattttctctactttgctcatttctaaatgatattttaacatctatattttttatttgctctaattctccagtttattctccattccatgcaaatcttgaattgagatgcaagtttatcctaaattattwggagaactgataatgggctaccaagaaaaaatacatacatgcaatatccaatttccaaactggctttggtaagacatatctttttgagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttt

SEQ ID NO: 151525 - DNA, 601 bp, Human
tgagtaatcataatgctcagaagttgggatggagcattatagttaatttaattttcttaaaagcttgaggtcaattggaaaattcatgtgttaattctaattctttaaaaaattacatttttaatgtttgtggtttaattttcaccaatgtaattacttcaaagacttttattttctctactttgctcatttctaaatgatattttaacatctatattttttatttgctctaattctccagtttattctccattccatgcaaatcttgaattgagatgcaagtttatcctaaattatttgragaactgataatgggctaccaagaaaaaatacatacatgcaatatccaatttccaaactggctttggtaagacatatctttttgagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttttt

SEQ ID NO: 151526 - DNA, 601 bp, Human
ccaatttccaaactggctttggtaagacatatctttttgagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttttttctttctaccacacatcttcaattctaagaggaacttttttctttktttataattgttgaccaggattcattttattattagcccttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctg

SEQ ID NO: 151527 - DNA, 601 bp, Human
ctttttgagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttttttctttctaccacacatcttcaattctaagaggaacttttttctttgtttataattgttgaccaggattcattttattrttagcccttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaata

SEQ ID NO: 151528 - DNA, 601 bp, Human
gagaaatcatttccattaaaacacctctcagatgcaaattattctatggagtaataaaagttagactataatgggcattttgtttcattactttatctttaaccttttagtttggttccttttaatatttgaagtatgtgcttacatctgtcgtcttctaggaaaatccctatttttatgtttgtatctggattattttatagtatgtggggttttttctttctaccacacatcttcaattctaagaggaacttttttctttgtttataattgttgaccaggattcattttattattagcmcttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaataaaaaga

SEQ ID NO: 151529 - DNA, 601 bp, Human
ggttccttttaatatttgaagtatgtgcttacatctgtcgtcttctaggaaaatccctatttttatgtttgtatctggattattttatagtatgtggggttttttctttctaccacacatcttcaattctaagaggaacttttttctttgtttataattgttgaccaggattcattttattattagcccttgttgaaaattgtagggctggcctggtgcagtagctcacgcctgtaatcccagcactttgggaggctgaggtcaggagtttgagaccagccctggccaacatggtgaaacsctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaataaaaagaaaataaaattatagggctaatatgtttatccaaacctcctatagctcaactgcctacaaaatttaccttttaactgcatggaaaatattccctctcccatatcaaatttcaaa

SEQ ID NO: 151530 - DNA, 601 bp, Human
catctgtcgtcttctaggaaaatccctatttttatgtttgtatctggattattttatagtatgtggggttttttctttctaccacacatcttcaattctaagaggaacttttttctttgtttataattgttgaccaggattcattttattattagcccttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctrggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaataaaaagaaaataaaattatagggctaatatgtttatccaaacctcctatagctcaactgcctacaaaatttaccttttaactgcatggaaaatattccctctcccatatcaaatttcaaaaagctatgtatttttttctttccttattttt

SEQ ID NO: 151531 - DNA, 601 bp, Human
ttgaccaggattcattttattattagcccttgttgaaaattgtagggctggcctggtgcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagygagactccatctcaaaaaataaaaagaaaataaaattatagggctaatatgtttatccaaacctcctatagctcaactgcctacaaaatttaccttttaactgcatggaaaatattccctctcccatatcaaatttcaaaaagctatgtatttttttctttccttattttttgtaccttttgaccaatatctgtcctttctcctacccctcagtccctgacaagaactttttaaatacattttattatctttgaaattggaatacatcttataattttgggcatatcatgatttaactgg

SEQ ID NO: 151532 - DNA, 601 bp, Human
gcagtagctcacgcctgtaatcccagcactttgggaggctgaggtcaggagtttgagaccagccctggccaacatggtgaaacgctgtctctactaaaaatacaaaaattagctgggtgtggtggcgcacgactgtaatcccagctactcaggaggctgaggcaggagaatcacttgaacccaggaggcagaggttgcaaagagccgacatcgcaccaccgcactccagcctggatgacagagtgagactccatctcaaaaaataaaaagaaaataaaattatagggctaatatgtttatycaaacctcctatagctcaactgcctacaaaatttaccttttaactgcatggaaaatattccctctcccatatcaaatttcaaaaagctatgtatttttttctttccttattttttgtaccttttgaccaatatctgtcctttctcctacccctcagtccctgacaagaactttttaaatacattttattatctttgaaattggaatacatcttataattttgggcatatcatgatttaactggaagattttttttcttggtagtaaataaagtaatggcagcagataaaacaattgatag

SEQ ID NO: 151533 - DNA, 601 bp, Human
aattgatagcttcttagatgcattgaaataaagtaatctccaacagtgacagtgtcctttgaagaatttctgaatgatccagaaacctgctgtgaaccatgtattgtttttgactggtgccctattgtatcctcaccaaaatgaagtttaaatctttgaaactggaaaataagacagaataagtatatagatattcttccttttgattctctacacagggtgtttttctcaatcacacagttgaatctcactggcttgtgcctttcacatgactaatgaaaccaaaatgtgcatcattttraagcatgtcctgttttccataaattccaatctctccacagcaattccatcacaaaacagcaaacaaatcaaaaaataaaaaacttcctgactgcccatctcctcaatgaaaatgttgtggttttaccatgatgacattttctttaattgtggtaaaatacacataacatagtatttactgtcttaactattcttaagtgtacagttcagcagtgttaagtatatcggattgttttgcaaccatctccagaaatcttttcatcttgcaaaactgaaacttccaaagtatcttttaaaaggc

SEQ ID NO: 151534 - DNA, 601 bp, Human
tgatccagaaacctgctgtgaaccatgtattgtttttgactggtgccctattgtatcctcaccaaaatgaagtttaaatctttgaaactggaaaataagacagaataagtatatagatattcttccttttgattctctacacagggtgtttttctcaatcacacagttgaatctcactggcttgtgcctttcacatgactaatgaaaccaaaatgtgcatcattttgaagcatgtcctgttttccataaattccaatctctccacagcaattccatcacaaaacagcaaacaaatcaaaamataaaaaacttcctgactgcccatctcctcaatgaaaatgttgtggttttaccatgatgacattttctttaattgtggtaaaatacacataacatagtatttactgtcttaactattcttaagtgtacagttcagcagtgttaagtatatcggattgttttgcaaccatctccagaaatcttttcatcttgcaaaactgaaacttccaaagtatcttttaaaaggccattcttactgaagaattctcgcatagaattgaaatagctcatctctagctcttagctatgcagcccttctaat

SEQ ID NO: 151535 - DNA, 601 bp, Human
aaaatgtgcatcattttgaagcatgtcctgttttccataaattccaatctctccacagcaattccatcacaaaacagcaaacaaatcaaaaaataaaaaacttcctgactgcccatctcctcaatgaaaatgttgtggttttaccatgatgacattttctttaattgtggtaaaatacacataacatagtatttactgtcttaactattcttaagtgtacagttcagcagtgttaagtatatcggattgttttgcaaccatctccagaaatcttttcatcttgcaaaactgaaacttccawagtatcttttaaaaggccattcttactgaagaattctcgcatagaattgaaatagctcatctctagctcttagctatgcagcccttctaatttttgtcgaacattttcaaatagctctaagcctcaagcctgagatttagccctaacccaggccagactggaccactaaatttttaaacattttttccaaactatactctctttaagtatgtgtgtataagaacaaatggctatttcagtctataaaatgaaattaatgaaattaaacattttaatattttaaccctttattttgctttg

SEQ ID NO: 151536 - DNA, 601 bp, Human
aaatgtgcatcattttgaagcatgtcctgttttccataaattccaatctctccacagcaattccatcacaaaacagcaaacaaatcaaaaaataaaaaacttcctgactgcccatctcctcaatgaaaatgttgtggttttaccatgatgacattttctttaattgtggtaaaatacacataacatagtatttactgtcttaactattcttaagtgtacagttcagcagtgttaagtatatcggattgttttgcaaccatctccagaaatcttttcatcttgcaaaactgaaacttccaamgtatcttttaaaaggccattcttactgaagaattctcgcatagaattgaaatagctcatctctagctcttagctatgcagcccttctaatttttgtcgaacattttcaaatagctctaagcctcaagcctgagatttagccctaacccaggccagactggaccactaaatttttaaacattttttccaaactatactctctttaagtatgtgtgtataagaacaaatggctatttcagtctataaaatgaaattaatgaaattaaacattttaatattttaaccctttattttgctttga

SEQ ID NO: 151537 - DNA, 601 bp, Human
ctaatttttgtcgaacattttcaaatagctctaagcctcaagcctgagatttagccctaacccaggccagactggaccactaaatttttaaacattttttccaaactatactctctttaagtatgtgtgtataagaacaaatggctatttcagtctataaaatgaaattaatgaaattaaacattttaatattttaaccctttattttgctttgagatggagtctcgctctgtcatccaggctggagtgcaatggcgccatctctgcttactgcaacctctgcttcccgggttcaagcgawtctgcttcccgagttcaagcgattctcctgcctcagcctcgtgaatattttaacacgttaatatttaagaatgtttcctcctggttgattcccactaaaatgcatgtgtccttccattaaaagagcccaagcactacagtgtcatttccatatctcttttcttgtcttgccttgttatttaatgactgaatgcttctttgacatcagagaataacctttcatgatatgcactcaaatgtgtagatgaatcagataaccatatccttgttaaaggagattattctgaaatatatgaaccaa

SEQ ID NO: 151538 - DNA, 601 bp, Human
taacccaggccagactggaccactaaatttttaaacattttttccaaactatactctctttaagtatgtgtgtataagaacaaatggctatttcagtctataaaatgaaattaatgaaattaaacattttaatattttaaccctttattttgctttgagatggagtctcgctctgtcatccaggctggagtgcaatggcgccatctctgcttactgcaacctctgcttcccgggttcaagcgaatctgcttcccgagttcaagcgattctcctgcctcagcctcgtgaatattttaacacrttaatatttaagaatgtttcctcctggttgattcccactaaaatgcatgtgtccttccattaaaagagcccaagcactacagtgtcatttccatatctcttttcttgtcttgccttgttatttaatgactgaatgcttctttgacatcagagaataacctttcatgatatgcactcaaatgtgtagatgaatcagataaccatatccttgttaaaggagattattctgaaatatatgaaccaatgggaagacagaatttgtaagacaggaactttcttactggatttctaggaacgctgg

SEQ ID NO: 151539 - DNA, 601 bp, Human
tgactcagtcaacttctagggcagtgattctctcctgggcaattttgcctcccaggggaatttggcaatgtctggagacactttttattgtcatgactggggagttgctactggcatctggtgagtagactccatggatgctgctaggcaccctacagtacacaggacagcccctatgacaaaatattatccagtccaaaatgtccacagtgctgaggctgaggaagcctcttctagagattgtcctcccaagctgctcgtctctttttccttcaccaactaaggctttaccttgtacctragaaattcaattggcttttttgaaccttatatgggttcatacatgggcctcagagagtccacaaacttgcacaattctgttattgtgtatgtatttattctgcctgttggggaagggagctttcatcaaattctcaaaggttgtattctatgttcattctgcgtatgatttccctacctcacattttctgctcattcatcacttctctttgccacactgccgtttttctacttcataacttctcagctgcttctcacattgctgctttcttatcgtggccatatttcccagttcgaattc

SEQ ID NO: 151540 - DNA, 601 bp, Human
aacttctagggcagtgattctctcctgggcaattttgcctcccaggggaatttggcaatgtctggagacactttttattgtcatgactggggagttgctactggcatctggtgagtagactccatggatgctgctaggcaccctacagtacacaggacagcccctatgacaaaatattatccagtccaaaatgtccacagtgctgaggctgaggaagcctcttctagagattgtcctcccaagctgctcgtctctttttccttcaccaactaaggctttaccttgtacctaagaaattcarttggcttttttgaaccttatatgggttcatacatgggcctcagagagtccacaaacttgcacaattctgttattgtgtatgtatttattctgcctgttggggaagggagctttcatcaaattctcaaaggttgtattctatgttcattctgcgtatgatttccctacctcacattttctgctcattcatcacttctctttgccacactgccgtttttctacttcataacttctcagctgcttctcacattgctgctttcttatcgtggccatatttcccagttcgaattccgaaggtaag

SEQ ID NO: 151541 - DNA, 601 bp, Human
ccaccagacaacctcataggcccctggccttcccacaccacagctgccctgggttctggtcaggtcccccatgggatgaggaaggccagtagggagtcaatgtcacccagaacaaaacatggctgcccaaggcaggctccctcaggacgggcactggctgaggcaggcatcgtgattgccgcgtctaacaaagatggtcagaaaaccccggggttaggttctggctagagaagccacaaagcacctggaaagacaggaagatactggagtcagtctgaaactccagggtgtggcaaacacrtgcagaccctcagaagcctaagaggaggttttgcagaaccacgaggaaaaaataactcagggacgagaaataagggtcaggactcaaagcagtggacataatcaggacagaacaggccgaagtgcagacacaaaacagatcaataaaacccaacagctcagcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagc

SEQ ID NO: 151542 - DNA, 601 bp, Human
acccaacagctcagcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagcaggacaggaggcaggtctgagagatctggtttgtgtcttgtgccctggttctctctgcattccttctctgtctctttttcccttcctcatgccttttccttagctgatttccctaggacagaattattttctttttcggactgaatgrtaaagaagtatttgtttcctaagtcttcatttcaaaagcaacaggatagaactctctaagaaaaaaaaaaaacacaaatctctaaatgacattaaattacatttttatttatgtagccttgaatggattgttctactttcagtcagtagatttaaaaggggaaaaaaaacatgttcctcagtccaatgttatagatggcttagatgactgggctgcgttacaccagcaccaggaaatatctagagcagtggttctcaaactttgctccacattagaattttaaccctcaggcggcacccc

SEQ ID NO: 151543 - DNA, 601 bp, Human
ctaggacagaattattttctttttcggactgaatggtaaagaagtatttgtttcctaagtcttcatttcaaaagcaacaggatagaactctctaagaaaaaaaaaaaacacaaatctctaaatgacattaaattacatttttatttatgtagccttgaatggattgttctactttcagtcagtagatttaaaaggggaaaaaaaacatgttcctcagtccaatgttatagatggcttagatgactgggctgcgttacaccagcaccaggaaatatctagagcagtggttctcaaactttgytccacattagaattttaaccctcaggcggcaccccacgccattaaatcagaacatctagggatgggagccaaacagccgtagtttttaaagtttctcagatgattccaatgtgcatcactggggactcactgtctaggaggtgattttaataaagccctgatccttgcttgctttcttgccactttacttttccaccagtagaatgtaacaaaagacaccttttatttttcagttaattaaattaaatcccagttcattgaggttgtgctctaatttcatgccagaaggcaaccagccgg

SEQ ID NO: 151544 - DNA, 601 bp, Human
agcaacaggatagaactctctaagaaaaaaaaaaaacacaaatctctaaatgacattaaattacatttttatttatgtagccttgaatggattgttctactttcagtcagtagatttaaaaggggaaaaaaaacatgttcctcagtccaatgttatagatggcttagatgactgggctgcgttacaccagcaccaggaaatatctagagcagtggttctcaaactttgctccacattagaattttaaccctcaggcggcaccccacgccattaaatcagaacatctagggatgggagccaracagccgtagtttttaaagtttctcagatgattccaatgtgcatcactggggactcactgtctaggaggtgattttaataaagccctgatccttgcttgctttcttgccactttacttttccaccagtagaatgtaacaaaagacaccttttatttttcagttaattaaattaaatcccagttcattgaggttgtgctctaatttcatgccagaaggcaaccagccgggtagttgcttacttcagtcaaaacaacagaccagcattttggcatcgtgtagtcaagcaatgtttttatcca

SEQ ID NO: 151545 - DNA, 601 bp, Human
gacattaaattacatttttatttatgtagccttgaatggattgttctactttcagtcagtagatttaaaaggggaaaaaaaacatgttcctcagtccaatgttatagatggcttagatgactgggctgcgttacaccagcaccaggaaatatctagagcagtggttctcaaactttgctccacattagaattttaaccctcaggcggcaccccacgccattaaatcagaacatctagggatgggagccaaacagccgtagtttttaaagtttctcagatgattccaatgtgcatcactggrgactcactgtctaggaggtgattttaataaagccctgatccttgcttgctttcttgccactttacttttccaccagtagaatgtaacaaaagacaccttttatttttcagttaattaaattaaatcccagttcattgaggttgtgctctaatttcatgccagaaggcaaccagccgggtagttgcttacttcagtcaaaacaacagaccagcattttggcatcgtgtagtcaagcaatgtttttatccactgatgagtggttgttagtttaatcttcaactttgtaacttggtgtttaaa

SEQ ID NO: 151546 - DNA, 601 bp, Human
ggaaaaaaaacatgttcctcagtccaatgttatagatggcttagatgactgggctgcgttacaccagcaccaggaaatatctagagcagtggttctcaaactttgctccacattagaattttaaccctcaggcggcaccccacgccattaaatcagaacatctagggatgggagccaaacagccgtagtttttaaagtttctcagatgattccaatgtgcatcactggggactcactgtctaggaggtgattttaataaagccctgatccttgcttgctttcttgccactttacttttccwccagtagaatgtaacaaaagacaccttttatttttcagttaattaaattaaatcccagttcattgaggttgtgctctaatttcatgccagaaggcaaccagccgggtagttgcttacttcagtcaaaacaacagaccagcattttggcatcgtgtagtcaagcaatgtttttatccactgatgagtggttgttagtttaatcttcaactttgtaacttggtgtttaaatttatccaaacacaactttggaccctggagatatccggacttatttactgcccaccaaccccctcccccact

SEQ ID NO: 151547 - DNA, 601 bp, Human
ctctaatttcatgccagaaggcaaccagccgggtagttgcttacttcagtcaaaacaacagaccagcattttggcatcgtgtagtcaagcaatgtttttatccactgatgagtggttgttagtttaatcttcaactttgtaacttggtgtttaaatttatccaaacacaactttggaccctggagatatccggacttatttactgcccaccaaccccctcccccactccccgcccttattcaccagagtgaccagaaagcaatatgatcttcacagcgccagatcttgctgtgataatccraggaaagaggagccatcaagccactcaagcaacatctcagctgctcagtaaatctttcaagagctcacccaagtcccaatctcagcttcctgatttcttttcctctttatatgtgaagggttttgttgtttgttgtttattttttttattttcataggtttttggggaacagatggtgtttggttacctaagttctttagtggtgatttgtgagattttggtgcacccatcacccgagcagtatacattaaacccaatttgtagtcttttatccctcacccccttcccaacctttcccca

SEQ ID NO: 151548 - DNA, 601 bp, Human
agatatccggacttatttactgcccaccaaccccctcccccactccccgcccttattcaccagagtgaccagaaagcaatatgatcttcacagcgccagatcttgctgtgataatccaaggaaagaggagccatcaagccactcaagcaacatctcagctgctcagtaaatctttcaagagctcacccaagtcccaatctcagcttcctgatttcttttcctctttatatgtgaagggttttgttgtttgttgtttattttttttattttcataggtttttggggaacagatggtgtttgrttacctaagttctttagtggtgatttgtgagattttggtgcacccatcacccgagcagtatacattaaacccaatttgtagtcttttatccctcacccccttcccaacctttccccaagtccccagagtccattgtatcattcttatgcctttgcatcctcatcgtttagctcccacttatgagtgagagcatacaatgtttggttttccatttgttgttcattttttaataaacatggttgaaaagactaggctatagtaggtcagtagggcctgtttctgagtgtggtctgttttgcc

SEQ ID NO: 151549 - DNA, 601 bp, Human
gggtgtcagcatcctcatctatcaaatgagaagttgagctggataatccccaaagtccctcattgcatacgaatgtcctatgatatttaacaataggacatgtagccttctgccttgagaaatttaggtactaacagaaattgtttccctgaggtcccttcaacttcaacaatttagagtaattcaccaatgtgtttcctattttgaataggactaatgtgtttcctattttgaattgcaaaaaatataaacatatccatatttgataccaagaaattagtaattctgttggatgtgaaamgaacacgggttacataagaatatggtcataattgctagagatatatactgaaataggtaggagtaaaataacatgatgtctgggatttttttaaataaaataatatatatccagatttcacaagatttcctttgggctggaaaggtttctgaatatagtgcctgtgttctagaaagaggggtcaggagcctagagtatgcagatgttgatggtattgagtgttctgtacacagaaccaagagactagagactttagagaccacaaaatgcttttcctaaagacctagaacatgaaggttt

SEQ ID NO: 151550 - DNA, 601 bp, Human
tatttgataccaagaaattagtaattctgttggatgtgaaaagaacacgggttacataagaatatggtcataattgctagagatatatactgaaataggtaggagtaaaataacatgatgtctgggatttttttaaataaaataatatatatccagatttcacaagatttcctttgggctggaaaggtttctgaatatagtgcctgtgttctagaaagaggggtcaggagcctagagtatgcagatgttgatggtattgagtgttctgtacacagaaccaagagactagagactttagagrccacaaaatgcttttcctaaagacctagaacatgaaggtttaatttatttccctttttctcctccatgtgttttggataggttggtaagtggaaatcaattacccctgaataaaatagaaaccctgagagagataagtgacttttctggggatacatgctaatgacaacatcaaagccagagtgaggattgaagggtgaggtactatgactacctccctctactcctccttcccctcctgctggggaaatgccaaaggtataagtatccttttggcaccatttgtcctccagggtttctg

SEQ ID NO: 151551 - DNA, 601 bp, Human
caacatcaaagccagagtgaggattgaagggtgaggtactatgactacctccctctactcctccttcccctcctgctggggaaatgccaaaggtataagtatccttttggcaccatttgtcctccagggtttctgtgtctgtcctgtatctccttattcattcttaaaactctttctagtggtcagagctctcctttaaagaaagaataacaagacatcatagcagtgaactcagagcactatcactggcttttcacaggacatgagcaactttctcactggaggggtcagggatgcttgyatggtaggtgctcctgactgtgataacttcacttgagcctaccctgagaatgaccctgtgtggcagatgcacccaaatatatgttcagagttccaagctaaggaattggaagtggccatcccagagattcattccttatctatgaggaacatctgaaccccagcccgtcccagggaatgtgggccatacaggggatcagcatcctttgtttggggttaaatgaaggttgccaggctgaggttgctagggggagggtgttaagtgaaaatgttttataaactgcatgccttttgccagcga

SEQ ID NO: 151552 - DNA, 601 bp, Human
ggaaatgccaaaggtataagtatccttttggcaccatttgtcctccagggtttctgtgtctgtcctgtatctccttattcattcttaaaactctttctagtggtcagagctctcctttaaagaaagaataacaagacatcatagcagtgaactcagagcactatcactggcttttcacaggacatgagcaactttctcactggaggggtcagggatgcttgtatggtaggtgctcctgactgtgataacttcacttgagcctaccctgagaatgaccctgtgtggcagatgcacccaaatrtatgttcagagttccaagctaaggaattggaagtggccatcccagagattcattccttatctatgaggaacatctgaaccccagcccgtcccagggaatgtgggccatacaggggatcagcatcctttgtttggggttaaatgaaggttgccaggctgaggttgctagggggagggtgttaagtgaaaatgttttataaactgcatgccttttgccagcgattgtggttcttcttaccagcccactgccactggaccagcagttctcctgtccagcccgccaccactagaccctctcccc

SEQ ID NO: 151553 - DNA, 601 bp, Human
ttttataaactgcatgccttttgccagcgattgtggttcttcttaccagcccactgccactggaccagcagttctcctgtccagcccgccaccactagaccctctcccctgtatgtaaacccccagtaaaaccccagtgtctcattttctagctctggatctcttcttcagcctcttgaacctagtgccatcccctttggagttgatagggattcagcacatcactgctacactagaataaaacatgtgctgtgtccacattaggccaacaaaatcccataccatccaacttttttcactrattaaaaatactattaaattttaaattggttcatataagaagttgcagaaaaggtgtttgtaggcaaatccagctgactcacatataaatcatctgtattagtttattagggctgacataacaaagcaccacaactagatggcttacaacaacaaaaatgtattttccgacacttctagaggcaacaagtgtggaatcaaggtttcagcagggccatgctccctctgagatgctgggtggagtcctcccttgcctcaccctagcctcttgtggtggcagcactccttggcattccttggc

SEQ ID NO: 151554 - DNA, 601 bp, Human
gccagcgattgtggttcttcttaccagcccactgccactggaccagcagttctcctgtccagcccgccaccactagaccctctcccctgtatgtaaacccccagtaaaaccccagtgtctcattttctagctctggatctcttcttcagcctcttgaacctagtgccatcccctttggagttgatagggattcagcacatcactgctacactagaataaaacatgtgctgtgtccacattaggccaacaaaatcccataccatccaacttttttcactgattaaaaatactattaaatttyaaattggttcatataagaagttgcagaaaaggtgtttgtaggcaaatccagctgactcacatataaatcatctgtattagtttattagggctgacataacaaagcaccacaactagatggcttacaacaacaaaaatgtattttccgacacttctagaggcaacaagtgtggaatcaaggtttcagcagggccatgctccctctgagatgctgggtggagtcctcccttgcctcaccctagcctcttgtggtggcagcactccttggcattccttggcttgtagctgcatcactccgatc

SEQ ID NO: 151555 - DNA, 601 bp, Human
ctcttgtggtggcagcactccttggcattccttggcttgtagctgcatcactccgatctctgccgctgttttccaaggtgtcctccccgtgtgtctcttctctgtcttataaaaacatccgtcctattggattaagggcccaccccactccattattacttcatcttaaccaattacatttgcaaggaccctatttccaaatgaggtcacattctaaggtactggaggacttcagcgtctctttcgggaggatgcaattcaacccataacaccatccaaacaaatgacattatgagaaggyttccatttttgtcctctgttgtggttagattcctgattttacataatttagagctaaaaatttacttcctgtctgaaaagtgatttttgacaaggattgagatcacaactcgagttctgtggccattgcttgccctttcagaatcacttgtcccatcctgtgtgccatgttccaaagaagccaggtgagcagatgctggcgacacagggatgacagcatagactacagctttaagtgaaagggactcatgactcaaccctgtagcttgcccttgctatggttgccccacccctcccaact

SEQ ID NO: 151556 - DNA, 601 bp, Human
agtgaaccatgctgcctatatgtaatgaatcgggtgggccaatattcacacacagtaacacaaagaaaaaaaatcctccaattttttaaaattaaaatgaatgattgatgcaattggactactttggaaaataatgtcaccaaaaccgatgagggggaaataaaagtgagaacctgggatgaagcaattgggacaaatttgggccttaaagaatctcaaagcacattatttgctcaatgctataatcttcccagctctggggagccagatcccctggcttatggagaccaaaagaaactayacatggcactctcgggctaaaaaacagtacatggactcatttccatcagctagagatgagtctatttgcccatgctaatatttcagttctcaacttaatagcttaagatgttcccattatcaacatcacttacctacccacagcacttttaaattagccttgggaaaaatgagtaaacagaagcacagtttatcattctgccaagtgcagctacccctgaagaaggcagctttggatagcaaaacagacaactagattgaaaaacagaagtgtcagccttgacacatgctactaatttgc

SEQ ID NO: 151557 - DNA, 601 bp, Human
tttactccacccctgacctttgggcactgtctcccattcccagtcaacacttgccaattggacctgacagttgacttgactttaccctatttatcttgctccctctgtctccatctcaatctcaatcaagattttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcargagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacac

SEQ ID NO: 151558 - DNA, 601 bp, Human
ctccatctcaatctcaatcaagattttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatg

SEQ ID NO: 151559 - DNA, 601 bp, Human
atctcaatctcaatcaagattttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcac

SEQ ID NO: 151560 - DNA, 601 bp, Human
agattttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaa

SEQ ID NO: 151561 - DNA, 601 bp, Human
attttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaaca

SEQ ID NO: 151562 - DNA, 601 bp, Human
tttgtaattcccctttggttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaacaaa

SEQ ID NO: 151563 - DNA, 601 bp, Human
gttcctccactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaacaaacctgcacaccctgagca

SEQ ID NO: 151564 - DNA, 601 bp, Human
cactctcagccaccctggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaacaaacctgcacaccctgagcatgtaccc

SEQ ID NO: 151565 - DNA, 601 bp, Human
tggtacctctactcctaaacaaggcccatgcctttgactcaagtggatgtgcttgcttctgctcaagttcagcctgccccaaaagagtgattcccaagtgctttattggataaacttccttttcattcaagagctccacatgcatgtctataaattgccatatgtaatctctatcaattgccagaaatcttgcagatttctttctgaatctgagtttatctgacaatttgtcaggactaaagactaacattggcctaacgtcagtttatctgacaatttgtcaggacaaaagactaaccttgggctaatgtcagtaaacaagaaagagctcaggaacagaaaaccaaacaccgcatgttctcacttataagtgggagctgaacgatgagaacacatggacacatagggcaggaggttgggggaacaacacatattggggcctatcagggcgtggggagggagagcatcgggaagaatagctaatggatgttgggcttaatacctgggtgatgggttgatctgtgcgcaaaccaccatggcacatgtttacctatgtaacaaacctgcacaccctgagcatgtaccccaggacttaaaagtt

SEQ ID NO: 151566 - DNA, 601 bp, Human
tagtaggcaaccaattgttattggttgaatactgagtgaatgaaagaataaatgaatgacccagaagcagaatggaattgtggttggagcacagcctttggcatcaaagagatctcggttcaagttttggatatgcaacttcttagctatgagtcttctctgaatttcagtttcttcatcaataaagtaggggtaataatagtgcctacctcatagattttggggagcattaaataagataatgcctgtaaggttcttagcatgatagctggcatattttaagaacttagtaaatgttgtstattattttcggtgaaagtcctcaaatgttgaagcttatcagaggtaattgaattatttaatatggctggtagtgatgattgtactaaagacaaattagtacaattagtctgtcagcaagatttgatttaaagagtcaggctgacaaaaaaaatgtattggtcacacccaccatatttaaagcactatactaggctttcaggagggggtgggatgcaaggatggatatgacacagccccttccctctaggaacgtagaactgagaagatttactatgtgtgcactgtaccatgctgaaga

SEQ ID NO: 151567 - DNA, 601 bp, Human
tgccagtcacctcctcctctgtccattgagtcagcatggaggatattcagcactggcttcctcaaggaataatcctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgasgccaggagtttgagaccagcctggccaacatggcaaaaccccatctctactaaaaatacaaaaacttcgccaggtgtaatgacatgtgcctgtagtcccagctacttggggcagggggcgggtgaaatgggagaatcacctgagcctggggaggttgaagttgcagtgagctgtgattgcgccgttgcactccagcctgggagacacagtaagaccctgtcaaaaaaaaaaaagatccatacctctaacagttgtcccttcatgcctccgagactcaggctagtcagtccccagagtctg

SEQ ID NO: 151568 - DNA, 601 bp, Human
taatcctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgacgccaggagtttgagaccagcctggccaacatggcaaaaccccatctctactaaaaatacaaaaacttckccaggtgtaatgacatgtgcctgtagtcccagctacttggggcagggggcgggtgaaatgggagaatcacctgagcctggggaggttgaagttgcagtgagctgtgattgcgccgttgcactccagcctgggagacacagtaagaccctgtcaaaaaaaaaaaagatccatacctctaacagttgtcccttcatgcctccgagactcaggctagtcagtccccagagtctgaaagttcttatacaaaacccagaattccagttcatctataactatgtcagaatttgttaagaaatttca

SEQ ID NO: 151569 - DNA, 601 bp, Human
cctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgacgccaggagtttgagaccagcctggccaacatggcaaaaccccatctctactaaaaatacaaaaacttcgccargtgtaatgacatgtgcctgtagtcccagctacttggggcagggggcgggtgaaatgggagaatcacctgagcctggggaggttgaagttgcagtgagctgtgattgcgccgttgcactccagcctgggagacacagtaagaccctgtcaaaaaaaaaaaagatccatacctctaacagttgtcccttcatgcctccgagactcaggctagtcagtccccagagtctgaaagttcttatacaaaacccagaattccagttcatctataactatgtcagaatttgttaagaaatttcattaa

SEQ ID NO: 151570 - DNA, 601 bp, Human
aaccagtcaatgtctacactggcacattctgctgtcttcaaaggctgtttcagtctccccagcctgtccagctcagaaaaactgatgttcatccttttctgtttttctcaaagaaaataccaaagcttttaatagctgatatctcctagtggtgcaatcatgagagatttttattttctccttgtagttttctgtaattgagagattatcgacaatgactatgttacttctataatcagagagagaaatattgtgcttgcttttattttcttaagcaactctacataaattcttgccacarctttctgggccccgtaatgttactgctgtgtctccttcctcccagccctcatggcaggactcatgtgtgacaggctctgggtcttctctcatctgccagtggcaaggaaaccctaggctgccaggactgcttagcaaatagatcatgaagtattacgactccattttacagatggagaaaccaagccccctgacttccctctgtctacactacaggcaaatgggatctggacccactgagatgagctcgacatgtacgactttgaggctgtactctctcattcagaggaagttaaggagc

SEQ ID NO: 151571 - DNA, 601 bp, Human
gtcatcagtcatcaaaacgctctgggtacaagagtgccccacagcataatagccctgcccaggagcatctggtaacattggaagtggtgaatcgacccattcagacttctctgtgctttctcccgtcttggcttctaccccttcatgccaaatgcctcatgctatttactggaaggaaaggcaaatgaaggagaacagggcaatgctgagtactgagtggacctttcctttaagagtttgaagaggtcagaaagcacccagtagtcagagctgtgttgcaaagctcccggaaaatttggcygctactttgtatttgtgtgtgtattcattattcatagacatgtattcatagacaacattattgctcaaaagatttgagacatattctccacttcactttatataattttaactttttacagcaaacaggtcaccactctaaagagtggcttaaccagaaatccttttttaaaaaaaattaaccaaatagtataaagtagataaggtggcagtagcagatttatctgtggtaccaattggcaaaccaaggccctaaaaggaaattccaaagccctagggtttgtacacacacttcctattc

SEQ ID NO: 151572 - DNA, 601 bp, Human
accccttcatgccaaatgcctcatgctatttactggaaggaaaggcaaatgaaggagaacagggcaatgctgagtactgagtggacctttcctttaagagtttgaagaggtcagaaagcacccagtagtcagagctgtgttgcaaagctcccggaaaatttggccgctactttgtatttgtgtgtgtattcattattcatagacatgtattcatagacaacattattgctcaaaagatttgagacatattctccacttcactttatataattttaactttttacagcaaacaggtcaccaytctaaagagtggcttaaccagaaatccttttttaaaaaaaattaaccaaatagtataaagtagataaggtggcagtagcagatttatctgtggtaccaattggcaaaccaaggccctaaaaggaaattccaaagccctagggtttgtacacacacttcctattcatctttaagtgcacctcatggaccttttattcctctgattgatcttccctgacccctgcacccagcctccatcatcctccaccctttcccaacctggtgtttggattacaaagatacttctgattccagtggctat

SEQ ID NO: 151573 - DNA, 601 bp, Human
cactggggtcggctttgtagcccatttcctccattggatggcctctgagttctgtgggcttctgatgaagcaaaagaccccatcctgaatcctgaggcaagagggactcagagtttcactcacatacgggagccactgggctcccacacaaagggaaatctccaccctagtgacacaaggagccaggcagtctcccggagcccacttagagcaatgagtttccaagtcaaaagacatttcaaggaagaggagcatcttgtccatctgaaattaggcctccactcagaaaaatctgaggagyctggagggttccaaggagcaattgtaaccccaactgatgatggtggagcatttatcaagccttgccaatgacagtggttcacgcttcaatagcactttgcagccatgtggcatgcttgaacaaaaatatcatttatttcatcctcacaacagttgactgaggaaagcagggcacatgtgaccctctcgacactttacattaaaagatactcatgctcagaaagaggaaaagacatgccaaattcaatgtggctgatgaatgacaggaccagctctagaaaacaaccacctattctgtctc

SEQ ID NO: 151574 - DNA, 601 bp, Human
gacagggcatgatccagctttggagaacccagggatgtccatgcctgaaagagggtaatctgaaagttagcatgagaagcagcccagctttctgttgggggacaatgtggcaattcctattgtttctgaaacagtatggagaaatcacattttcctggcagctatattcctgcatagaaagacagcaatttttgtgggaaaaagacattaacaggccacatggtgggaaggctaagattccccatggggttgactttgaggaacactagatggttaccatgtctctagaaatgagcctgcycttggtgagtgagatatgcaagctgatgctgattgcaggattgcttgggactatagagagaattttattttattttagaggggattttagagcggtgtgaggaaagatgaaggggcaagatatgacaactgataggggaggaactttgagggcaaatacaaagatgcttaataaggaattttgccaagtgtctgctatgaaatgttctatagagcccctcactcctgtctactcacaatatccttgctcttatttttttttattatactttaagttttagggtacatgtgcacaacatgc

SEQ ID NO: 151575 - DNA, 601 bp, Human
aatttccctctacacactgctttaaatgtgtcccagagattctggtatgtagtgtctttgttctcattggtttcaaagaacatctttctttctgccttcatttacttatttacccagtagtcattcaggagcaggttgttcagtttccatgtagttgtgtggttttgagtgagtttcttaatcctgggttctaatttgattgcactgtggtctgagagacagtttgttataatttctgttcttttacatttgctgaggagagctttacttccaactatgtggtcaattttggaataagtgygatgtggtgctgagaagaatgtatattctgttgatttggggtggagagttctgtaaatgtctattaggtccacttggtgcagagctgagttcaagttctgaatatccttgttaactttctgtgtcatcgatctgtctaatgttgacaatggggtgttaaagtcccccattattattatgtgggagtataagtctccttgcaggtctctaaggacttgctttatgaatctgggtgctcctgtattgggtgcatgtatatttaggatagtagctcttcttgttgaattgatccctttaccat

SEQ ID NO: 151576 - DNA, 601 bp, Human
catttacatttaaggttaatattgttatgtgtgaatttggtcctgtcattatgatgctagctggttattttgcttattagttgatgcagtttcttcctagccttgatggtctttacaatttggcatgtttttgcagtggctggtaccagttgttccttcccatgtttagtgcttccttcaggagctcttgtaaggcaggcctggtggtgacaaaatctctcagcacttgcttgtctgtaaaggattttatttctccttcacttatgaagcttagtttggctggatatgaaattctgggttkaaaattcttttctttaagaatgttgaatattggcccccactctcttctggcttgcagagtttctgccaagagatccactgttagtctgatgggcttccctttgtgggtaacccaacctttctctctggctgcccgtaacattttttccttcatttcaactttggtgaatctgacaattatgtgtcttggagttgctcttctcgaggagtatctttgtggcgttctctgtatttcctgaatttgaatgttggcctgccttgctaggttggggaagtactcctggataatatcctgcagagt

SEQ ID NO: 151577 - DNA, 601 bp, Human
ttacctagtcaagcctcagcaatggtggacgccccttccccacccttgctgccaccttgcagttcgatctcagactgctgtgctagcagtgagcgaggctccgtgggcataggaccctccgagtcaggggcaggatataatctcctagtgtgccatttgctaagaccattggaaaagtgcagtattagagttggagtgtcccgattttccaggtactgtctgtcacggcttcccttggctagtaaagggaatttcccgaccccttacacttcccgggtgaggcgatgcacccccctacttccactgacactccgtgggctgcacccactgtccaacaagccccagtgagatgaacccggtacctcagttggaaatgcagaaatcacccgtcttctgcattgctcacgctgggagctgtggactggagctgttcctatttggccgtcttggaacccctatccttgctcttattaatacctcaagtgacatacagttcagtgtgccctacatgtggacggagggtgagagtgaaggctgccatttagaggcagccctgcctggttactcatccttcattctgtaaggagctaagtgctactgt

SEQ ID NO: 151578 - DNA, 601 bp, Human
ttgcagttcgatctcagactgctgtgctagcagtgagcgaggctccgtgggcataggaccctccgagtcaggggcaggatataatctcctagtgtgccatttgctaagaccattggaaaagtgcagtattagagttggagtgtcccgattttccaggtactgtctgtcacggcttcccttggctagtaaagggaatttcccgaccccttacacttcccgggtgaggcgatgcacccccctacttccactgacactccgtgggctgcacccactgtccaacaagccccagtgagatgaaccyggtacctcagttggaaatgcagaaatcacccgtcttctgcattgctcacgctgggagctgtggactggagctgttcctatttggccgtcttggaacccctatccttgctcttattaatacctcaagtgacatacagttcagtgtgccctacatgtggacggagggtgagagtgaaggctgccatttagaggcagccctgcctggttactcatccttcattctgtaaggagctaagtgctactgtgttctcagaacgtttgtgctaagcagggaacccctcttttgaactgtacgggatat

SEQ ID NO: 151579 - DNA, 601 bp, Human
cctagtgtgccatttgctaagaccattggaaaagtgcagtattagagttggagtgtcccgattttccaggtactgtctgtcacggcttcccttggctagtaaagggaatttcccgaccccttacacttcccgggtgaggcgatgcacccccctacttccactgacactccgtgggctgcacccactgtccaacaagccccagtgagatgaacccggtacctcagttggaaatgcagaaatcacccgtcttctgcattgctcacgctgggagctgtggactggagctgttcctatttggccrtcttggaacccctatccttgctcttattaatacctcaagtgacatacagttcagtgtgccctacatgtggacggagggtgagagtgaaggctgccatttagaggcagccctgcctggttactcatccttcattctgtaaggagctaagtgctactgtgttctcagaacgtttgtgctaagcagggaacccctcttttgaactgtacgggatataaaagtgaacacaatctactgctctccccatactgacccactagccttacttgggctctgttcgcctgggcacatgcacttacacag

SEQ ID NO: 151580 - DNA, 601 bp, Human
cagaacctagttattcttatttgaaaccaccttaattttctaaaatttagttattgggttttttaattcacatcagatcagaagcaacaatagagtggaaggggctagaagaaactatcttgagtgatctagaagggagtcagctaacaaaagtgagaactattagctgttaaattgaatgtaaagaaaaagacattaaaaaagaaaaaagccgggcgtggcagctcacgcctgtaatcccagcactttgggaggccgaggcaggtggatcacctgaggtcaggagttcgagaccagcctraccaatatggtgaaaccccatctctactaaaaacacaaaaattagctgagcatggtagtgtgtgcctgtagtcccagctactcgggaggctaagacaggagaatttcttgaacccgggcattggaggttgcagtgagccaagattgggccactgcactccagcctgggcaacagagcaagactccgtcaaagaaagaaaagaaaagagaggagaggagaggagaggagaggagaggagaggaggggagaggagtggagaggagtggagaggagacgggacgggacgggacgggatgggac

SEQ ID NO: 151581 - DNA, 601 bp, Human
taacaaaagtgagaactattagctgttaaattgaatgtaaagaaaaagacattaaaaaagaaaaaagccgggcgtggcagctcacgcctgtaatcccagcactttgggaggccgaggcaggtggatcacctgaggtcaggagttcgagaccagcctgaccaatatggtgaaaccccatctctactaaaaacacaaaaattagctgagcatggtagtgtgtgcctgtagtcccagctactcgggaggctaagacaggagaatttcttgaacccgggcattggaggttgcagtgagccaagawtgggccactgcactccagcctgggcaacagagcaagactccgtcaaagaaagaaaagaaaagagaggagaggagaggagaggagaggagaggagaggaggggagaggagtggagaggagtggagaggagacgggacgggacgggacgggatgggacaggaaaggaaagaaaagcaaagaaaagaaaaggaaaaagaaagagaaaaagacactaaaaaggaaaggagagaggagagatgggcaaaaggatggagcgagggaaggaggctataaaaagaagactcagaatcttaaaatgctc

SEQ ID NO: 151582 - DNA, 601 bp, Human
agccttgatctctaggagcagctgagcacatcctatatccaccatatcacaccataatttttatgttcataaatgaccccagtactccataaaaagtttcaattaggaaatcagagaagcgcctcatttttagaagtgtgcacccaatagattaaaagtttggccgggcgtggtggctcacgtctgtaatcacggcactttgggaggccgaggcgggtagatcacgaggtcaagagatggagaccaccccggccaacagggtgaaaccctgtctctactaaaaaaacaaaaaaattagctrggcatggtggcacgcacctgtaatcccagctactccagagattgaggcaggagaatcatttgaacctgggaggcaaaggttacagaaagccgagattgcgccactgtactccagcctgggtgacagagcaagagtccatctcaaaaatatatatatatataatatataaaacatatatatgttatttataagttatatatatgttttataaggtatatttatgttttatatgtatatatgttatatatatgttttatatatgttttatatttatatatgtatgtttttatatatatatgt

SEQ ID NO: 151583 - DNA, 601 bp, Human
tgggcatggtggcacgcacctgtaatcccagctactccagagattgaggcaggagaatcatttgaacctgggaggcaaaggttacagaaagccgagattgcgccactgtactccagcctgggtgacagagcaagagtccatctcaaaaatatatatatatataatatataaaacatatatatgttatttataagttatatatatgttttataaggtatatttatgttttatatgtatatatgttatatatatgttttatatatgttttatatttatatatgtatgtttttatatatatatrtgttttcattcctgaaagggtgtgctttagatatttagacatgatgatgccagaaaaatatgttttaattgtgtgcatttatgaaggaaaaggaagaatgggctgagaattattattgccttgctagttgaagatttcacaatggaggttgtcccagttcttgaagtctccacatttccttgatttctgatattgcgatttttattcacttcagctactaacccaaccaccttgcagccacatctcagtgggcttcatcatccatctgcccttgagttcaaattaatgcacacaaagagg

SEQ ID NO: 151584 - DNA, 601 bp, Human
tgcccttgagttcaaattaatgcacacaaagaggttactggaggaatcaagaaggtctcagaacctatcccttaggaatatggagagcctgttgattaatggaaaagagttgcacaactcaaggccaagtgctgtttccgtggatctgtacatgagaatactgcattctatatgactttataaaaatagtcacccaacaggtgttgttgaacacctgtagacatgtttacaggtgacagtgtagggggctgaatatgtagatgaagccaaactgagattgttctggaactttgatgatggyattccagacgggacaatggcagtgggtcaggcgttggaggcttccgtcttaatcactgctcttctacttggttaaatgtagtagttaccatctgcagtaggctgtactggttgtctctggattgtccctagatttgcccaactaaataaagctagccattataacacccagcctcttagctcagagcacaacagccaaaggtttatttctcacccatgtgacagtttgctggtggtcagcatgaactcaagagcctttcatctgttggctgtactgagcttttaggacctcacagtcctc

SEQ ID NO: 151585 - DNA, 601 bp, Human
tcaagaaggtctcagaacctatcccttaggaatatggagagcctgttgattaatggaaaagagttgcacaactcaaggccaagtgctgtttccgtggatctgtacatgagaatactgcattctatatgactttataaaaatagtcacccaacaggtgttgttgaacacctgtagacatgtttacaggtgacagtgtagggggctgaatatgtagatgaagccaaactgagattgttctggaactttgatgatggtattccagacgggacaatggcagtgggtcaggcgttggaggcttccrtcttaatcactgctcttctacttggttaaatgtagtagttaccatctgcagtaggctgtactggttgtctctggattgtccctagatttgcccaactaaataaagctagccattataacacccagcctcttagctcagagcacaacagccaaaggtttatttctcacccatgtgacagtttgctggtggtcagcatgaactcaagagcctttcatctgttggctgtactgagcttttaggacctcacagtcctcaatttcatcttcttcaggccagtaatggaggagagagaaatagagg

SEQ ID NO: 151586 - DNA, 601 bp, Human
tgtaaaaagctttaaagaccaggactaggctagaagtacagtcatgcatcgcttgacaatggggatactttttgagaaatgcatccttaggttatcttgttgttgcttgaacatcataaagtgtacttacacaaacctagatgggataatctgctgcacacctaggctatatgggatagcctattgctcctaggttacaatcgtatacaacattttactttaccgaatactacatgcaattgtaacacaatggtaagtatttgtgtatctaaacataggaaaggtatagtaaaaacacagyataaaagattttttaaaatggtacacctgtaaagggtacttaccatgaataaagcttgcaggactgggagttgctttgggtgagtcagtgaatgagtggcgactgaatgtgaagccctgggtcattactgtacactactgtggactttatatacactgtacacttaagctacaccaaattttttttaaatttttttcttcagtaataaattaaccttagcttgctgtaacttaactttataaactttcttaaactcattttgactttttttttttttttttttgagacagagtctcgccc

SEQ ID NO: 151587 - DNA, 601 bp, Human
aagaccaggactaggctagaagtacagtcatgcatcgcttgacaatggggatactttttgagaaatgcatccttaggttatcttgttgttgcttgaacatcataaagtgtacttacacaaacctagatgggataatctgctgcacacctaggctatatgggatagcctattgctcctaggttacaatcgtatacaacattttactttaccgaatactacatgcaattgtaacacaatggtaagtatttgtgtatctaaacataggaaaggtatagtaaaaacacagcataaaagatttttwaaaatggtacacctgtaaagggtacttaccatgaataaagcttgcaggactgggagttgctttgggtgagtcagtgaatgagtggcgactgaatgtgaagccctgggtcattactgtacactactgtggactttatatacactgtacacttaagctacaccaaattttttttaaatttttttcttcagtaataaattaaccttagcttgctgtaacttaactttataaactttcttaaactcattttgactttttttttttttttttttgagacagagtctcgccctgtcgcccaggctg

SEQ ID NO: 151588 - DNA, 601 bp, Human
tatctaaacataggaaaggtatagtaaaaacacagcataaaagattttttaaaatggtacacctgtaaagggtacttaccatgaataaagcttgcaggactgggagttgctttgggtgagtcagtgaatgagtggcgactgaatgtgaagccctgggtcattactgtacactactgtggactttatatacactgtacacttaagctacaccaaattttttttaaatttttttcttcagtaataaattaaccttagcttgctgtaacttaactttataaactttcttaaactcattttgactttttttttttttttttttgagacagagtctcgccctgtcgcccaggctgcagtgcaatggctcgctgcaaatctcggctcactgcaaactccgcctcccaggttcaaatgattctcctgccccagcctcccaagtagctgggattacagatgccagccaccaggcccagctaattttttttgtagttttagtagagacggggtttcaccatgttggccaggctagtctcaaactcctgacctcatgatctgcccgcttcagcctcccaaagtgccgggattacaggcgtgaaccaccgtg

SEQ ID NO: 151589 - DNA, 601 bp, Human
taccatgaataaagcttgcaggactgggagttgctttgggtgagtcagtgaatgagtggcgactgaatgtgaagccctgggtcattactgtacactactgtggactttatatacactgtacacttaagctacaccaaattttttttaaatttttttcttcagtaataaattaaccttagcttgctgtaacttaactttataaactttcttaaactcattttgactttttttttttttttttttgagacagagtctcgccctgtcgcccaggctgcagtgcaatggctcgctgcaaatctcrgctcactgcaaactccgcctcccaggttcaaatgattctcctgccccagcctcccaagtagctgggattacagatgccagccaccaggcccagctaattttttttgtagttttagtagagacggggtttcaccatgttggccaggctagtctcaaactcctgacctcatgatctgcccgcttcagcctcccaaagtgccgggattacaggcgtgaaccaccgtgcctggccttgactattttgtaataatacttggcttaaaacacaaacacattgttcagctgtacagaaacattttcc

SEQ ID NO: 151590 - DNA, 601 bp, Human
gccctgtcgcccaggctgcagtgcaatggctcgctgcaaatctcggctcactgcaaactccgcctcccaggttcaaatgattctcctgccccagcctcccaagtagctgggattacagatgccagccaccaggcccagctaattttttttgtagttttagtagagacggggtttcaccatgttggccaggctagtctcaaactcctgacctcatgatctgcccgcttcagcctcccaaagtgccgggattacaggcgtgaaccaccgtgcctggccttgactattttgtaataatacttgscttaaaacacaaacacattgttcagctgtacagaaacattttccttctttatatgcttatactataaacttttttctatttttaaaagtttttttgttttactttttaaactttttcattaaaaactaagacacaaacattcacattagcctagaactacatagtgtctggatcgtccctattgctgtctttcacctccacatcttgtcccacttgaagttcctcaaggatgatagcatgcacggagctgtcatctcatgacaacaatgccttctggaatacctcctgaaggacctgcct

SEQ ID NO: 151591 - DNA, 601 bp, Human
aattttttttgtagttttagtagagacggggtttcaccatgttggccaggctagtctcaaactcctgacctcatgatctgcccgcttcagcctcccaaagtgccgggattacaggcgtgaaccaccgtgcctggccttgactattttgtaataatacttggcttaaaacacaaacacattgttcagctgtacagaaacattttccttctttatatgcttatactataaacttttttctatttttaaaagtttttttgttttactttttaaactttttcattaaaaactaagacacaaacaytcacattagcctagaactacatagtgtctggatcgtccctattgctgtctttcacctccacatcttgtcccacttgaagttcctcaaggatgatagcatgcacggagctgtcatctcatgacaacaatgccttctggaatacctcctgaaggacctgcctgaggctattttacagttaactttttttaataagtagaaggagtacactgtaaaataacaataaaaagtatagtatagtaaatacacaaaccagtaacatagttattatcaagtatatatactgcacataattgtatgcgc

SEQ ID NO: 151592 - DNA, 601 bp, Human
ataggaacttttcagccccattgtcatcttataggaccaccaccatatatgcagtctacagtgggcaaagtttgtcattcagtgcgttactgtgtgttatttctacccactttcagaggccaccacttcatcacctgacctcatctaacgacaggggaagcaatgaagtaactttaactgtgtggccagaaaggaaaagaaaaccaaattctgatggacatctgatgtttttactattcctatgaatgtattccaaggttctgagagggtagggaaagcaggaataagagtgggaaaatayatttagcaacattcttgagagttttttcttagacttgtcagtgttctcagttgtgcccatcctcaagctccaaagattctcccacaaggcatttggccaaggcacttcatttttccaggcctcagtttccccatgtgttaaagtgaggggttgaattagaatacctttcaagtctttgggccccttaaagatccaaaatcccatgattctgtaatgattctgtatgattcccctgatgttcccttccccctgagacaaataagcagtgccagtatgccaataatttatgttttattttaa

SEQ ID NO: 151593 - DNA, 601 bp, Human
ggttgaattagaatacctttcaagtctttgggccccttaaagatccaaaatcccatgattctgtaatgattctgtatgattcccctgatgttcccttccccctgagacaaataagcagtgccagtatgccaataatttatgttttattttaattttccttctcaccttcaaagcttgagtttctagatattaatatataacaatagacaaagttgttatgaatacagtagtgacttttatggcaaagtaaagttattttgtgtttggatgaacagcacattcacacacgtatataatatayacagagctccatctgtgaaaaaataatcttgtttgaagtcttgcaaaacttatgtcctcctcctactcttgccctgtattagttttgcaattagtaacaaacaaacaaccgtgacatctctgtggcttagaacaacatttactctccgctcactttacatggggactgtgagtcagcagcagattggctgtggctctgctagaattggctgggttcagctgggctctcagtggggctccacctgtcttctcattttaaaacccaaacgaagggtatagacactatctgtgacatcctaag

SEQ ID NO: 151594 - DNA, 601 bp, Human
caaatagttggggacaataacccaacagatcacacccccaatgcctctatctaagttctaaatacaacatttcccgtagagaggaagccactctgcctcctccactgcatcttcctttcctgcccctctcagcttgagctcaggctccaaaacttgagcgtgataagaatcatctaagtgcttgttaaaaatccccttcctagggcccccctttccaaagatcttgacacatatgatctgaagtaggcagtggtgcccaggcatgatgccccaggaatacctactgctattgaagagctcyccccggttcccacagccttcagcatcagacctgcctttggattgggggagcatgctgagtgagccattattaggaagagggctgccttagaggactcagaatctacgaccccaaggtcctctgacctgtccccactcctcacagccagcatggattttgtacttctggagctccttgaaggagggtcattgcacgtttgaaagtgtgatagttagcacagaccccagagatcaaatcctgagttcctcttcctccatatccaactcactagctgtgtgaccttggacaactcactagctg

SEQ ID NO: 151595 - DNA, 601 bp, Human
aaaggaataataataatacctacacctcaggcttcttgtgagggtgaagcgagttaacaaaacagtgcctggcatgcagtggatcacatataaacatttcatgtgtgatattatacatgtttttatgtatttataagtgtattctatacaagggtttgctgattttattggcacacaggtctgagaacatgggaggcttgtgagataaagttgcctcctattggaggtgttatatggggagcatgctgagtcagctgttatcaggtaggaaggctgccttagaggactcagagaatttacrtgtcaggtgatagcatgtaagtcagtggttttcaaccccagctttaatttagaatcatctagaaaggttttttttaaaatgcccatgtccttccaagtgggctcaattctgagccaattagtgagaatgtccagggacaaaacaaagaaatgaaaaattttaaggccgggcacagtggctcacgcctgtaatcccagcactttgggaggttgaggtgggcagatcacttgagaccaggagttcaagaccagcctggccaacatggtaaagcccgtctctactgaaaatacaaaaattagc

SEQ ID NO: 151596 - DNA, 601 bp, Human
gtactggaaagaaaactccaacttcttgccatgtgcagtggctcatgcctgtaatcacagacctttgggaggccaaggcgggtaaatttcctgagctcaggagtttgagaccagcctgggcaacatggcaaaaccccatcactgcagaatatacaaaaattagctgggtgttggtggctcgtgcctctagtccccactactcaggaggctgaggtgggagaatcacctgacccagggaggtccaggctgcagtgagcggtgatcatgccactgcactccagcctgggcaacagaacaagaycccgtctcaaaaaaaaaaaaaaaaaaaaagcccaactcctggaaatcaaatggtacctgatgtgaggttttctccctgttatgttagcctcaggccatctaacccaggtagaacaaggcaggtaaggaaacccagtgggccaaggaccccgaaggaagcccttaacacaatgcctaatactgaaaacaacggatgaatgtattcaaaatttgtttgcaagaaatgagactttttgcctttttaggacaaaaaaagcacttgaaatttaatttaggttaacaggagatatggcgggtagca

SEQ ID NO: 151597 - DNA, 601 bp, Human
accccatcactgcagaatatacaaaaattagctgggtgttggtggctcgtgcctctagtccccactactcaggaggctgaggtgggagaatcacctgacccagggaggtccaggctgcagtgagcggtgatcatgccactgcactccagcctgggcaacagaacaagaccccgtctcaaaaaaaaaaaaaaaaaaaaagcccaactcctggaaatcaaatggtacctgatgtgaggttttctccctgttatgttagcctcaggccatctaacccaggtagaacaaggcaggtaaggaaacycagtgggccaaggaccccgaaggaagcccttaacacaatgcctaatactgaaaacaacggatgaatgtattcaaaatttgtttgcaagaaatgagactttttgcctttttaggacaaaaaaagcacttgaaatttaatttaggttaacaggagatatggcgggtagcacagagtgattatgaaatgcacagggcttccctgccattcgagttttgatcaatctcagcaaaacccaaagtttgccaaaacctggaaacaactcaaatgtccatcaacacagtagaatgaataaatgagtta

SEQ ID NO: 151598 - DNA, 601 bp, Human
caaccgttttcactctgctactttttctcaacacctgccttctgaatggtaagtaagaggctatcacgctctctttcattgcctggggtgtttgtcaacagggtggagagtccatgcagtcttcttgcaatgccattatgaaaaatgaaaatgctgtgttatgtgctgctgttaaattatttgcaatattttgcattaaagttaatgcagaaaaattaatgcaattaatgcaaaatcttgtcactgtgctctctgccttttgtcctcatttcaggagtgtaatgaaacagctctgaagaasacaggacctgagttctaatccaggtcctgccagtttctagctgtgtgacctagagccaattacctaactctctgggtttccaaattctcaaagtgaggacagtgatgtttcctctactgcagatgaaataatgtatatgaaaactctttaaaaaaccataatgggatataagaggttgctgttacatggcgggaagcaggtacagccgactctattatctgtgctaacaggagaaatgaagtccacagctaaatgagagggtgggtgcctgtgactatacacttctgtatgtcaacccat

SEQ ID NO: 151599 - DNA, 601 bp, Human
gggtggagagtccatgcagtcttcttgcaatgccattatgaaaaatgaaaatgctgtgttatgtgctgctgttaaattatttgcaatattttgcattaaagttaatgcagaaaaattaatgcaattaatgcaaaatcttgtcactgtgctctctgccttttgtcctcatttcaggagtgtaatgaaacagctctgaagaagacaggacctgagttctaatccaggtcctgccagtttctagctgtgtgacctagagccaattacctaactctctgggtttccaaattctcaaagtgaggayagtgatgtttcctctactgcagatgaaataatgtatatgaaaactctttaaaaaaccataatgggatataagaggttgctgttacatggcgggaagcaggtacagccgactctattatctgtgctaacaggagaaatgaagtccacagctaaatgagagggtgggtgcctgtgactatacacttctgtatgtcaacccatgtgcatttctgggtgtgcagacttctatatgtacctgtgtatatattaacttttctatatggacctgatttcaaatgtctctctgtctgaacctgtatgt

SEQ ID NO: 151600 - DNA, 601 bp, Human
ttccaaattctcaaagtgaggacagtgatgtttcctctactgcagatgaaataatgtatatgaaaactctttaaaaaaccataatgggatataagaggttgctgttacatggcgggaagcaggtacagccgactctattatctgtgctaacaggagaaatgaagtccacagctaaatgagagggtgggtgcctgtgactatacacttctgtatgtcaacccatgtgcatttctgggtgtgcagacttctatatgtacctgtgtatatattaacttttctatatggacctgatttcaaatgyctctctgtctgaacctgtatgtatatacttttatgtatgtctgtgtgtgttctgtgtatatccgtatgtgcacacttctctgcaggtacctgtgtgcatacaagtatgtacttccatgagtatgcacctgtgtatatttttgtgtgtgtgtgtggtgtgtgtacttttgatgcgggctctgtgtgggcatctacatacctgtatatgtggttcctgtgtggttttctccgtgtttctgtgcattgagaaagtccattaatgttaacttgttcctctaatgcagatgaaggaaacatttgt

SEQ ID NO: 151601 - DNA, 601 bp, Human
gcctgtgactatacacttctgtatgtcaacccatgtgcatttctgggtgtgcagacttctatatgtacctgtgtatatattaacttttctatatggacctgatttcaaatgtctctctgtctgaacctgtatgtatatacttttatgtatgtctgtgtgtgttctgtgtatatccgtatgtgcacacttctctgcaggtacctgtgtgcatacaagtatgtacttccatgagtatgcacctgtgtatatttttgtgtgtgtgtgtggtgtgtgtacttttgatgcgggctctgtgtgggcrtctacatacctgtatatgtggttcctgtgtggttttctccgtgtttctgtgcattgagaaagtccattaatgttaacttgttcctctaatgcagatgaaggaaacatttgtctaattgtaattttacaaatctaccctcctctcttgagcttcctgaaggtactattaataaacagtaaaataagaaagagaagctttcagagagagaaaaaggggaaagcagaggtcagaatgacccacaagagaaactaaatactcaagaaatcaatgatcaccctaattggcttccgagtgtgctca

SEQ ID NO: 151602 - DNA, 601 bp, Human
cctgcatgaggggtagaggagaaaacagagagaacccccggaggtgctgacccatatctgaaagcgctcctctctgctcctgatatcctaaactcaatgctagggcatccagctagacaaaaaagaggatcagctgaagtcatgtaggcgagcatggtggcttcccagccccacagtatcagggcaaattcccagggctctgctgtccctctttgaacctgacatccaagcaagagaaatgggagcccgcttgccaagagctttggggatttggcaactaaaaaattttacactcttggtrttatattttcacaccacctcactgagaccttctagcatccagtctggaactgggtacagctcttagataacagtggttgctcagaaccaggagaggagctggctactctcctacctcttaccacacctcctaccccaaaaagatccatcaaattatagttttatagaccctatgggattacaaaagggccacacactcttgaagccctacgtatccaaaggaagccctttgcaacctcaccacacacacacacacacacacacacacacacacacaaaggaaagagaggaaaatctaaga

SEQ ID NO: 151603 - DNA, 601 bp, Human
tcctgatatcctaaactcaatgctagggcatccagctagacaaaaaagaggatcagctgaagtcatgtaggcgagcatggtggcttcccagccccacagtatcagggcaaattcccagggctctgctgtccctctttgaacctgacatccaagcaagagaaatgggagcccgcttgccaagagctttggggatttggcaactaaaaaattttacactcttggtgttatattttcacaccacctcactgagaccttctagcatccagtctggaactgggtacagctcttagataacagtggytgctcagaaccaggagaggagctggctactctcctacctcttaccacacctcctaccccaaaaagatccatcaaattatagttttatagaccctatgggattacaaaagggccacacactcttgaagccctacgtatccaaaggaagccctttgcaacctcaccacacacacacacacacacacacacacacacacacaaaggaaagagaggaaaatctaagagaaaaaaaaggactaaaaaccaagattcagaaatggggatggggtggatgaggagacagactgtgagtctgggtcac

SEQ ID NO: 151604 - DNA, 601 bp, Human
gcaccactgcactccagcctgggcgatagagtgagactccatcccaaaaaaaatcaagaaaaagtgaagggaaaggggaaggaaaggagaagatggggaaagaggaaggaaaggatgcccagatacagggagctttagcgatgtagtgaacggacagaagatcaggaacaagttgagttcattgtgtggggatggcagaaagatggagattggtgagctgagtggagaagtgccatagagcggtgttttgccagagtgtctgcggattgctcatacctgggaaggattctttgtatggttyccttaggctgagggagggtatcagctttacagaccttgtgggattacaaaagggccaccacacactcttcaaccaatatgtgtctatcttgcattcaaggctcattctttgttgaaattttgcagttggtcactaggctattgttatctccatctcaaagtacacagacacacacacacacacacacacacacaccagcaaaatgctctctaagagcaatgccaacatcagggcagcccacagaggagtgttgctggatgctgatgcttggcattcctgagcatccaccctaggtctcct

SEQ ID NO: 151605 - DNA, 601 bp, Human
tgaggccccatagaagtgtttcttaattgctagttaatcttaaatgctcatctataattcttatgccatttgtattttttttaactaaacatgtcacttttgcaaaataagtaggatcgtgtgaagtggtaccatacaatccttgacaaatgtggtatattaggttttcaaacttgtttcatgttcaagaaaataaagaaccttgtagggaaaagaaggtgaggttttttccttagcacattgctcatccaagagccaccatctcctagaagacatattgggacctaaggttgaaatgagrgctaaaccagatcatctctgtgcaagcattttgttacgctgacagtgagaccctcctgaaaatcatgggagagctgcattcttcttcagaaaggaaaatatttagttgctggtagagacagctggcccactttccaatgactgcactttgttgtacacaaaactgtcatcccggctgaaatccaaagggacatcatgtaaacagatttcaggaactcagatgcaaccagaattgaacaagcctccacccctgtgcagtgtatcttgagctgaggttcctgagtctaaatgtgagcagcct

SEQ ID NO: 151606 - DNA, 601 bp, Human
cttaaatgctcatctataattcttatgccatttgtattttttttaactaaacatgtcacttttgcaaaataagtaggatcgtgtgaagtggtaccatacaatccttgacaaatgtggtatattaggttttcaaacttgtttcatgttcaagaaaataaagaaccttgtagggaaaagaaggtgaggttttttccttagcacattgctcatccaagagccaccatctcctagaagacatattgggacctaaggttgaaatgagggctaaaccagatcatctctgtgcaagcattttgttacrctgacagtgagaccctcctgaaaatcatgggagagctgcattcttcttcagaaaggaaaatatttagttgctggtagagacagctggcccactttccaatgactgcactttgttgtacacaaaactgtcatcccggctgaaatccaaagggacatcatgtaaacagatttcaggaactcagatgcaaccagaattgaacaagcctccacccctgtgcagtgtatcttgagctgaggttcctgagtctaaatgtgagcagcctactgagccacgtgggcttgaaatacctcctctcaacgt

SEQ ID NO: 151607 - DNA, 601 bp, Human
tttgttacgctgacagtgagaccctcctgaaaatcatgggagagctgcattcttcttcagaaaggaaaatatttagttgctggtagagacagctggcccactttccaatgactgcactttgttgtacacaaaactgtcatcccggctgaaatccaaagggacatcatgtaaacagatttcaggaactcagatgcaaccagaattgaacaagcctccacccctgtgcagtgtatcttgagctgaggttcctgagtctaaatgtgagcagcctactgagccacgtgggcttgaaatacctcctctcaacgtcacttcactttattgctgacttggtgcagtctgaaatggaccaacatcagtttttgtcctcttgaacccttttttaaaaaacgaaaagtaattcaacacgtatgtgaaatagctgctgcattgtgcatgacccctctgtgtgtggacaggtgaaagttccaatttcctgaggcaacccaatgggcatgacctgggtatggtggtgcctgggccattgaaagctcgagtgtttatcagcagggaatataggtccccgagcccacaagaacacttatagaaaggaagggttgat

SEQ ID NO: 151608 - DNA, 601 bp, Human
agctggcccactttccaatgactgcactttgttgtacacaaaactgtcatcccggctgaaatccaaagggacatcatgtaaacagatttcaggaactcagatgcaaccagaattgaacaagcctccacccctgtgcagtgtatcttgagctgaggttcctgagtctaaatgtgagcagcctactgagccacgtgggcttgaaatacctcctctcaacgtcacttcactttattgctgacttggtgcagtctgaaatggaccaacatcagtttttgtcctcttgaacccttttttaaaaaaygaaaagtaattcaacacgtatgtgaaatagctgctgcattgtgcatgacccctctgtgtgtggacaggtgaaagttccaatttcctgaggcaacccaatgggcatgacctgggtatggtggtgcctgggccattgaaagctcgagtgtttatcagcagggaatataggtccccgagcccacaagaacacttatagaaaggaagggttgatggaagaagaatacttgaggccctaaaataacctttccaacatgctcttccctctctcactcccagctgaaatgggcagaacatggaagcc

SEQ ID NO: 151609 - DNA, 601 bp, Human
ggaggtgagtgatccatatgctttttgaaggaactatggcctttggcaaggataaagccctcacaactgaaaacaggtcattcctcctaattactgggtcactgtgttggcctccaatgcagttgtgacccacccagatgtgaaaagcccttttcccctctattgggattgatgggggctcatcttcacagctctcctcgggctagtttcttgtactgctcagacacttgaccaggtttccaacctgcctcccttagtacattttagatctagacccttgtaagagtacttaaatggcacmaggtgggagggggcagtctcagtatatcccgtccatagtcaatggctgtgtttttatttactttaaaatacctcaaccaggctgggtgcagtggatcacacctgttaatcccagcactttgggaggccgagacaggtggatcacctgaggtcaggagttcaagacaagcctggccaacaggaagaaaccccatctctactaaaagtacaaaaaaattagccaggtgtggtggcgggcacctgtaatcccagctcctcgggaggctgaagcaggagaatctcttgaacccaggaggcggag

SEQ ID NO: 151610 - DNA, 601 bp, Human
aggtgtggtggcgggcacctgtaatcccagctcctcgggaggctgaagcaggagaatctcttgaacccaggaggcggaggtttcagtgagctgaaatcgcgccattgcactccagcctgggcaacaagaatgaaactccatttggaaaaaaaaaaaaggctgggctcaggggctcacacttgtaatcccagcactttgggaggcagaagcaggtggatcacttgaggtcaggagtttgagaccagcctgaccaacatggcaaaacccagtctctactgaagatacaaaaaacttagccagscatggtggtgagtgcctgtgatcccagctactctgaaggctgaggcaggagaattgcttaaacctgggaggcagagatttcagtgggctgaggtcatgccattgtgctccagcctaggtgacaagagcgactccgtctcaaaaaataaataaataaaaataaaaataaaataaaatactttgacctaaagaaataatattaaattgcaggtggtacaatattccatctttacatactttagtatatgcctcttttaaaaaggcacatttccaaacatagccaaaataataggatcacaca

SEQ ID NO: 151611 - DNA, 601 bp, Human
cgggctttcattggcttggcatgctggaaagggcactgaactgcaaatcaggcaggcatctagtccactcctgactcttgcttaacaaaagcacagggtctagaggcagaaagcctgagttcaaatcccagcctgcaacactatagttatgtggccattggtaaatctttctttgattcccagttttcttatcttttataacaaagcaatgtaggcaaagagtttaacaccattgatggcttttagtaagaacttaatgttagcttttattattattactgcaaacgaccatgtgaccttsgatttcctctttaaggatcaattaaaaagaataatgaaaggatttttaaatttttagagtactataaaatatacgcaacatattaacatattaataatatttaaaagagaatagccctgtcattgatgatactttggattgctgttcaaatcaaaaaaatatatgaatggaggaaaacactcttgggtttaagagtttcattcattaggttggtttgtttttaatgatgctgtacgtgatcaaagctttctggctgtttgttttttagacttcaccatgaatgatacaaccgtgtggatc

SEQ ID NO: 151612 - DNA, 601 bp, Human
tattgtctgggcagtggctttgaagggctataggtacttcactgtctctcaacttttcctcccaatcatgatagtcaaggataatgacaaaaaaaaaaatacaaagatgatggaaacctgtagataatcctcattttagccattagatgtagtgtgtttgcccataaaaaaaatcttttatcagtgctataaaaagtagaaaaattgactcgtttcaggctgatgttctttctatgaaacagagattcctagttgtgaaacagtaaaaatctggcaagagtagctaaaatcaagagaagcmaatagtccagataatccactaacttcaaaatcagcctccttaattagctaaagttaattttaatataggcctctgtaattttattttcatcattgattgtttcatggagctgccaaaccaagtcctatctctatcacagtccctatagtggctattatactaacctttcaaaaattacaaagtcagaaatgagtcatttagccaatctcatgaattattttatagcatggtgacctgcatctttccgccagttcctgggccaaaaataaaaggatttgatgctcatctgttggaggtaag

SEQ ID NO: 151613 - DNA, 601 bp, Human
aaaattgactcgtttcaggctgatgttctttctatgaaacagagattcctagttgtgaaacagtaaaaatctggcaagagtagctaaaatcaagagaagcaaatagtccagataatccactaacttcaaaatcagcctccttaattagctaaagttaattttaatataggcctctgtaattttattttcatcattgattgtttcatggagctgccaaaccaagtcctatctctatcacagtccctatagtggctattatactaacctttcaaaaattacaaagtcagaaatgagtcatttagccaatctcatgaattattttatagcatggtgacctgcatctttccgccagttcctgggccaaaaataaaaggatttgatgctcatctgttggaggtaagtacaggaggcaaaaaaatggagtgtgactcactgctctgtagtaattaactctacacactcacacacagtccccgtcagttcagcctggtagtttcagccagcctttttggactgtctctcctggtcagcatgtgtgttaacagaaagttgtgtgaaggatgagggtacttactttcacacactaaatgtcagagggcaa

SEQ ID NO: 151614 - DNA, 601 bp, Human
tcagcaaactaaactagttactgtccagctcacaatttaacctgctagccacagagacttaacgataaaatagctacttttgtctcaaaaatatgtgttagtattcttaatgatattacctctaatcctcaaaagaaccctcccagatgggtagtattaatattattttctaccttttaaaaatggagaagctgaagttcagagagcagcttgtccaaagtcacataccctataataagtgataaagccaagacctaggtcagtacctgacccaagtcagaggataagaaaaaagaggccrggcgcggtggctcacgcctgtaatcccagcactttggaaggcagaggcgggcagatcacgaggtcaggagatcaagaccatcctggctaacatggtgaaaccctgtctctactaaaaatgtaaaaaattagccaggcgtggtggtgggcgcctgttgtcccagctactcgggaggctgaggcaggagaatggcgtgaacccgggaggcggagcttgcagtgatccgagatcatgccactgcactccagcctgggcaacagagcgagactccgtctcaaaaaaaaaaaaaaaaaaaaagag

SEQ ID NO: 151615 - DNA, 601 bp, Human; identical to SEQ ID NO: 28165

SEQ ID NO: 151616 - DNA, 601 bp, Human; identical to SEQ ID NO: 28166

SEQ ID NO: 151617 - DNA, 601 bp, Human; identical to SEQ ID NO: 28167

SEQ ID NO: 151618 - DNA, 601 bp, Human; identical to SEQ ID NO: 28168

SEQ ID NO: 151619 - DNA, 601 bp, Human; identical to SEQ ID NO: 28169

SEQ ID NO: 151620 - DNA, 601 bp, Human; identical to SEQ ID NO: 28170

SEQ ID NO: 151621 - DNA, 601 bp, Human; identical to SEQ ID NO: 28171

SEQ ID NO: 151622 - DNA, 601 bp, Human; identical to SEQ ID NO: 28172

SEQ ID NO: 151623 - DNA, 601 bp, Human; identical to SEQ ID NO: 28173

SEQ ID NO: 151624 - DNA, 601 bp, Human; identical to SEQ ID NO: 28174

SEQ ID NO: 151625 - DNA, 601 bp, Human; identical to SEQ ID NO: 28175

SEQ ID NO: 151626 - DNA, 601 bp, Human; identical to SEQ ID NO: 28176

SEQ ID NO: 151627 - DNA, 601 bp, Human; identical to SEQ ID NO: 28177

SEQ ID NO: 151628 - DNA, 601 bp, Human; identical to SEQ ID NO: 28178

SEQ ID NO: 151629 - DNA, 601 bp, Human; identical to SEQ ID NO: 28179

SEQ ID NO: 151630 - DNA, 601 bp, Human; identical to SEQ ID NO: 28180

SEQ ID NO: 151631 - DNA, 601 bp, Human; identical to SEQ ID NO: 28181

SEQ ID NO: 151632 - DNA, 601 bp, Human; identical to SEQ ID NO: 28182

SEQ ID NO: 151633 - DNA, 601 bp, Human
attacgttaatatactatgtatttgagttgtaaaagtttatactttttactagtttaatggattactctgataacacacataggatagttatgccacagaacttgtacaatttaaaaattctcaagatttccatttatgaactgtataatatatactgataggctgggagaggtggctcatgcctgtaatcccagcactttgggagccaaggtgggtggatcacctgaggtcaggagttggagaccagtctggccatatatatatatggaaagagataatagaacatttatatatatatakagagagagataatagaaaatttctgcatgaaatgaatgtgtcataatatagctcccaattacacagtgccatccaggaatgtgagtgagtaattgggaagcaatttgcggcttagccacatggtggtctgtccacaaatcctctggagagggaggcagcattcagtgcacatctgtgcaaacactggttaatctgggtaatgccttcgaattcaagaatttaaaacaagggctttttctttgctttgtttgaagagaagttttcctactgccattttcagatatcagaagtgaatcttaa

SEQ ID NO: 151634 - DNA, 601 bp, Human
cttataaaaataattgaagagcttttgctaaagccaatgtgattaggatttgtgtaatcatggccatatatttgtgtataacgtaaaaagaaatatctgcaaacatacctatgtgtttatcaacttgttgctttgccaataaaactcttcaaaaataaaattaaaaagagaagcaacattccacagcagattgtaaaactagccacaaactcctccccttcttgcatccgcacatttgtaaaatgaaattgcatatattcccctcaaaagtgttgttagctactgtgaggcaagccgagayttgaaaagtgccttttaggactcgatctttcttactactcttgacacctttgccactgccactacgtaatagtagagatcagttaaccatcttctatccagcgccagctgactgcagacgcagatatgagtgcaacaaagacgtaaaagatgttccagagatgaatatccacttagctgtctcacacacttctgagataatatgattattttttaataaatccattaaactctgtgattatttgttaggcagtaaaatacattcaaatacaaaagcagttattccctatgaataaggaca

SEQ ID NO: 151635 - DNA, 601 bp, Human
agcagcagcattaaattctcataagaacacaaactattgtgaactgcatatgcaagggatgtaggttgcgtgctccttatgagaatctaatgccaacccaccttctgtggcaaaattgtctttcatgaaacccagtccttggtaccaaagaggatggggactgctgctgtagatgctctaaaacatgatttaagctttctttgattaaatgcttattccttctctcattggtcttgattttagagaatgtccctttctttatagtttttattaactaaactcttcactcttctttatataygcctagttctagtttacccttttttaaatgttttatggcctactacagtaatcaaatgtttgaatgaaaattaaaggagatataatcacattatttaaaaaatatatttgataggacaacaatctcttctttttctcttcatgtgtatttttcttttcctattatacaaatcaaataactccaaatctatattactatgaataagtgagcataagtccattaagcttcctcttcattataaatctcaatttctctgatgataacatttcaacaccttgtcataactgcttaaaagttaat

SEQ ID NO: 151636 - DNA, 601 bp, Human
taggcgacagagaccctatcttaaaaaaaaaaaaaaaaaaacttccaaagaaatattattattattatttcttcgagtttgaaagtaaccctccccatatgtgtaacaggcacagcttaatttgaacacaagcactgcagtgtgcaaaaagcatggaacaaaattgtaggtttaacacctgttcttccactgagcaggaatcaatgaccttggtctaatcattacatttatcacagaatccccttcccgtttaacactgacattgatattagctcccttgtttattttcaggttattttaygtgtgtgtgtgtgtgtgtaaatgaatggtgcactctgaaaatacaggcaaaattaaagggaaaagggtgaggaaaaaagtctttgtctttggcattacagtgaccgataaactgcatacaaagactatctgcccacacacttcagtgtttatcacctgatgtcctaataaccagcagggctcattgagaagtgagctttactacggtagttgtgggacaggaaagcattgtggaaagtaatacagctggacctccatatttaagaagtaatgaaatctaaccttggaagccagaggctgt

SEQ ID NO: 151637 - DNA, 601 bp, Human
agcccagaagttcaagatcagcctgggcgacatggcaaaaccctgtctctacacaaagtacaaaaactaaccaggcttggtggagtgtacctgtagtcccagctacttgggaggctgaggtgggaagatcacttgagccccggacattgaggctgcagtgagccatgattgcatcattgcactccagcataggcgacagagaccctatcttaaaaaaaaaaaaaaaaaaacttccaaagaaatattattattattatttcttcgagtttgaaagtaaccctccccatatgtgtaacaggcrcagcttaatttgaacacaagcactgcagtgtgcaaaaagcatggaacaaaattgtaggtttaacacctgttcttccactgagcaggaatcaatgaccttggtctaatcattacatttatcacagaatccccttcccgtttaacactgacattgatattagctcccttgtttattttcaggttattttatgtgtgtgtgtgtgtgtgtaaatgaatggtgcactctgaaaatacaggcaaaattaaagggaaaagggtgaggaaaaaagtctttgtctttggcattacagtgaccgataaa

SEQ ID NO: 151638 - DNA, 601 bp, Human
ctgtaatctcaacatttcgggaggctgaggtgggcggattgcttgagcccagaagttcaagatcagcctgggcgacatggcaaaaccctgtctctacacaaagtacaaaaactaaccaggcttggtggagtgtacctgtagtcccagctacttgggaggctgaggtgggaagatcacttgagccccggacattgaggctgcagtgagccatgattgcatcattgcactccagcataggcgacagagaccctatcttaaaaaaaaaaaaaaaaaaacttccaaagaaatattattattattttttcttcgagtttgaaagtaaccctccccatatgtgtaacaggcacagcttaatttgaacacaagcactgcagtgtgcaaaaagcatggaacaaaattgtaggtttaacacctgttcttccactgagcaggaatcaatgaccttggtctaatcattacatttatcacagaatccccttcccgtttaacactgacattgatattagctcccttgtttattttcaggttattttatgtgtgtgtgtgtgtgtgtaaatgaatggtgcactctgaaaatacaggcaaaattaaagggaaaagg

SEQ ID NO: 151639 - DNA, 601 bp, Human
agattagtcagaggaggtcatgcttggggttgagtcaagggagaatataactggcatgcaaacaatgtcaaaggtatctttgcaacgggaaagaattgcaaaattttgcaacaaagaaaagccttaaagacatactttcaatctttcactttctctctagcaaagaatctagtttgcatatatttcacatgtagttgattaaagtccacagacaggaaaaccaaacatttgttctaatggaaacaatttccttagtgtccaaaactagtgtccatccagcagaatataaatattttgtagyttctcatgaaattttccatgtcaactgacatttctagttgtagatgtttctcctggaaaccagctttaaaagtttacagctgtttcttccaataactaatttctggttagaaattctagattaaaacttagcatcaatttcagtcaatgagccacattcagccctttccaaatcaactacctattagaccaagtcctgtcaaaaataaaataattaataaatcaaaaaataaatttatcttggaggcagaataaaactgtaatagaaaaatgtacaatttaaacaatgtaatcctcaaaa

SEQ ID NO: 151640 - DNA, 601 bp, Human
gctacaatcctaatcagttttgttgttccttttaaaaatattagaatgcataagaaattaattatctgaggcagctgagaccagaagtacacacagcctcaggctatgcattcagtgggcagctgagatttcagtgctttatttttccagggagcttaccaccatgctttgatacaataaacctattccttgatttttaagttagtcgctcttttgcaggacattccaccagtgtacatgttcccatgttcctgaagtgtggtggtacttgggaggacaggaaggcatcatacagactctycttgacttccttcctttcttcctcactctctttctctttttccccacaagtatcaactgtgaagtacaactacccaggcccagtgggccgtatattaccctgatacaacacgatactataacacttaagtttattcattagacagattccagtctctttgtgtggtttcaacaattcttacatattctgtttttgtctgtttcatttttgagtgttttaagtaaacttttataacttggaaattatacccattaaaaacaattttacacccagtgtggcttaccatcaaataggaaaatc

SEQ ID NO: 151641 - DNA, 601 bp, Human
tgtccaaaatatatcataacatgttcaaagaggaaaaaaaatggtagcttccaggaattcccttttaggaaaataccacaggggcttgcagaagtgctgacttagatgagttattgttaacaaaatctagagattcaaaagaaaaaaaatccttacacttatggctggtcactttatgtgtatgaactcatttaattcacaaagcaaccaatgagatgaaaatatttctcatttgataaaagaaagtacagaggttcagagtgactgaacaatctgtgtgagttcaatttgaatttgagcycatgtcagtgtgactttaaaactgaacttcttctgctgtgccttattgtatcacaaagtgctgattccgtttctacttaaagataaaaactagacggcagagtttaccgaaattcactaggtactatttaaagtgttgggtcatgggagtagttatgctcctaataatgttagctggacttaagcataaaactgggggagaaaagaaagaaaaattgatacagaggctgaggagagaaatcctttcaagaaatggagttctttggaagcttctccatttcccttacaatccagggacaga

SEQ ID NO: 151642 - DNA, 601 bp, Human
ggcgcagagaacataaatattttaaaagctgtttgccgctttatcatgtccaaaatatatcataacatgttcaaagaggaaaaaaaatggtagcttccaggaattcccttttaggaaaataccacaggggcttgcagaagtgctgacttagatgagttattgttaacaaaatctagagattcaaaagaaaaaaaatccttacacttatggctggtcactttatgtgtatgaactcatttaattcacaaagcaaccaatgagatgaaaatatttctcatttgataaaagaaagtacagaggytcagagtgactgaacaatctgtgtgagttcaatttgaatttgagctcatgtcagtgtgactttaaaactgaacttcttctgctgtgccttattgtatcacaaagtgctgattccgtttctacttaaagataaaaactagacggcagagtttaccgaaattcactaggtactatttaaagtgttgggtcatgggagtagttatgctcctaataatgttagctggacttaagcataaaactgggggagaaaagaaagaaaaattgatacagaggctgaggagagaaatcctttcaagaaatg

SEQ ID NO: 151643 - DNA, 601 bp, Human
ccctccttccatataagcaagcaccattctgaccattaatttcaggagccctttcctgctcttgtctctcaggcctaaatccttttctcagttactaaaaagaatccatctaatgccgaggtcttttctcttcagaccaaccactaactgcctacctctcaggacttgactctatttttttttctgatgttgctggtatgttagtctggtcttttattaattaatcaagtgagctttttcttcccattatattcttataattgtgtctggtctttagtctctctggcatttctctgacctstctcactgtcctggaaccatgtggaaaataccatgccatctctaacatttgcattcttcattgcacatggttcaggccacagcctgtgtttgataaatactaattagctggataaggaactaagtcatgatgccaagttgcaggattattaaattataattgtaaaaattacatttttaaaataaaatgagtgaggcagacacagtacccttaagcctagtgaatatgatgtttgatgctagttatacatgtgatagtgctgtatgctctcatgaaaggtatttctgaaagtttatttta

SEQ ID NO: 151644 - DNA, 601 bp, Human
cacttacaagtggtagctaaacattgagcacacatggatgtaaacctgggaacaataaacactgcagactactagagagtggaggagaggaagagggtgtaggttgaaaatctacctattggatactatcctccctacctggatgcaatatacccatgtaaccaacctgcacatgtgccccctgtaactaaagtaaaagttaaattaagaataataaagaaatccagtgtgtattttatacttacattacatttcaatttggaatagtggagtgttcaatagcccatgtagctagtggctrccctattggacaacacaggcctggagtttttctggaagaggcctcaaaaaaaaagttaacaggggttgcttctcaggaagagaactaagagactaggggtaaaaagagatagcaaccttacttttaaccacaaacccttctgtattgcttgaattatgtgtcaagtatatgggttgtctgtatagaaaaaatacaccacaatagacagacatacagacagagtctttgggcaacactatcaacagcaaagcttcaaagtcagggcaaacagaaagcagaaactaggcagaggaaactcac

SEQ ID NO: 151645 - DNA, 601 bp, Human
ataaattaaagatatatatctgatatatatgattactgaaaaatataagtgaacaggataataactattcctttaaaaaattaagtgttgaaaaattcagggcaagagatactaaaatgaactcaaaaatctcaatccaattttcataattattcgtattccttatgaaatcaattatttgcaaatctgataatattttgccaaatgttttaatttactctttttattatataggttgataaaattaaaaggaaaacatttgtttcccattgtctgctttttatacaaaaggagtgtctagtttactaaatgacacattttctcaatgttaatataatccatatgtgaaattatgtagctaaatattccttaagagcacatttgttctattttaaaaatctatgctaaaatcacaacaaaaacatctgctcatatctagaaatgaaagtatttttaaaacataatttaaattctatgatgtgcacatcactctggaggaagatgagtattttgaagaaaaaatgttcagttgcatttcacaaaaaggccttcttagtgaggagagaagttatgaaaatagatttagaataagaaaagtaca

SEQ ID NO: 151646 - DNA, 601 bp, Human
ctgaattaacgtacatttttttctggcaaacaaaagatttcatttcactgataactgaaacaaaatggtgaaataacaggaaagagacataagttaaaagaggaccacaaaaataaatctcagcttggaaaataccattctgcatcaattctattggtgaaaggagatgagagtgaaaacagaatattaatgctgtaataaacaaacatgaataacagctataaattaaagatatatatctgatatatatgattactgaaaaatataagtgaacaggataataactattcctttaaaaaawtaagtgttgaaaaattcagggcaagagatactaaaatgaactcaaaaatctcaatccaattttcataattattcgtattccttatgaaatcaattatttgcaaatctgataatattttgccaaatgttttaatttactctttttattatataggttgataaaattaaaaggaaaacatttgtttcccattgtctgctttttatacaaaaggagtgtctactttactaaatgacacattttctcaatgttaatataatccatatgtgaaattatgtagctaaatattccttaagagcacat

SEQ ID NO: 151647 - DNA, 601 bp, Human
gaaagcaatcactgacaactttgttaaaaggtgttatttgattttacctttcaaaaatacatatcatatgttcaggtgaatgttgttaatttcaaagttgtaatcttatctgtatttcataccccctcacattcttcatatttgcaaagctttgtttttaaaggcatatatattagaccaaagtcagataaatatagtagcacagttcagagactataatagtttatattgtaatcccataagcagattcagaaggaagtttcaaaaaaatagtttccaaaaattatttgtgcaatatcarcatacttagattaaatatatcacttctaaaagtgattcattttggggtacagtatctgctttaaaaatgtgaatctcattagtttgtaattagatcttaaaatataactcagcttgaagaaatttctctatagttcattgatgtgtttttatactcaataaaacaagatgtttaaatatctgaatttaagattcaagtaggataaataaaaagaagcttctggtagctaaagaagcaggtgttaactgaatctaccctgataactcagatgttatgaaatatggtcttttaggctaatac

SEQ ID NO: 151648 - DNA, 601 bp, Human
tattaagccttataaaagaaggagattctgtcatttgtgacaatgtggatgaacccggaggaattatgcaaagtttaaaaagccagacacagaaagaagaatactgaatgatctcacttacatatgaaatctaaaacaataaaatttgaatacatagaaatagagcagaatagtggttactggggtgggtgtaaggaatgggggaaatataagtcaaatggtacaaagttcttatgtaggatgaataagcctggagatctaatgtacagtatgagtactatggcaataatattgtattacrtaatagaaatttgctgagagagtagattgtcagtgctcttaccacacacatgaagataacaatatgaggtgatggatatgtaaatctatctgactatagtaatcattttactatatatatgtatttaacacatcacattgtataccttaaatttatacaaaaaagaacaaaatatttttaccatttacatatatctgaaaaatccctttttaatattttcattattatatgagttaatctaatattaatagctacttatatagaaatccaaactcagttccacttgtagtattaaaaaaa

SEQ ID NO: 151649 - DNA, 601 bp, Human
cacagctttacatttaagtaaattacaataattttaactttataaatatatgaagaacagtatggcttttgtattttgatgttttaatatgattgtcaaaaggattatctttttgatatcctaacatgtgtgagatgccatctcattatggttttcattggaatttcactcagtgatgttgagcaccttatcatacatctattcgccattctcatgtcttctagagaaatgtctattcaggatctttgccctctctttaattggtttatttaactatttgcgattgactcatatgagttayctatatatttcggatattaatcccttacaagatttatggttggcaaatatcttctcacaatctgcaggccatcatttcattttcttgattgtttcctttgttgtgcagaagctttttagactgatgtggccccacttgtttatttttgcttttgatacctgagcttttgctgtgacatccaaaaaatcatagtcaagggggtattcctctacatttttttcttctaggagttttatggtttcagagcttatgtttaagttttcaatctattttgagttcatttttatatgttatataaga

SEQ ID NO: 151650 - DNA, 601 bp, Human
aataaatattttataagctatatgtccagtgacctctatcatcactaccagttggaatcaactgataagaggtcacatacacagctttacatttaagtaaattacaataattttaactttataaatatatgaagaacagtatggcttttgtattttgatgttttaatatgattgtcaaaaggattatctttttgatatcctaacatgtgtgagatgccatctcattatggttttcattggaatttcactcagtgatgttgagcaccttatcatacatctattcgccattctcatgtcttctagagaaatgtctattcaggatctttgccctctctttaattggtttatttaactatttgcgattgactcatatgagttacctatatatttcggatattaatcccttacaagatttatggttggcaaatatcttctcacaatctgcaggccatcatttcattttcttgattgtttcctttgttgtgcagaagctttttagactgatgtggccccacttgtttatttttgcttttgatacctgagcttttgctgtgacatccaaaaaatcatagtcaagggggtattcctctacatttttttc

SEQ ID NO: 151651 - DNA, 601 bp, Human
agaaagaaatctaaaagatatctgtagcatgggtaagaaaataaaaaattcaccataaacagaaatgatgtttttgtgtaactaaaattaaatatttcaaaagctagagaaaatatctaattactctgtttcctgtatgtatacacaaaatacatatttgttttatgaatgacttttaacttgctaatataaaaccacagcttcaactctttactactgctagcccatattctattattaacctttgtatatgaaaatagtatttttcttaggtgtacttcttcaatgtcaaagctagtartgtaaatgattaaaatattaaaagatttaaagggaactggtgaatgtatggatgcattggtaagccaaatcaccattttcttcttctctatggacatcacagagttcataataaatattttataagctatatgtccagtgacctctatcatcactaccagttggaatcaactgataagaggtcacatacacagctttacatttaagtaaattacaataattttaactttataaatatatgaagaacagtatggcttttgtattttgatgttttaatatgattgtcaaaaggattatcttt

SEQ ID NO: 151652 - DNA, 601 bp, Human
ttatacaactacattcatagatatgtatgtcaagatgtaaagatattatttttcactcctgtgatagtttaattcttaaacctgtctaaagagaaagatgagtatacaattttccaaagtgcctactggcaccatgatcctgttctacagcaaagtttattttagtaaaaatatgaaaaaacacatccatataacaggaatttaaattacaattatttgtctcacagttaaacatcactatcacacacctatcaaaaaggaagtttaatttttaaaaaaaggaaacgtaagcactatttgstctttccactaatgtcttggtaaactgaccaaagccacatctttagaagcagtgattgttttttccctgttcctctgagaatctacaaataattacttctatctcatttttaaatattgtagcatttttttggtttttatatattaggttttaatatttgagcctgattaaagtatatttatgaacaagaatatactcgataaaacaattagtaaagttgctccaggcactagagggaaaatatgtatttatgtataaaacaagagataaatttgtagcaaatgtaaggtaaacaaaaat

SEQ ID NO: 151653 - DNA, 601 bp, Human
agatctaaagttggatagcacagcagggtaactgcagtcaacaataatttattgtacatttaaaaataactaaaagagtataattggatcatttctaacacatagggtaaatgcttgagaagatggataccccactttctgtgatgggattattacacattgtatgcctgaatgaaaatatctcatatgtgccatgaatatatacacctactatgaacccactaaaattaaaacttaaaagaaataaaagatcagttcagtacagacagtgcacatccagttttgacaaacttgaaaataygtttatacagaacaggataaaataaaggctatggggtagttgggattttaaaagttacaacgcatgacaatgcacatatgaatataaattttagtattattgagatgtacaccaaatttagttctcaataatcacattttcagggtctcatagaagtttttataaaaatggatgaaaaacatagcaaagtatagaaaaataaccatgaaggtagttaaagtgaaaaagagatgttatgaccatgatttccaattgatgattggtgaccttcattgattggtgacctagtatgcatttctt

SEQ ID NO: 151654 - DNA, 601 bp, Human
ggacaatggagtactattcagtcataaaaaagaatgagatcctgtcatttgcaataacatggatggagctggagatcattatgttaaatgaaataagccagacacagaaagataaactttgcatattctcacttatttacaggagcacttatttacggagatagagagtagaatgatggttaccagaggctgaaaagggtagtgcagggggtagtggggtggggagtggggatggttaatgagcataaaaatataggtagatagaatgaataagatctaaagttggatagcacagcagggyaactgcagtcaacaataatttattgtacatttaaaaataactaaaagagtataattggatcatttctaacacatagggtaaatgcttgagaagatggataccccactttctgtgatgggattattacacattgtatgcctgaatgaaaatatctcatatgtgccatgaatatatacacctactatgaacccactaaaattaaaacttaaaagaaataaaagatcagttcagtacagacagtgcacatccagttttgacaaacttgaaaatatgtttatacagaacaggataaaataaagg

SEQ ID NO: 151655 - DNA, 601 bp, Human
gcaaatcaaaattacaaaatataggcaatattattacaaatgccagtgaggacgtggaggaaaggcaacccttgtattatacactgttggtgggaatgtatttatcagtacaaccactatggaaaacaatttggaggttcctcaaaaaactaaaatagaactaccagatgatccagaaatcccactgctaggtatatacccaaaggaaaggaaatcagtatatcgaagagacagctgcactcccatgtttattgcagcacaattcacaatagccaagatttggaagcaaactaagtgttcatctacagatgaatggatttttaaagtgtggtacatatggacaatggagtactattcagtcataaaaaagaatgagatcctgtcatttgcaataacatggatggagctggagatcattatgttaaatgaaataagccagacacagaaagataaactttgcatattctcacttatttacaggagcacttatttacggagatagagagtagaatgatggttaccagaggctgaaaagggtagtgcagggggtagtggggtggggagtggggatggttaatgagcataaaaatataggtagata

SEQ ID NO: 151656 - DNA, 601 bp, Human
aaaggtgctcatagcattgatcatcagagaaatgcaaatcaaaattacaaaatataggcaatattattacaaatgccagtgaggacgtggaggaaaggcaacccttgtattatacactgttggtgggaatgtatttatcagtacaaccactatggaaaacaatttggaggttcctcaaaaaactaaaatagaactaccagatgatccagaaatcccactgctaggtatatacccaaaggaaaggaaatcagtatatcgaagagacagctgcactcccatgtttattgcagcacaattcacratagccaagatttggaagcaaactaagtgttcatctacagatgaatggatttttaaagtgtggtacatatggacaatggagtactattcagtcataaaaaagaatgagatcctgtcatttgcaataacatggatggagctggagatcattatgttaaatgaaataagccagacacagaaagataaactttgcatattctcacttatttacaggagcacttatttacggagatagagagtagaatgatggttaccagaggctgaaaagggtagtgcagggggtagtggggtggggagtggg

SEQ ID NO: 151657 - DNA, 601 bp, Human
tcatcaacatagaccttaatgattttggtttgagccattgacaggaagcctgtaagaggagctagattaaggaagaatatatatttttaatgcaagtatgtaaaatggatgaaggcagtcagggagattttcatttccgattctattcttttccacaatgtttatgtgattcataaactactgtagtgatcagagaggcatttaaaataatatataaagttttacacatattagaatgtacaattttataatatatgcataacaaaaaagttgaataactctatatgacttttacaattcyaaaaaatatatgacatttaaaactgtttataagtgaataaaaaggctgagtttgctgctgtaagataagcacaagtttttccagagaagcttgaacttgaatcctgattctgttacttgcttattatgtaaccttgtacacatttcttcatatactttaacatttagtgttctcctctttaaattatgtatatgcagcatttggcagtatttgttaattgtgaaaattaagcaaaatactctacatagaggcctctgcatattgactgaataaaaaaatcataatcgaaatcacaatatt

SEQ ID NO: 151658 - DNA, 601 bp, Human
aaaattcaagtaacttaaaaatatgctaatcttcctcttctaacagctctataaattctcagaaattttaaaagtacgacaacttgcttgagcattctggctacagaatatcagactggtgattatcactctgtaggaacttaacattgatcagtattttcagtggttttttttttgacgatcttataaataagacttagtataactaacttattgtgttaagataggcaaagatgcagaatgctaaaatgtttctggaaaaaaaaatccctaaccattctgtttctaatttgtcttattytagttttgtttttcttggtagctgagtacttgcacaattcctcccaacacacttaaacactaaattatgaaatgaaatagtttcaaaggtcctcagtcttaagctgtcctttaaagaacatctcaagctttgacaaaaaccatggccaatctgtacagtggttttaattcttcgtttttactattgagaaatgtatagctcattctttttcaagagcttctagtaaagctttaaaagcaaccaataatgttgtaacattttaaatattggattaaaactctagatattttcttatttaga

SEQ ID NO: 151659 - DNA, 601 bp, Human
aaaacattcctaacagatacacaagtgagaattgcaaagtgagaaatcaatacgggttacaggaaacacaagatctaagaccagaggtgtgtaaaaggctggatacattttggagatctgaaagggaaaggaaagcgtactctagacagacaagcctggattaaagctttggggtgagaataagcacaacatgtgtgacctggaatagagaagaccgccctgcctcctagagagaagaagcatggatgtgatgggatattaaacccaggcacaggtttcatggagggaaaggaaagaatgycttacgggaccagttttcattggttctctcatttccagaataagaatacaactaagtgtgaattaatagttttaactcttaacctaccactacccaccaaagagtcagagagcactagagtcatttggtgaaacaaacagagaagactaaaaaaaaaaaaaaaaaatcacagtctgaaaattcaagtaacttaaaaatatgctaatcttcctcttctaacagctctataaattctcagaaattttaaaagtacgacaacttgcttgagcattctggctacagaatatcagactggtgatt

SEQ ID NO: 151660 - DNA, 601 bp, Human
actggaagcagtctgaggctcttaccagatgcagatgccagcactatgcttcttgtacaacctgcagaactatgagccaaataaacctctttataaattatccagcttcaggtatttctttacagcaacacaaatgaactatggaaaggatcttgagatgggatcatcctagattacccagatgggccctaaatcccataacaagtgtccttctaagaaacaggagaaaagacacagacaaaagcggagcaggtgatgtgaagacggaggcagaaattgcagtgaagtggtcacaagtcartgaagtcaagggatgcccacagccaacacaaactgaaagagacaaggaaaaattctcttctagaaccctcagagagagcatggcctggattatgccttgacttcagacttctagcctccagaactgtgagaattaaaagagtgttgttttaagccacagaggttgtggaaacttgttagagcagcctcaggaaacgaatatagctgtagacagtcaaagtgattagaggatgatataaatcaggaaatgtgactgacatgactgcaatttgcacaaatccaagagggtatggtgcctaca

SEQ ID NO: 151661 - DNA, 601 bp, Human
tttaaagtaatataaattatagttcctgcctaaatttttacccataactcacttcttagaacacacagagttaccactgaaatcaaagttagttacatgtttactgaactgtattggctgaggttttgaaaatatctacaggctgtatgtatggtatctatcctttttcatcgaatagactatgatttcatcattatattttataaccactttttaatccagaaatgcaaaatatgagagctgcaaaagtaaatattccaccatccttatgaatatttcattacacaatatgtttatttasttacaatttttttggaagagccaaactaattcattgcacatttatttagtacatctactgtcactattgtagtaggttgaatggtgctccgccaccccgccccccaaccaaaatatattcatgtccaaatccctggaacctgtgaatattacattatttgaaaaagtctcattacagatgtacttaatttaaggacttctatggtttagatatggtttattcggccatgccaagtctcatgttaaaattgattcccagtgttgaggtgaggcctggtggaaggtgtctgggatgtggaag

SEQ ID NO: 151662 - DNA, 601 bp, Human
acacttggctcttgttacctgaatctggaaagagcttagacttgtgtcaaagcacattctaatttaccctttatcactatcctttttaaagaaagttttcaaagtataaaaagtatattcacttaacaacaagttttacaggttaaaattagcattaaaacaaaaatttaaatagtaatagtttaaaagttcatgtgttcaaaacaaaattaaactttggcttccaaattgctaaaatgaatttggacaaagcattgttttaatctactatagtaaatatttgtttttcattcaaaacagrtaatccaaaacaagtcgattttatcagctaataactgataatactgaaatgaaaataaataaggtttaattttacgttttgcaatgatgtgttactctaactaaactgactggataaaatatgtgtattttagttttttgtaatctcatgctctatatattttattgcttttataaataaataaatctagaattaaagttggacaaactgtataacatcaagtaattataaaactatgttaaaatatttaagaatgaatttgtgaatataacttttgcttctttaaaataaaaaggaatg

SEQ ID NO: 151663 - DNA, 601 bp, Human
actggattaagaaaatgtggcacatatacaccttggaatactatgcagccataaaaaatgatgagctcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggagaggggagggatagcattaggcgatacacctaatgctaaatgacgagttaatgggtgyagcacaccagcatggcacatgtatacatatgtaactaacctgtacatggtgcacatgtaccctaaaacttaaagtataataataaaaaaaagagttctacaaatgtttaggttgcactactactgtttgaataaagatattgcttgataactaaaaaaagaaagaatgaataaatgtatacttaattatttaataccttccttctccatcccacaagatgtgagctccataatggaagggctgtgtttgccttggtttctgctgtatatcctggttttgtacagtacactatgcctatgt

SEQ ID NO: 151664 - DNA, 601 bp, Human
gtttagtcttgggagagtgtatgtgtcaaggaatttatccatttcttctagattttctagtttatttgcgtagaggtgtttgtagtattctctgatggtagtttgtatttctgtgggatcggtggtgatatcacctttatcattttttattgcgtcaatttgattcttctctctttttttctttattagtcttgctagcggtctatcaattttgttgatcctttcaaaaaaccagctcctggattcattaattttttgaagggttttttgtgtctctatctccttcagttctgctctgatyttagttatttcttgccttctgctagcttttgaatgtgtttgctcttgcttttctagctcttgtaattgtgatgttagggtgtcaattttggatctttcctgctttctcttgtgggcatttagtgctataaatttccctctacacactgctttgaatgtgtccccagagattctggtatgttgtgtctttgttctcgttggtttcaaagaacatctttatttctgccttcatttcgttaggtacccagtagtcattcaggagcaggttgttcagtttccatgtagttgagtggttttgagt

SEQ ID NO: 151665 - DNA, 601 bp, Human
aatatttaaaatcatgtaagtgagctgtgtccacttgaaaaacttgactcttttgctgtgaatccatctggtcctggactctttttggttggtaaactattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcacctttaycattttttattgcgtcaatttgattcttctctctttttttctttattagtcttgctagcggtctatcaattttgttgatcctttcaaaaaaccagctcctggattcattaattttttgaagggttttttgtgtctctatctccttcagttctgctctgattttagttatttcttgccttctgctagcttttgaatgtgtttgctcttgcttttctagctcttgtaattgtgatgttagggtgtcaattttggatctttcctgctttctcttgtgggcatttagtgctataaatttccctc

SEQ ID NO: 151666 - DNA, 601 bp, Human
gtcataatgtttaatgagatgcatgggaacctctgaattggatgaatattcaagtgatcttcagggaaatcctgaattagaatcagctccaataatttaattgaaaggtcacataactgagtgactattataaaatctataatataatggaagcactgtactcgcacaagtggcagttaagaactttaggtcaagggcttatctcatttttagactcataataagacaatactctttacttttagaaaatgtcaacattcctctaaggaaaaattactatattacttaagagaaaacattygcactttttctattaactatatccgaagagggtaaggaaggcgtatatcacatctgtagaaacattttttaaaaaaatacttggaatactatatgtttttgccaatccttagaagtgatcaacggttcttgcagatactgattctattattagaaaacagcttttgatttacctgtttgtccaacaggggtctccgcttttgttgttttgtacttgtattacttttattcttaaaaaactagtgaaagcaaaacttcaaatacaacttcacctaagtgaagaatgtttacaacatttaat

SEQ ID NO: 151667 - DNA, 601 bp, Human
tgagcccttaagaaagaaatgtacagccaaatcctggttcatctttatcagaagggcctatgctaggactgtgcaaaccttttataccgagacttcaccctaatttcatcttagtttgttgactttcatttgtttttgcctttgtcctattttcctttacagtgacatataaccatcctcccctttactaactacttatggatgcaggatggaaaatatttatactatttttgcatactttgaaggtttaaacatcagcaaagtgaaaacaactgacctcaaaacatgatctaacccaaartgagcaccttctgggagatggttttctgcttgacaatactttgtaatgaacttcatctcttatactgaggtagatgtcactattaaccaaaagcaggagctctgtaatggaagaattgaattaagatgcagatttctaagcaagaagagaaacatagagaccaggatagagcacagggcttggatggagcataccaacaaagagaaaataatgtgaggggtttaactttgtttcttttaccctggattttaaaaacagtcatattaaggatcaagtttattttttatttgttgtatcatt

SEQ ID NO: 151668 - DNA, 601 bp, Human
ggaaataacatgtatgacgactcaaagttaagtaaagcagtcaggagatggagaccatctggccaacatagtgaaaccccgtctctactaaaatacaaaaattagcagtgcgtggtggcacgcgcctgtattcccagttacttgggaggcttaggcaggaggattgcttgaacccaagaggcagagtttacagtgagctgagatcatgccactgaactccagtctggtgacagagcgaaactacatctcaaaaaaaaaaaagcaaacaaacaaaaaaaaagttaagcatagctaaatttgwagaactgaaagaaatgcaatataattgcatcatgaagtgcaagaggggaagtggcaggcgagaaagccagaaagatttgcatagcctgattataacaagcctcactaggcagattaaggagttacactttatgataagggtaaggggaggtcatttaagacatttaagcaagaaatggctattgaatacatataaactagaagtgtaggattagctacttgatggaattactggggatagattctatttcctctaaagagtatatgtctgcctcaacagtggaaaggatagtaggaggta

SEQ ID NO: 151669 - DNA, 601 bp, Human
ctacagatgtgctgaattctaacaggagattggcaagcagcaaagaatgaccgtgctttgggcttagaaggataaccatattgtggaagattaaatatcttctggatgaagaatgaggcttgcccccatgaccacagtaggaattctattaaacttgatgtaatatttttctagataaaagaattttgaagaagatttatgtcatagaacttgaaggttccaaattctctttgatctatatgctagaggggaacctgggaaatttcaaggagaaacttacctcttttcacaggagctaccwaagcccacctctgggctaaaaagtgcagtctttgattcagacacctgtgcttgtcagacccttcaatttttataagagcatgacattcctacctgtgcctatgctatcccttggagcataagggtctatatgcattcaccctgcacctaactcattaagaaatgttgttgcctctaccttcaaaatgctgtatggccataaactcaggaaacacagatgaatatacacaataaatgatttattgatattactttgcaaaaaaaatataaatgatttgggtctccacagtccttgttgcta

SEQ ID NO: 151670 - DNA, 601 bp, Human
ccttttactcctaggatgagaaaatctcgacaaagatttgcccacagggataaacaatgtgtggaagaaaaaaccaaaaagccatttagaaataacattattacttgtgtaaaaaacttctctgtatgctttctagtagacatgaaaatgtagactcaaatatttgagaagtctgaaaatccacttgagaaatgtgtgtaacaatttattataattgcaaacccaattaaaaatgttgagctattgaacacaattcattttataatccatgaatatattaaatgtatgtagcacagatttrtgttactataaaaatctttatttctacttttccagcattatgcatttaaatttgtaaattctatgttacattaatcacatgaatatagatgggcaacttcactacatttcctataaaagaaatcatgcctactgacaattttgtaggaaattttgttaaagattgactgtagctcataaaacagtaaggtttccttcacgaaagttattagacattttagatcccctcagtttgattgaaatgataaaaaaattacactttaatatcactgtctttggacactgacactgtatttaatac

SEQ ID NO: 151671 - DNA, 601 bp, Human
atacctattgcttccaaaagaaggcttatttggtctggagaagtaaaagtaaaaacatggagaatgaaatacgtgatatttggccaaaatgaaggaaagacagtaaaagagtacactgagaaattatacatgttttcatatttacctagcatctttttggtcatcttgttttgtttttcatgatctgtcttgctggtggtgctatcaatgttgtgttctcatttttgctgtccttagaagtccatttgcttgactatacatctaaaactgattcctgtaagatcaatctgactagagaagycagtttaaacccttttactcctaggatgagaaaatctcgacaaagatttgcccacagggataaacaatgtgtggaagaaaaaaccaaaaagccatttagaaataacattattacttgtgtaaaaaacttctctgtatgctttctagtagacatgaaaatgtagactcaaatatttgagaagtctgaaaatccacttgagaaatgtgtgtaacaatttattataattgcaaacccaattaaaaatgttgagctattgaacacaattcattttataatccatgaatatattaaatgtatgta

SEQ ID NO: 151672 - DNA, 601 bp, Human
cacattttttaaaaaagtaaaaagtcaagttggagaaactgccaatacctattgcttccaaaagaaggcttatttggtctggagaagtaaaagtaaaaacatggagaatgaaatacgtgatatttggccaaaatgaaggaaagacagtaaaagagtacactgagaaattatacatgttttcatatttacctagcatctttttggtcatcttgttttgtttttcatgatctgtcttgctggtggtgctatcaatgttgtgttctcatttttgctgtccttagaagtccatttgcttgactayacatctaaaactgattcctgtaagatcaatctgactagagaagccagtttaaacccttttactcctaggatgagaaaatctcgacaaagatttgcccacagggataaacaatgtgtggaagaaaaaaccaaaaagccatttagaaataacattattacttgtgtaaaaaacttctctgtatgctttctagtagacatgaaaatgtagactcaaatatttgagaagtctgaaaatccacttgagaaatgtgtgtaacaatttattataattgcaaacccaattaaaaatgttgagctattg

SEQ ID NO: 151673 - DNA, 601 bp, Human
ggtgggctggtaggtatggatggaagtggacagattggacagagaagggtcgaagaagactattctgtttctagatttcatgtgtcagtggatgaatattggtgccattcactgaaacagcaacactggaagagggtctagattgaaagagaggatcatgagtaatctttatggatatattattcaaaaagaggtaagaagtaggcagaggagagtgtggcctggagatacttaatgttagtgtttgtggaaatagatggcgattagtgggtaaggatatagttgcctactgaaagtttasaggtaacataaggaaaagaacaaagaatccaggatcaagactcaatttaatagctagatatggtctaggaaaggcaacatacagagaggcaggaaaaacattagtagggatgtggtatcattctggcacattactgctttgtggtattaatgaacaatttaacatgtacacattgcatcatttggaatgatgttatgctcctggaaatgtgagatttccgttttatgtttcttatgtaacacctctctgttttcttgcagaacccaacagatacttgctgaatgaaaatgttcataactt

SEQ ID NO: 151674 - DNA, 601 bp, Human
catgttaatcatgaagcagagagattcctgcaggagatgttcctgctgcactcatatgggaatggcacctacctagacttcacagctgagaacattggaagcacagctggacaggcaagttactgtttagattgcctcctcaggtctcacatgtggcttccttgtggcagatttgaggaggcataaaacaaagcaggcgtggattctggccagctggccatctgttccttcacctactgtgataatttggtcttgtagaattctgttaagtgagcattaagtaatgaccatgtcaaacagwacataatgactgcttataatcactggatgaaagcttaagggatgcttgcccaaacacagaaaaggtcaccaaagcaaaccaatattttttttaaaaaaaaggaacagcaaaattgacacaaaacagcaacagttaactttgttttcatttttactttttatcatattgaatccatgtcaaatcacagagggtgaatatggtacaaaggagctaagtaaatacactgaagtttctactgtctcattatgtgtatatcaatttacatagacaaactaaataagaattttaaaactaagaaaa

SEQ ID NO: 151675 - DNA, 601 bp, Human
tacaagaggctttagggagttttaaaatcaataatgctgtaatacttttgcaggtaatctttaagtagctcctaacacaatggggacagcatatgatcaatattaatgaacaactgaattcaacagcatgctttccaggcattttttatgcaagctcatataagtatgtcaacaagattaattcctcacaaaagcagtagatctatatggtttgctacttttctgcatctatctcctcacaattccaatagtagagttagagttatttccatatgtgtaatatgattagctgcttacacayttagagactgtgcccgaaatcatgaataacttatagtacacaagcagattattagaaagtgaataggttaacattctcctgtgataatatgtactaggctttggtcaatttttaaaaaatatgcctccaaaacattgccagttagatatcaaaataaatgtacactttatgtagtaaggaaatgccagtaaggcaattgcaacagcatagtttttactagttgtttaccactagaataaaataggaatagctatgaccccaaatttcaccccaaattctggtgttaagaacatatcgaag

SEQ ID NO: 151676 - DNA, 601 bp, Human
ggataagcactttgtatggtattaaaattgtcagcagctgaaagacaaatctcacatcagaaaaatatccttagttatccagtttaggtatctcattttttaaggtaatttcaatggctctcttttactgtgaatatactatgcttggtattaatacatttctttgttcatataatggttcctggaaatttaattctaggatttcctagtggcaacatattaaaacatgaaaattaagaatcggccatattcttaattttagcagccaaaactatagtacatttgaggcatctcatatagyttctataacataccagcacacacgcacacatacaagcacacatgtatatcactctcacacagctttgaagcagtttaatagcagatcaaagtttgagaacaaatgagtattattcaaccactcagagcttgtaaaacaaaaagatagaagacaagggcaatctcaattgcttgtcacttcaaaagccttgtaaagaagtttgtctttctatgcattagggcatacagaagaagtatacagagtggtgactaggagcttgtgttctgattagtattcataaaattcgaaattatctgatta

SEQ ID NO: 151677 - DNA, 601 bp, Human
tcaatcaatatctaccagtgacagattgaggcctcagactaagaatctgggattctaaaacctatacccctcagagcatcaactaactggggaggggagaatgaaatgatagtgatgttagagttttgactcatcaattcacttcaaatgagagtaaaaatgatagattttaaaactaactgataactgacagccaagcacataaccgctaaagaaaaaaatatataaataattacagtcaaaaattatataattttaagcaaataagagtccttggagatcacttaatccaactttccarttttgcaggtgaggaaaaaaaccaaatacgaattcagaaatgttccctagaaacaacttaatatgagaaaaattaggtttaaggacttgttcctaggaggaaaaatagttatttaaaccaaaactggtaagaaattaccgaagagagtggagtaatttatatcacagagaaaataagtcttccatgctccttcacacttacagggttggacgagggaggaatagaaaatgactgaaacagtaagtcctctgcgagttcttgagagcagttaaaacagtgattctgggcaggtgcggtggc

SEQ ID NO: 151678 - DNA, 601 bp, Human
caatttataaactcttttcacataaatcatctcatttattctttactataacttaggtcttcgtcattatcattctcttttacagtttttttttaaatactgaaggtcagaaagattatataatatttctcaatcaatatctaccagtgacagattgaggcctcagactaagaatctgggattctaaaacctatacccctcagagcatcaactaactggggaggggagaatgaaatgatagtgatgttagagttttgactcatcaattcacttcaaatgagagtaaaaatgatagattttraaactaactgataactgacagccaagcacataaccgctaaagaaaaaaatatataaataattacagtcaaaaattatataattttaagcaaataagagtccttggagatcacttaatccaactttccaattttgcaggtgaggaaaaaaaccaaatacgaattcagaaatgttccctagaaacaacttaatatgagaaaaattaggtttaaggacttgttcctaggaggaaaaatagttatttaaaccaaaactggtaagaaattaccgaagagagtggagtaatttatatcacagagaa

SEQ ID NO: 151679 - DNA, 601 bp, Human
caagaagcaaggtagaagagctggacaaatgaataataataacttgagtcaactgggttggggcaagggtattgaacagagagtgctatagagaatgactcctcctgcatgggtcaaagccactaataaaaacaagagctgaacgaggtggtgcacgcctgtaatcccagcactttcagaggctgaggcgggcagattgcttgagcccaggagttcgagacaagcctgggcaacatggtgaaactccacttctacaaaaaatacacacacacacacacacacacacacacacacacacaaatccaggcatgctggtgtgcacctgtagtcccagctacttaggaggctgaggtgggagaattgcttgagcctaggaggttgaggctgcagtgagttaagatcacaccactgcatgccagcctgtgtgacagaatgagaccctgtctcaaaaaactaaactttaaaaaaaacaaacaaacaaacttgtgaataggaaaaaaaaaatcaccagcatcacttcaagcactgcaatcggacctcaaccatgggtgggaagcacttagaaggtgggcaactttgtcatgcactggggcaagatttt

SEQ ID NO: 151680 - DNA, 601 bp, Human
aacaagaagcaaggtagaagagctggacaaatgaataataataacttgagtcaactgggttggggcaagggtattgaacagagagtgctatagagaatgactcctcctgcatgggtcaaagccactaataaaaacaagagctgaacgaggtggtgcacgcctgtaatcccagcactttcagaggctgaggcgggcagattgcttgagcccaggagttcgagacaagcctgggcaacatggtgaaactccacttctacaaaaaatacacacacacacacacacacacacacacacacacaccaatccaggcatgctggtgtgcacctgtagtcccagctacttaggaggctgaggtgggagaattgcttgagcctaggaggttgaggctgcagtgagttaagatcacaccactgcatgccagcctgtgtgacagaatgagaccctgtctcaaaaaactaaactttaaaaaaaacaaacaaacaaacttgtgaataggaaaaaaaaaatcaccagcatcacttcaagcactgcaatcggacctcaaccatgggtgggaagcacttagaaggtgggcaactttgtcatgcactggggcaagatt

SEQ ID NO: 151681 - DNA, 601 bp, Human
tctcccttcaaagtgacaggctatgtcacggtctgtaggctcatcctatctactcttgctctctctcccctttgtgcatcacagacattccccccaaaaatcttttacacttttaattctatcttacagtcttcttcctgcaggatgttaattgactcaggacagaatccagacttgagattgtgaagaagggaagagtcaagttgaaggaaggaaaagctctccctgggagatgaaaaaagacaaaaacaaaaaactacagttttctctaatttagtctgtactgattttaattggagakagtagaacatatttataaggaaaagaaaagccactgaagaggaagttaagatgtacatattagaaaaggaaagcaagggtaattaaactaagtatctgactgtgtatgaagaggtgattttgagagccctagaggatttgttcagaaaaggagtgagtgtgttcagctgaaacaagaagcaaggtagaagagctggacaaatgaataataataacttgagtcaactgggttggggcaagggtattgaacagagagtgctatagagaatgactcctcctgcatgggtcaaagccactaata

SEQ ID NO: 151682 - DNA, 601 bp, Human
atacctctggggaagcacattttctgccaatctaaaacgagcagtccgtcaaaagttgcatacttagagaagaggggctgatggtcatttttaaacttgagaaagtaacagcagattatttagtacctgtggctgctaatgaaagtgtggtgctgctcagagctctcttggagaaaaccagctgccaggagtgtggttagctgacaacattcagctactgaaccacaggatctgctgtggcagcatttattttaaggccaggctccccagccaaaaactaaataccaaaggggcatagagytagctgggccagtcgtgcctgacctgagacttctctaataaacattctgtactctgaggtgccccaatggtgtggctgagatttttcttaaaaccatagcagtttgagactttttctatgccatgttctctccttccttttctcccttcaaagtgacaggctatgtcacggtctgtaggctcatcctatctactcttgctctctctcccctttgtgcatcacagacattccccccaaaaatcttttacacttttaattctatcttacagtcttcttcctgcaggatgttaattgactcag

SEQ ID NO: 151683 - DNA, 601 bp, Human
gtggctttaggacaaatatgaaagagacagatatcagtttaatgtaaagtgcatcttttggcaaggatagtggggcaataataaaaagggatgaccagaagactacaaacttcccatgccactgggaggattgaaacacagtctaggagtcctccactgtggacatggtgtattccatgggagagaagcagcattagccaaagccagggctctcttctgctctcagattctatgattctactacaaacaagaatgatgatggcttgtatactttgtaatcaataataataaaagtacaatractatgaataacttactgtgctgacagtgaatcccattaaatcctcggggacatttacaaacatagcctatgaatgtatcccctcggtatgcttcacttatttcacaggttcctccattatggcatggattaggagtgcagggacctgaaagacagaaaaaaatatttctgcttgatgcatattcttaaaagtagacattaggtcaacattttgcaattaataattttacagaaaaaagtgttctagatattagtggcatagtaaatgtactggttgtatgagctctggagactaatggc

SEQ ID NO: 151684 - DNA, 601 bp, Human
tcagcttgcatgtggcaacctctgtgagaatctccctgacagcttagagttggctgtggcccctctgcttgctgaacacctacagtgctaaggcaccacaccattcctttgacatttatgttcacccctccttctaagaagaaatcatcactagtgggatctactttctttaaccttccaagataaataagaattgggatttaaaaaagaagtgcaggtagcatacttattgagctttcaaagattttcacactaaaaatgccaacatgtaagaaggagaaaactggcttaagggcagggtggcagttttgtgttttgtttttttttttctgggtatcatctctgaacctaatcaccagagtaatttttggaaaacttaaaggatgtggctttaggacaaatatgaaagagacagatatcagtttaatgtaaagtgcatcttttggcaaggatagtggggcaataataaaaagggatgaccagaagactacaaacttcccatgccactgggaggattgaaacacagtctaggagtcctccactgtggacatggtgtattccatgggagagaagcagcattagccaaagccagggctctctt

SEQ ID NO: 151685 - DNA, 601 bp, Human
cataaaaaggacatctaatagctgaaatccaaaacacaacgagtgctggtaaggatgtagaacacagggactctcatgcattgctgctaaggatacaaaacagccatgttggagaccttttgaagcttcttttacaaaactgaatgtacttttaccataagatctagaaattgcactactaggtatttgcccaaatgagctgaaaacttatgtccacacaaaaacctgccatgaatgtctatagcagctttatttataattgcccaaaactagaggcaaccaagatactcttcaaatgccraatttataaacaaactatggtacatccataaaatggattattactcagaggtaaaagtaaataaactattaagtcctaaaaacacacggaggaaccttaaatacattgataagtgaaaaaaaatcagtcttaaaaggctacatactatgtgatttcaattacatgacattctggaaaaggaaaaactacagagacagtaaaaagatccgtggcaaaggttgagagaagtaggaaaggataaataggtgtacaggggatttttagtttagcgaatctgttctatatgatactgtgacagta

SEQ ID NO: 151686 - DNA, 601 bp, Human
ctcctctgcatacctggccctggggaaatcacggaagaatgatacgataaaaatgttagggccattcaaggagattctgagctgaggtgtatggtaaatccacctgatagcaataacgtcttaagctaggtggagactgccaggtggagggtgttaagtgaaaatgctatttaaactgcatgctttctgtaggcggtggcagttctgtccagcccgctgctactggaccacactgtatgtaacctccacttcaataaaccccatgtctcattgcctggttctgggtctctttggcctctcraaccttgtgccatccccactgacattaatagcaatccaacacaacaaaaagctaaaagaagccatcaagttaaaattataaagagtaacttaaagtaagaattaatgataagaggaattctagaaaagtatggagctacatagtgagccttagcctccccctgccttactacacaaaatgtttcctaaaaaattataattgtttttaaaggaagggaaaaaaataaagacccatagcaatccccattatattttaaagtattagtccattaggcatacctaactttttaaagtttgtaaa

SEQ ID NO: 151687 - DNA, 601 bp, Human
taaataaaatatatttaaaaatatactggtaaaatatgccagcactaattcattcaataaatatttatagtacagctaccatgtgacaggcacccttgaaagatataagagaaatatccgtatgtaaaatagccatatatccctgccaagtagtggtaaataaccccaactggtcaagttcaaaagacaagataattgcaatgatctctgttgcaattcaccgtggtgttctctagcgttctgctttggtagtcaaaccataaacaagtgtttagtgtgctcttatcactcacttatttawaaattcatttacccaatatattttgagtacctactacatgcaaatcacaattctaggttttgatcaggaatcatagatgactcaggcagaaattatctttaagctgcctggagtgaggagaaatatataaataaatacaaaacaagggagaaagaatgaagaagtaagtgtcttacaaggttgaaagcagagggactttcctgcctgaggaagtagaaatcctaggagcgtttttggaggatctgggcctggcattatcgatgagcgataagggcaagggctttccaggcacagaaagaa

SEQ ID NO: 151688 - DNA, 601 bp, Human
attataaatatgtgcttccttgaatttaaataaaatatatttaaaaatatactggtaaaatatgccagcactaattcattcaataaatatttatagtacagctaccatgtgacaggcacccttgaaagatataagagaaatatccgtatgtaaaatagccatatatccctgccaagtagtggtaaataaccccaactggtcaagttcaaaagacaagataattgcaatgatctctgttgcaattcaccgtggtgttctctagcgttctgctttggtagtcaaaccataaacaagtgtttastgtgctcttatcactcacttatttataaattcatttacccaatatattttgagtacctactacatgcaaatcacaattctaggttttgatcaggaatcatagatgactcaggcagaaattatctttaagctgcctggagtgaggagaaatatataaataaatacaaaacaagggagaaagaatgaagaagtaagtgtcttacaaggttgaaagcagagggactttcctgcctgaggaagtagaaatcctaggagcgtttttggaggatctgggcctggcattatcgatgagcgataaggg

SEQ ID NO: 151689 - DNA, 601 bp, Human
ggttggggaccatggtgtaattgaaaaatttacttttttcaattaaaaatatgtatgtatgtatgtatttgcctatggatgtaatgtatacatagtttctgacattattatctcattctgcatagtcaacataacttataaaatgataaagtctggttctatgttttctcaaaatcaatttcttggaccatttccatttgcccacataaaataactctgttcctaacagtgttaaagctaccattctgtgtcacctttgtatgtaagaagcctgtggagagaatgatacaaaagaagaaggtttttaatctctctaaattcttgttggtaaatttgcttttcccttttaattacttcttgtagagatgtagtatgaattaaaaaaataacgtaacgctaaatgtagaatttactaaatgcataaatatttggaagaaagaaaataaaacacaacttcagcattagaatactgcctatttgggtgccaatcgaaggagatttttctgaaattttctagacaatgataaccggaatctattacagaacaaagaagtgttgctataacaaagcagcatgctgcatataattaaagcattaaaat

SEQ ID NO: 151690 - DNA, 601 bp, Human
atctgtacaacaaacccccaagacacgtttacctatataacaaacctgcacatgtacccctgaacttaaaattaaaaaaatgggggatttactcaatcattgactctgaaacagttttgtacatattccagatgtgaagtaagcaatccagtaaataatatttaagctagtataaagaatcaatataaagaggttggggaccatggtgtaattgaaaaatttacttttttcaattaaaaatatgtatgtatgtatgtatttgcctatggatgtaatgtatacatagtttctgacattattrtctcattctgcatagtcaacataacttataaaatgataaagtctggttctatgttttctcaaaatcaatttcttggaccatttccatttgcccacataaaataactctgttcctaacagtgttaaagctaccattctgtgtcacctttgtatgtaagaagcctgtggagagaatgatacaaaagaagaagatttttaatctctctaaattcttgttggtaaatttgcttttcccttttaattacttcttgtagagatgtagtatgaattaaaaaaataacgtaacgctaaatgtagaatt

SEQ ID NO: 151691 - DNA, 601 bp, Human
tgttggtatgcattaattttttcaacatgaaggctcattcataacattggagtattccaacgtaacgttattcgttactccattcctgtgttttctctggaattagtcccgtgctgaatatcttaaatccattctccatgttcgttaagcatatatcttctattttttattttatctaagttttggaatatttctatgacttcaacctctcactacactttttaaaaataagttctccaatcatatcttttataaccatcaactctttttcaaggtgacatatagtattcttgttttatgwatatcatattttctttatgatcctaattaagatgtttaaaaaggtccctctgttccatgaatcatactttcttcctcttgcatcatttatttatgtgttcattttggatcttctgttttgtgcagtttacttcaaatgtctggtgaaccttgattgcctacttacacgaatgaaagactagattgacttgtatacttaactgtatacaagtgtagtttattcagtactttaatagttttatttttgaacaagcttctgtcctgtacggaggactgactgtatcctctagagggggagcat

SEQ ID NO: 151692 - DNA, 601 bp, Human
agattgcttgcaggaggtaatacatttggtgcttaaaggatgagcaggagtttttatagctgtattaaattaggaagaaacacaaagaacatattttcagagagagctgagcactttgaatttctgaagcatgcacagggactgtgcgaggggatactctgcataatggcgaccatgtagtctgggaccagatttttatggccgtatcaatcaacttaaggagtttgaactttagtccttggatactggagagttaatagagaactcaagaagggtggaaggggacatgggattgaatagwtctgcattttagaagctcattcacattctctaaaatttcattactggtatcattttggaaaaataattcaaaaagtgagaagggaaatttatgttgagtccatatcactcagactaggtagtaggatggctataatcacgtttggtatgtttaaatacttagcttggttcgaaatgtatatagacttcctaatatttacggttgctagatttggtaaataaaaacagagagtgtccatgcaaatatttgagacatatttataagaaaatctttgtttatctgaaattcaaatttacctgg

SEQ ID NO: 151693 - DNA, 601 bp, Human
cagatgctgaacttaattatgtcacaatcagaattatctagataatttatttcccagtcacttctgtgaccagtttagtatatatttgaatcttctgttcttgaactcccttttgatgtggctttctgctatattactagtaattcattttaaagtggctaattaaaatcagcattattcagtcagaacgtatcacacacaaaccttttataataatttattgataaccttcacttacaagaacagtagcataacaaaagccccaaatccaagagatatttatccattgtctccatctaayaaagatcatattctctgtccatctctatcctgacatcctagtatttattttaagatctttatttagatgcaaatgcctttgatactagtacgcaggcaatattcatcccaattatctgggttgtttatattaattattccaataaagttttatttgcatttacacagatatttggccagtatgacaagacagctattccaagggatataaaagccaaaatgaggggaggtagaggaggggttatcaagagggtgttatgtctctataactcaaatatttgatgactttaaatatatatat

SEQ ID NO: 151694 - DNA, 601 bp, Human
aaagtttgaccttttatatttttccttatttaaagcctatgatctttcaatttctctttaaagattgaatttctatttaagatgaatttctaggaatttgattctcccactcagatgctgaacttaattatgtcacaatcagaattatctagataatttatttcccagtcacttctgtgaccagtttagtatatatttgaatcttctgttcttgaactcccttttgatgtggctttctgctatattactagtaattcattttaaagtggctaattaaaatcagcattattcagtcagaacrtatcacacacaaaccttttataataatttattgataaccttcacttacaagaacagtagcataacaaaagccccaaatccaagagatatttatccattgtctccatctaataaagatcatattctctgtccatctctatcctgacatcctagtatttattttaagatctttatttagatgcaaatgcctttgatactagtacgcaggcaatattcatcccaattatctgggttgtttatattaattattccaataaagttttatttgcatttacacagatatttggccagtatgacaaga

SEQ ID NO: 151695 - DNA, 601 bp, Human
tattgtacagattatagccaaaagcccatgaaattgactttggagtggtaggctgtcaaagagtttttaaaatggaaattatatttgttaattccttattggtgccttcaaaacaatgcattgtctgggcatgacttcttgtcacagaaactgtgtggcttcttctcagagaattatattgaaaaattcaataatctcattcttcattacagattccgctagttggccagagatgaaacagagaattcttgagtctaattcccaggaatctccatctctggagacttttaaaactaattartaagtaattaattagtttgttttcaactggctcacctttgcaatctgcagagtaggaatggtagcagttttcacttctgggacatcattatcccagttcatccttgagttctctcagaactcctcaggaaaatgccatctgtcctcagtagtttagctacatttaattcaccaacatggcttagatattttgaatactgaccaccatttggaccaggacatctaatccttctggggatagatatctatctaacctcctcctagagaagacaaagacaatgtatttcaaccataaatctat

SEQ ID NO: 151696 - DNA, 601 bp, Human
gaaatgcacactctggagatttcgctgtgagaagcctactccagtaattgacaaactactcatatatatatatatatacacatatatatatatatatatatacatagatctatctatctatctatctatctatctatctatctatctatctatcatattgagcactcctcccttaggcaattcaccttatgcacatccacatcctgagaaatgctcagttacacctggtcttctttgtcctggatctttgtcagaaccattattgtacagattatagccaaaagcccatgaaattgactttggagtggtaggctgtcaaagagtttttaaaatggaaattatatttgttaattccttattggtgccttcaaaacaatgcattgtctgggcatgacttcttgtcacagaaactgtgtggcttcttctcagagaattatattgaaaaattcaataatctcattcttcattacagattccgctagttggccagagatgaaacagagaattcttgagtctaattcccaggaatctccatctctggagacttttaaaactaattagtaagtaattaattagtttgttttcaactggctcacctttg

SEQ ID NO: 151697 - DNA, 601 bp, Human
tttttttttcttttttaggtaagtggtgctttctgcctctttgtaaacacttaaggcaaataactgccctgtcatttgatgcatcatttcaagaccctactttcttcagcttccaataagacaaataaatagtgtgcaacattcttgctagcgtgtgggacggcccaaatgcatcctcctttatttttacgttttatttataacagaggctaactgatttattttatttttatttcgtttcttttagagatgggttctcactgtgttgcccaggatggtcttgagctcctgggctcctctygctgaggcctctaaaagtgctgggattacaggcatgagccagtgtgccctgtctatctggtttcaatgccctgaatttactctcagaaccaaagtgtcactttggtggtagaaatttcagtcatatgcataatcataaaccaaaatgggattcgtggaacttgagtatctgaggaaatgttatcattcttttcaggtcacaagataccatttctatgcatattgtgcactaaatgagacaccctagagaatatgtgtgcattaataacataccacaaatatgaaaagtgccatttcaatg

SEQ ID NO: 151698 - DNA, 601 bp, Human
gggacatgcatgatacaaagtccagaagaaaggttgtcaatcatattccagggtagaaaccagcacaggagttatcatctatgtattgtcaacaacttccaagatcttaccttcaagcagcttagagctggtaccacctgtaacctgtaggtgcttatatgtaccccacagtaagcaaattctctaagttctccatgtgcaaaactaaatcattacccctttttactctagattttctaaaatctcttaagagactacagaaaaaagtagaaccatatcctaagaaacctagacaatagayagaataaagatccttaatttgttatatgtccttaaaatttaataaaataaaagcaaacaccccaataggaaaatattttagggaactctctaggtgactctttctgatctctttgtcagcacacggagaatacaggaaatgctagaatgccagatcatatgacagttgaagggaggcatgccactatcacatgcatcttcaaagagatgtctgaatttaaatataaatgttgtatcaatataaagttaattcacagaaaagcaaaggttttcattaaacacaacatgaaaaactggttgg

SEQ ID NO: 151699 - DNA, 601 bp, Human
agttagatataaatttattccttacaaagtaaaggtgcttaatagctaaattaattaaagacacacattacagtaaataattcacagttatttttgtaatatttatcaaggtaatatctcaacaaaaacatcttgcttttaattgtttaacttaaatatatttgagtttttaaaatgtggtatatcactagttttgaaaatatttcatttaattgtattggcaaaggcagccttaatatacagtttaaaattgaaagtctggtaaaaaatgagggaaaggctgccctctgggacatgcatratacaaagtccagaagaaaggttgtcaatcatattccagggtagaaaccagcacaggagttatcatctatgtattgtcaacaacttccaagatcttaccttcaagcagcttagagctggtaccacctgtaacctgtaggtgcttatatgtaccccacagtaagcaaattctctaagttctccatgtgcaaaactaaatcattacccctttttactctagattttctaaaatctcttaagagactacagaaaaaagtagaaccatatcctaagaaacctagacaatagacagaataaagat

SEQ ID NO: 151700 - DNA, 601 bp, Human
taataatgtcatatttaaacaaccaggagggaaatgtatacaggtattgtgggccacatagtccaataaatgagaacaatcctagttatttttagattagttaactaaagtgttattaattttcattgcacttaatctagtttaaacatcatgttcagttaaatttacatgacaaagcttatctgttcttatgagaatagttttctcattccaattcatcatcattttcaagctgtttatggaaataactgtcagaacacttgagcttataacatttaaaaggaatgagggtctgcgcgcrgtagctcatgcctgtaatcccattactttgggaggccgaggtgagaagatcattcaaggtcaggagtttgagaccagaccaaagtgctgaaaccccatctctactaaaaatacaaaaaaaaaaaaaaaaaaaaaaatagccaggagtggtggtgcgtgcctgtagtgccagctgctagggaggctgaggcaggagaatcacttgaacccaggaggcagtgagccgagattgtgccactacactccagcctgggcgacagagtgagactccatctcaaaataaagaaataaataaataaaa

SEQ ID NO: 151701 - DNA, 601 bp, Human
cctgaaatttaataatgtcatatttaaacaaccaggagggaaatgtatacaggtattgtgggccacatagtccaataaatgagaacaatcctagttatttttagattagttaactaaagtgttattaattttcattgcacttaatctagtttaaacatcatgttcagttaaatttacatgacaaagcttatctgttcttatgagaatagttttctcattccaattcatcatcattttcaagctgtttatggaaataactgtcagaacacttgagcttataacatttaaaaggaatgagggkctgcgcgcagtagctcatgcctgtaatcccattactttgggaggccgaggtgagaagatcattcaaggtcaggagtttgagaccagaccaaagtgctgaaaccccatctctactaaaaatacaaaaaaaaaaaaaaaaaaaaaaatagccaggagtggtggtgcgtgcctgtagtgccagctgctagggaggctgaggcaggagaatcacttgaacccaggaggcagtgagccgagattgtgccactacactccagcctgggcgacagagtgagactccatctcaaaataaagaaataaa

SEQ ID NO: 151702 - DNA, 601 bp, Human
ccaaggaacaaaaaaaaatagttttactttttatgattagaccaaataccagaaggacacggttaatagctttgtgggaacttttgtagtgttttgcataatgaatgaactcaccaaagctcctatgacaaaatcctcctgactactcaaaaggttaaatgtgtataaatagatgacattttcctatactatgaagaacagttgaataatactaaatgaattgttttccttctcaggtacacttataaactgactgctttcttggtgttaaccttttcatgcacaatcccttgaactacttattattaattaatatgaggaatattattaaatttaaattgatcattcatgaagacaaggatgcagagtaaaaacagagagaagcaaaagttctaaaagactatagggtctacaaataggaataatgagaatgagacagaggggccagaaacccgagtagtatgtaaaccttcatcgtaatgtggttaacatacaaacttgaaaatagtcctcattttacagaggtaaactgaatgggtctgttttcttggaatcaaaaataccagacaaatgtatgtcagagcaatatttccagtgactt

SEQ ID NO: 151703 - DNA, 601 bp, Human
aagtataagaccaatactatgcagttttctactattttttcttttataaaattcagtttaaacttggattaaatgtatccagttgcctgttcattatgtttaaacaagtgtttatctgcttcccaattttacaccaatcaaaatagatgaaggtaactttctccctagagaattcttactaaactcagagacatcttagccactcgactgcctgaacttatcaaatgcccaacttatccaggtatgcataaaatacttatgcaggtattttaggtattaccaaagagaaaattaagtacaytgaagaaacaatgtctattttaccgacaaattttagatcggaaaagggatttggccaaccagacacaagggaagacacgttgtagaaagaaccaagtaacaatatgtaaatattatatgcatagcctctgatggtatgttacatgtgtcgatttaaatgaactccattttagaatgaaataaaattgaataattaattttgtggttcccaagtattcctgttcagatatggaatacttttgtaatcagaaaacatgtttaagaaaattttaatggaccttttgttcaaaacaggtgaaat

SEQ ID NO: 151704 - DNA, 601 bp, Human
gttttacctgctggcagttttgttggagcaatcaacaaaatctcatttcttgaattccacaaatgagagtaaagtaacaaaccatttccccccaaattgaataatacctgatttctgtatcttcagcatatccttttttttgtttcatcatgacttatatttgcaataaatttgagaagaatgttaatattcattgtttctgatttctaaggacataaaggggatgtcttgggaaaaaaattcacaaaatgccccttggtacccagccaactcttttcataatctgtttttgagatttttwaaaaaaactatgcataactattgatttcttatgaagtgtcacataaagaaagtaaaatgagacagtttcagaaaaaaagtatggtaaattcaggaattgcacacctttgcacaagagttgtcaaaagcacatgataaaaaatttcaggtggtacaataaaatattctggcttttttgttctatatataggagtgtggcttttattttgatacagaagtcaagtgggtggcaatatccacttaaaatctctaaagagctgagtgattattcttaatatatttgcatcttccttctccagtc

SEQ ID NO: 151705 - DNA, 601 bp, Human
tagtatccaagttaagtacttattttttttttttttttttttttttttgagacggagtctcgctctgtggcccaggcgggagtgcagtggcgcaatctcggctcactgcaagctccgcctcccgggttcacgccattctcccgcctcagcctcctgagtagctgggactacaggcgcccaccatcacgcccggctaatttttttttgtatttttagtagagacggggtttcaccgtgttagccaggatggtctcgatctcctgacctcgtgatccacccgccttggcctcccaaagtgctrggattacaagcgtgagccaccgcgcccggccaagtacttatttttgttgaacaatatttgtagtaaaaacaatatacagaatttgctagtactacccaataatacatacatacatactaaaatctttagctgctgaaatgggtatggaatattagttgtgttcaacaaaatatccataatgggataaattactattttctaaaatgttgcagcagaatacattattgctatagagtttggcctagtgattaagtaaataaacaaatatacttcttataaacatattaaaaatatatgaca

SEQ ID NO: 151706 - DNA, 601 bp, Human
agctactaaaacaaaggatgctttaccaattttataaaagaatatcgagaaggatttaatagagtaacaattttattataaacctgttgaagctaagccagcttttcatacattatctcttattcagtagagattcatactggatgtgttttatcagtaatgaatatggatcagcctattgaaatatgaaagttgacttctgtttcttttcaaatttattgtacgtaataataaagtatactctgacattatgtagtatccaagttaagtacttattttttttttttttttttttttttttgagacggagtctcgctctgtggcccaggcgggagtgcagtggcgcaatctcggctcactgcaagctccgcctcccgggttcacgccattctcccgcctcagcctcctgagtagctgggactacaggcgcccaccatcacgcccggctaatttttttttgtatttttagtagagacggggtttcaccgtgttagccaggatggtctcgatctcctgacctcgtgatccacccgccttggcctcccaaagtgctgggattacaagcgtgagccaccgcgcccggccaagtacttatttttgt

SEQ ID NO: 151707 - DNA, 601 bp, Human
taaacttacttggattccatataaattgcacgtgtaccttaaagaaaaggctgtttcttcctatcagatgggcagcatagcttagataaatgctaatttttctcacaattgtgaatactgtgattctgtggtatttcgctgggaaaacattctctcaattttattacgacctatattctattattttccatattgaaagctcagaaggtgtccaggttaaatgaagatgaacagcaatttgtgcattttttttccctctgagacaatatgcttcttacaggtagagacgatgccttttgcrttatttaggttttcaaagcacttagcacagtgcttacaaatgggcagctctcaatattacgggataaagtaaactaaaacaaatcattgctttttggaattacttttctttcttttttgaaggtggattagtcctctgaatgtagatattatcactctaaggattcaacatactgggtgggtgttaaaatcggaaatgctttcttcatatactggcaggcttaaaaatatataagaatcagctcttggaggtaggggaaatactatatttggaatgaaaaccacatttataaagtcacaa

SEQ ID NO: 151708 - DNA, 601 bp, Human
gcatttcctggctgtaagatctgtgtttatgcatccttggtattgtgcttgcttttgtcaggtacgacaataatcctaaattaatgagtccattcaacattggctaccagagaatttcaggcaccttttatacagtcatttaaaataattacactgcctgaattgtctgagtagactggaagtgccttctgacctgacaccctgctgttcagactaatactgagcaagtgagtcacctggcaggttgagcaggagcagctgggctagctgggggccaaacttcaagtgcctccccatagcracttttctgctttggccaagagggatgtgaataaaatagcttcaaagtggagtccttctcactctgcaaattcattctctggagtatggcaaagaatggcttctgcattttattgatcttgcagctgacaagtaagcagtgcctcaagatgtctcgcatcttgttcctgagtgtgctgattaagcctttcaaataagtgagatgcacagctgaatccgcaacaggaatgtactgctttcatttgctctatctcaatatccagacatcttcagaatgaaaggatttcaaattaaaaccatg

SEQ ID NO: 151709 - DNA, 601 bp, Human
gtctgcatttcctggctgtaagatctgtgtttatgcatccttggtattgtgcttgcttttgtcaggtacgacaataatcctaaattaatgagtccattcaacattggctaccagagaatttcaggcaccttttatacagtcatttaaaataattacactgcctgaattgtctgagtagactggaagtgccttctgacctgacaccctgctgttcagactaatactgagcaagtgagtcacctggcaggttgagcaggagcagctgggctagctgggggccaaacttcaagtgcctccccakagcaacttttctgctttggccaagagggatgtgaataaaatagcttcaaagtggagtccttctcactctgcaaattcattctctggagtatggcaaagaatggcttctgcattttattgatcttgcagctgacaagtaagcagtgcctcaagatgtctcgcatcttgttcctgagtgtgctgattaagcctttcaaataagtgagatgcacagctgaatccgcaacaggaatgtactgctttcatttgctctatctcaatatccagacatcttcagaatgaaaggatttcaaattaaaac

SEQ ID NO: 151710 - DNA, 601 bp, Human
cagcaagcttcaatttcagtgaacatttaataaatgtcggtagagggaattacttctaaaaaataaatatgaaaggtaaataaacaatacaaatggcaggtaatatggtaccattttatttgtatacttcatttttaattaaaaatcatttacacttacacttacatgctctcaaaggtacacagatatagaggccttctttagaaattttttttatgatgagtaaagaagagcacttgtttactatttaaaaaaaatgtaactgatagtggtctgtctgggtctcttctctttcaaatcrctgccacacagcattaccaggtatttctgaaattccccattgttacctctagagagggcatagtggcaattcgatcaatgctgaatacaaaaatagaatacggtagtagaatatggtagtctgcatttcctggctgtaagatctgtgtttatgcatccttggtattgtgcttgcttttgtcaggtacgacaataatcctaaattaatgagtccattcaacattggctaccagagaatttcaggcaccttttatacagtcatttaaaataattacactgcctgaattgtctgagtagactg

SEQ ID NO: 151711 - DNA, 601 bp, Human
ctaatacggataggcaaattctgttcttattaatttattgacctctaagtatatgctcatccacccatcactccatccgttcatttaattcagttttgaaaatacgtgtttattgaagcccttctacatatttggcacttttctaggtagtagtgacatagggataaataaggcagaaaaggtctatgctcttaaaagattcacattctagtggagagacaaataataaacaaacacttaaacaagaaaataccatgaagtggtatgtgctatgaaggaaaaaaagaagggtgaatcaagygtgggtgtcaggtgatcagagatggcctttctgagaggttacaccaagtctcatctctgaatgggaagaaggagctggctatgtttacagtactggtttcctcaaggggcttcagtgtaatggggagacacagagaaataagaacatttttatataatatggcagatattgtgttggtgaatgcagaagattcagtgggagaagagaagagggaataataacctagcttggggctctgggaatgattcccggaaaagaataggagcttgcatagtggagagaggagacaggatagacaca

SEQ ID NO: 151712 - DNA, 601 bp, Human
agtttgaaaagtgtacccacatgtgttttctcatataatctttgaaataatacttcaagaaaaaaatgttttcaggactatttcatgaattagaaaaattgtgaggatggaagttaagcttgtaaaagatgactgtgtaatttaatgtggagagttcagtaattcttcaaaatttgactcggatcttttccttctgctatattatgtgaagcatacatacttatgcatcctaggggaggcaacaggaacattaacatggaatgaacatacaagatatcactagtaacactgaggatgtaayggagttttcacaagttgggatccactgcaacagtacataatgtatggcactgatatggtatgcctctgtgtccccacctaaatctcatgttgaattgtaatccctagtcttgggggagggacctgatgggaggtgactggatcatggggacgggcttcctctttgctattctcataatggtgagttctcatgagatctggtggtttaaaagtgtgtggcacgtctctcttcacactcactcctgctgccataggaagacatgcttgcttcccctttgcccttcccccatgattgtaagtt

SEQ ID NO: 151713 - DNA, 601 bp, Human
tactttttaaaatcggggttatgatgacacttaacttatcagttgtgaagaagacaagataatgaaagctttgcttttggagctataaattgctgaaaaaataatgagcttggttctgtaaggttattttcatacttctttttagaggacctcaactgaagtaatcctggctttttagcccctttcgagtaggagctaggtatttctcactgttatatccttagatgctcatggtggcttgtacacaggaaaagcccaataaatatgcactgaacgttgttattgggggctttttttgctyctaaacagtaaagtaataagcaaatccaagccttagatttatttcactctgcgaagttgtcacaacagcagattttcttcactaatcatgtggaccacaatcaaatggatgtcatcacaataaaaagttcaaaatccaatttccttttgcctgtgctatccacttcccccatatcctattaaattcaacagttataaaaaccagtgaaggaattacaattcagaatgcaaatgaatatacacctaagattaagtgaccttaagcaattaataacaggatgcttaaaaagaaagataatat

SEQ ID NO: 151714 - DNA, 601 bp, Human
ttggctatgaatattaatgtctaaagttttatcatgaccacagtcctacaaatgcatttcaactagagtgattaaaaatgtctctggaatgattattcattagtaaatatgatataattattttctattattctgtgcatattttaaaccttaatcgatccttcacaagtgtgataaaactgtatagatgtgccatttccactatctggagttcattttgcacatgttgctatagattgaaaaagtcaagtgtaacttaagaagcaattttaacaacttcatgtaaatataaattcataawacaaaacaagaacttcaggcaaccttattagagctctatagataaaagaaatgtttatgagacatataagaatgcctaagaaatctgaacaaagaaagtatctgaaggagattttggcccagtttttcaagtatggaagtcttgcctcttagccataaatcaattttcgtttataccaaatgcctgtaaactagttcttgtatagtacacctaattatgtcacatcagggatttccatgtttctttgacttagaatacgtagtaaacagatagaacagatcaatcacctaaactaatcaa

SEQ ID NO: 151715 - DNA, 601 bp, Human
gcataactgggtatatacccaaaggaatataaattgttctatgataaaggcacatgcacgcctatgttcactgtagcaccattcacaataacaaagacatggaatcaaccgaaatgccaatcaattgtagactgggtaaagaaaatctgatacatagacaccatggaatactatgcagctgcaaaagagtcagatcatgtcttttgcaggaacatgaatgaagctggagcaaactaattatccttagcaaactaatgtgggaacaggaaaccaaatactacatgttttcccttagcaccasttacagtgggtgctaaatgatgggaacacacggacacatagaatgaaataacagatagtgggacttacctgagggtgaaggatgggaggagggaaaggactaggaaatataactaatggatactaggcttaataccagagtaacaaaataatctgtacaacaaaaaccccatgacatgaagtatacctatataacaaacctgcacatgtacccctgaacctaaaataaaagtttcaaaaaaaaaaagaaaattggtaaagttttgtaaaaaataacattaaaaatatattattaaagaac

SEQ ID NO: 151716 - DNA, 601 bp, Human
catctgataaaggtctaatattcagcatctataagaaacttaaattttcaagaaaaaaaacaaacaacttcattaaaaagtgggcaaaggacataaacagacaattttcaaaagaagacatacatgcagccaacaatcataggaaaaaaaccctcaaaatcagttatcattagagaaatgcaaatgaaaccacaattagataccatcttacaacagtcagaatggctattactaaaaagtaaaataataatagatgctggcaaggttgaggagaaaagggaatggttatacactgttggtrggagtgtaaattatttcaacgattgtggaaagcagtgtgaagattccgcaaagaactaaaaacagaactaacattcagcccagccacagcataactgggtatatacccaaaggaatataaattgttctatgataaaggcacatgcacgcctatgttcactgtagcaccattcacaataacaaagacatggaatcaaccgaaatgccaatcaattgtagactgggtaaagaaaatctgatacatagacaccatggaatactatgcagctgcaaaagagtcagatcatgtcttttgcaggaa

SEQ ID NO: 151717 - DNA, 601 bp, Human
aataaatgatgctgggatagtggttagccataggcagaagattgaaactggaccctttccttacactatatacacaaatcaactcaagatggattaaagacttaaatgtaaaatccaaagctataaaatccctgaaagacaacctaggcaataccattctggacagaggaaatggcaaatatttcatgacaaagagacggaaaacaattgcaacaaaagcaaaaaatgacaaatgggatctaattaaactaaagagcttctgcacagaaaaaggaactatcaacacagtgaacagacaacstaccgaatggaagaaaactttttcaaactatgcatctgataaaggtctaatattcagcatctataagaaacttaaattttcaagaaaaaaaacaaacaacttcattaaaaagtgggcaaaggacataaacagacaattttcaaaagaagacatacatgcagccaacaatcataggaaaaaaaccctcaaaatcagttatcattagagaaatgcaaatgaaaccacaattagataccatcttacaacagtcagaatggctattactaaaaagtaaaataataatagatgctggcaaggttg

SEQ ID NO: 151718 - DNA, 601 bp, Human
caccatggcatgtgtatacatatgtaataaacctgcatgttttgcacatgtatcccagaacttaaagtataataaattaaaaaacatctgataatatttcttagcgatacctatatttctttgagaaattgtgtttgtttttcaataaatacaccaattttgatttcagtctgaaaaattcagctcaatttactctgatagtttggaaatagtcctgttatgctattccatttaaattgttaaatatattattactattagaaaattatagaacatgagaacttaaggccctttttctttygccaaaaaaaattagtggaaaccaagtcatctcacttttagcttgaattgaaaacaaacctacaacaccaatagttttatttttaatttgtgtaatccttttagaattattaatattcaatctgagttcagtacattgctgattggacaacactacatatcctccaatggtaatttaatgacagttactagtccgacctgtgttgcaataaacatactatatttttgtatttgagagcttaaaaatactggtcataaagaaattgtaagagctgtgaattaggctaattatatatttttt

SEQ ID NO: 151719 - DNA, 601 bp, Human
aaaaaaaaaaaacttgtttaactgcatttaccaactctttaaatccagaaccagttatgagcattgtggtactattaataattgcatgctgaacatataaatgtaaaatggcaatttcaattttcgtttcatcaagacaatgaagaaaatgaaattgaatactaattagtgcatgtttgtcatacacctgaaagattagggggttactgtgctcattataagtgagtttaagcgaagtactcaaaggtttcatttgaaggactgaatataaataatagacttaggtgacaagggaaattamcaatgaatgatcaacacagaaactctggtatatcatttgatttcacagaatgtcttataggtgatttaatcttacaaaattgataaagttttttcttctaaaaaataacttagaaaatatgttattaaagaatgcattaacaaaatatatattttgaacataatcagtaagtaattactgaataacaatgttgagactaagaaaattactcaaaaccatatgatcacatggaaattaaataacctactcctgaatgacttttgggtaaataagtaaggcagaaatcaagaagttatttga

SEQ ID NO: 151720 - DNA, 601 bp, Human
aaaagaaaaacacagagaaattgacactgcatatcttgaaaataaataagaaatagttatactggctgaccctcagttagttagcaaagcacccagaatttaaaatacacttgttataatccaagacatatttctataattgtgcaaagttgctaattctaacatgttaatcagaaagaaaaactgatattctaggatgctgatgagctaatgtttaatgtagtggttaattattagttggaaaaaatctacataaagaaataaagctccaaaaaactagaaatctgaaaaaaaaaaaaaacttgtttaactgcatttaccaactctttaaatccagaaccagttatgagcattgtggtactattaataattgcatgctgaacatataaatgtaaaatggcaatttcaattttcgtttcatcaagacaatgaagaaaatgaaattgaatactaattagtgcatgtttgtcatacacctgaaagattagggggttactgtgctcattataagtgagtttaagcgaagtactcaaaggtttcatttgaaggactgaatataaataatagacttaggtgacaagggaaattaacaatgaatgat

SEQ ID NO: 151721 - DNA, 601 bp, Human
taagagagttccaaacccaattttctcagtgataaaatactagaactgaaaaaacaactggtgaattaactttcgaaagaaaaattgtgacattgccctagtattatactatatcatacacatcaaatatatcagcacacaacggtaatacatagtataatggaaatttctttccttgtattatgtaaatattatgttaatgtagtttttactttaataaaagtcctaataaaaataggctgtttggatataatataattcaaatggagtagttagcaaaccatgtaaggccaggccacayatgttttgtgttatgtttacccagcttacttttatcttttctggattcagagcatcctgaaagtaggtgttatcttttctctactgcctagtagtggatagagtgtagagtacacattcatgagtaaatgtttgtggaatacatgaataaattaatagctggaaattcaatgtatatgtattctagaaaaacacacataaacacatatatataaataaaaatcaacccataaatttaaaaaataaaattaatattttactacaaatagctataaaagaaaagaaaaacacagagaaattg

SEQ ID NO: 151722 - DNA, 601 bp, Human
aatccccaagacaatgggggaattgtctccacagcatgttagaggtcttcatggcagcccctcccatcataggcctgaaggcctaggaggaaacagtggttttgtgggctgggcccagggtccccggtgctgtgtgcagcctagggacttggtaataaatcgttacaaatttctgtagtacaaatttcacatacggatttttttatgaagtcaataattggggtttgggaaacactgcctagatttcagaagatgtatggaaatgcctggatgcccaggcagaagtttgctgcaggggtgrggccctcatggaaaacctctgctagggcagtgcagaagggaaacggggggtaagagcccccacacagagtccccactggggcaccacctagtggagctgtgagaagagggccaccatcctagagaccccaaaatggtagatcccccaacagcttgcaccgtgtgtctggaaaagccacagatgctcaaaggcaacctgtgaaagcagccaggagggaggctgtaccctgcaaagccacagaggagaagatgcccaagaccatgggaacccacctcttgcatcagcttgacatggatgtga

SEQ ID NO: 151723 - DNA, 601 bp, Human
atcgcttgaacccgggaggcggaggttgcagtgagctgagattgcaccactgcactccaggttggcgacagagccagactctgtctcaaaaaaacaaaaaaaaaaagaaaaaagaaaattaaaattttatgggatataacagttacttaatatagccttaagaaaatccaagactgccccacagtcactaacagtgtccactgctccccctcaaaataaaagggaactaccaagagttgtcaaagagaggatagtgaagaggttacaaatgctttagggctgcccctcacactagctgccygggtttgactcccaacttttcaacttactaagtttagtaaacatagacaatttatttagctttctgtgcctagatttctccacctgaataatggggataagaacaatactggttagacggaattacagtcaatacatgcagagcagttgaaactgcagcacatagtgctgaagtgctaactgttagatcttaaagctaatacataacactacggacaatgaaactaatttctaacctaaatatggaaaatatataactttttctacaattaagtctaactacattcaattagttttaagc

SEQ ID NO: 151724 - DNA, 601 bp, Human
agctatagtctcagaaactgttttgatgaaaatggaaataggagaagatgaaacttcatttagaagttcccaaatgttccctaactatctctttcaactctaagtggatgtcactcaacctcccactccactagatggggccatgggactcataaatggccaacggcttagaagcagaagtgtcacatggcagtggtgtccatttaatccacttccactctctatccagagcaacaagtaattttccaactcaatgctatacacccttatcaggatttttctccaagttaatcaaaaagcygatgaactccttttcttgaatttgatagatatcttagtagttaatgatgcatcctcaagctctcttagtatttcatcttttatttttatttcaacagctgccagtctagtttaggccctccttatatctgcctccaggcagttagctgtaaaagcctcctagctggtatccttgctcataggttcccctctctctaaagcacaattcaacaattattccattaaattttactgaaagcttcatcagcactaggcattgtgttaggtattcagaacacggaccacttacatgtcatcttcc

SEQ ID NO: 151725 - DNA, 601 bp, Human
agaacctcaaagttcagtgtatctcttctctagagtcctgcaaaatgatactttcaggtgagctatagtctcagaaactgttttgatgaaaatggaaataggagaagatgaaacttcatttagaagttcccaaatgttccctaactatctctttcaactctaagtggatgtcactcaacctcccactccactagatggggccatgggactcataaatggccaacggcttagaagcagaagtgtcacatggcagtggtgtccatttaatccacttccactctctatccagagcaacaagtarttttccaactcaatgctatacacccttatcaggatttttctccaagttaatcaaaaagccgatgaactccttttcttgaatttgatagatatcttagtagttaatgatgcatcctcaagctctcttagtatttcatcttttatttttatttcaacagctgccagtctagtttaggccctccttatatctgcctccaggcagttagctgtaaaagcctcctagctggtatccttgctcataggttcccctctctctaaagcacaattcaacaattattccattaaattttactgaaagctt

SEQ ID NO: 151726 - DNA, 601 bp, Human
tcaacaaatattcattcatctactgtagatttgagactcagaaaaacattccaaaaagtatcagataatgcattgatgtttcaaaatttatgtacatctttccaaatccaggctaatgcatgctcttaaaaaaaagaagctaagatacattggcaattctatttaaatgtctgggttttttgtttgttgtttgttttgttttgttctgtgagaatcacattttggtttaagagcttctggaaagctgacattatgtaaaaatactggcttaggctgggcccctgcaaagaaaagtaagatwaaaatattcacatatacttctaaaattcagtacttcatctcttaacaacactaatgatagtaataaactaaggagacctgcattgaacatagtttttctttttttaatctgagaaatgaaaatacagcccatgtattatgaattcagagaaataaatgtttcaaagtgattgaagcattaagtatataatagaagcaagaaaatgtgacaggctatttgtggggggaaaaaggagagcttgattattttcttcaagagccaaaatcataacaaaataaagtgatctataccaagtacact

SEQ ID NO: 151727 - DNA, 601 bp, Human
gcaattggcacatgggaaataataaatatattgaatgaatgaataaattcattaatttaaatgaagttgggggtctcttgggaatatgttttttctaagcatggaaaaaaagaatgaagtacccttcaagaagtcccatgtggctggaactcacagagtaaattcctcacatttcccagaacataattgcttgttgaatgaaatcaaatagctttttctctctgaaatgtccacagaatgaagtagaaaacttccatataagataatttgaaatgttttctccactccaataagcccacawgggcagagaaaacttatatattgtccaaatagctctctacaaatagtagctgctcaacaaatattcattcatctactgtagatttgagactcagaaaaacattccaaaaagtatcagataatgcattgatgtttcaaaatttatgtacatctttccaaatccaggctaatgcatgctcttaaaaaaaagaagctaagatacattggcaattctatttaaatgtctgggttttttgtttgttgtttgttttgttttgttctgtgagaatcacattttggtttaagagcttctggaaagctg

SEQ ID NO: 151728 - DNA, 601 bp, Human
tgacagtcaatggccagtagaacccaggatcactgatcttgaacatcctcttccttcaccatataatataactgcttatgtaaatgtgcttcacttgcattacatttaaacatccagagaacaggtaatgtggtttatcctcactttatttattaatgcattcaaatatatttactgagcaaataaaaaatattctcagtcttggggatatgaaaacattatgatagcatatctgtttcatttttttatgaaaggttagtcactagtcaccagtcactgagattgacgagaatacaaagasagccaacaaatagtattcctgccctcatgcagcttacctaataaacaatatcttacatagtctaattactagctgcggcaagggctgtgctagaaaagaacaagaagctgtgaaaatatatattagaatggaatctagttgaggagagggatagggttagggaaagcttccctgaggaactggcatctatacagcaattggcacatgggaaataataaatatattgaatgaatgaataaattcattaatttaaatgaagttgggggtctcttgggaatatgttttttctaagcatggaaa

SEQ ID NO: 151729 - DNA, 601 bp, Human
tagttggaaatgcagaaatcaactaccttctgtgttggtctcgctgggagctgcagaccagagctgtttctattcggccatcttggcccctccaaaaagggcttccttttttacacttaagaaattgttaagggactagcactatcatattctgccttgaatctagtcgtgaacatggtattttgctgactcatattaggtatgagacagttcagttgtgagtgacagaaaacccaaactaactatgtcttaaatagaaagaggcttcttatttgggtaaatgtgtgactacgcagaaggkgctgataaatcagggccccaggtatcctctgtctcgttacccagtgtatatacctgatcccacggtccaagatggcagcctctgagttcctggaaggatggaggcagggatgaagaggggagaagaggatgtgtggatactctctgttaaaaaaaaattcctaggaaccaccatgtgacacttttgcttatatgcctttgaccatttgagagtctcatcaacaatagttggccacatctattgttgggaatgagaggttgggaaatatatttagctaataatctctttaatatgaaaaca

SEQ ID NO: 151730 - DNA, 601 bp, Human
tcaccaagctcatcaacccaggtggacttcattcaggctgctgtgctggcagtgagaatttcaagccagtggttctcagcttgttgggctccatgggagtgggacctgctgagtgagaccacttggctctctggcttcagccccctttccagaggagtggccggttcttctgtctcactgggattccaggcaccgctagggtacaaaaaaggacctcctgcagctagctcagtgtctgcccaaacagccgctcagttgtgtgcttgacacccagggctctggtggtgtaggctcatgaggraatctcctgatctgcggattgcaaaaatccgtgggaaaagcgtagtacccaggatgggtagcacagtccttcacggcttcccttgttttgggggagggcaggtcccccggctccttgcgctttctgggagaagcgacgtcccaccctgcttctgctcgctctctgtgggttgcacccactgcctaaccaatccagtgagatgaactgggtaccttagttggaaatgcagaaatcaactaccttctgtgttggtctcgctgggagctgcagaccagagctgtttctattcggccatcttgg

SEQ ID NO: 151731 - DNA, 601 bp, Human
ttggcactgtcacgggaaaaccacctactaaagcctcagtaatggcggatactcatcccttcaccaagctcatcaacccaggtggacttcattcaggctgctgtgctggcagtgagaatttcaagccagtggttctcagcttgttgggctccatgggagtgggacctgctgagtgagaccacttggctctctggcttcagccccctttccagaggagtggccggttcttctgtctcactgggattccaggcaccgctagggtacaaaaaaggacctcctgcagctagctcagtgtctgcccaaacagccgctcagttgtgtgcttgacacccagggctctggtggtgtaggctcatgagggaatctcctgatctgcggattgcaaaaatccgtgggaaaagcgtagtacccaggatgggtagcacagtccttcacggcttcccttgttttgggggagggcaggtcccccggctccttgcgctttctgggagaagcgacgtcccaccctgcttctgctcgctctctgtgggttgcacccactgcctaaccaatccagtgagatgaactgggtaccttagttggaaatgcagaaatcaactac

SEQ ID NO: 151732 - DNA, 601 bp, Human
aatctcttaacacgtcccctgatacaaaagattcattgcagtctgtaatgacgtttacctggaagaggtcatatcttttaatccttccagctgcttatacatttctatagcagggatgaatttttaatttgcattgtattttcatgggcatgtgggtactacgtttaaatatttaattattttaaaaataaaataggaaagataaaatagcttaaagtgtattgatgctctgaataactttatgagtgaatagatactgaaatttgaagtcagtgttttgcacaacaaatcaagatttggkactggacttactgggttggggacttcttagggataacggtggtgctatgagcatgctggaaagatgagaagcaaaagcctggaattgggagtcctgtactgtctttagggtatgcaaagaggctccttctttctaggtgttcatcagtacaatatgaccactgaagggcaaaatttcctgtcttgaccccaggatgttaaaagaaagaacaataaaagttttgtttcttctaagcaaagttttgtgatctaacagttgatgactctagccaagagcaagatgtttgtcttctgaaaacca

SEQ ID NO: 151733 - DNA, 601 bp, Human
actacactccagcctgggtgacagagcgagactctgtctcaaaaaaaaaaaaaaaaaattaactcaaatataactagtcctagtggctacagtagagtctctcttaaaccacctccaaatcagcaacaacctgagcactgacactcttcactgccgctgtgaaacataattgctgctctacacatctggcactttgggctgttctctgctaagccaactctcttctgttcttgcagattaattgcacgctcatcaagggtcatttgtgtttgttccccaatctgttttcttttcaagttgkgattgttattctacttatgtaatctaattaaacacaattgataaaatgtgactggaaaagaaaaggtttttttctataaaaacatgaaaaagctttctgaaaaacctcaaaaaggcatagtactaaagagtctataatattgggataattaattgatatctaggattctatacttgaataacttcaccaatatgtttaaacaatgaaataaaaagaagtatcaattataaatttcttgacgtagtttatctaagaaacatagtatggaatttaaatgcttttttattttaatcaaggttt

SEQ ID NO: 151734 - DNA, 601 bp, Human
aaaaagcacagttaaaaaagttacagggatttgcaactcccctgttctttcacattatcttattaatataaagtattttatcaaatgcatcattaacacattctgtgaaggcttgggtggtgagaagcatcatgaacacacctaaggaggaaggctttggaggtgtttaaggataaaaagagtaactctggttcacgcctgtaatcccagcactttgggaggccgaggcgggcggatcatgaggtcaggagatcgagaacatcctggctaacacggtgaaaccccgtctctactaaaaatmcaaaaaaaaaaaaaaaaaaaaaaaaaaaaaaatagcccggcgtggtggcgggcgcctgtagtcccagctactcggtgggctgaggcaggagaatggcgtgaacctgggaggcggagcttgaagtgagccgagatcgcgctgccactacactccagcctgggtgacagagcgagactctgtctcaaaaaaaaaaaaaaaaaattaactcaaatataactagtcctagtggctacagtagagtctctcttaaaccacctccaaatcagcaacaacctgagcactgacactcttcactgccgc

SEQ ID NO: 151735 - DNA, 601 bp, Human
aaaaagaaacaagataattaaatacacacagtaccatgtatgtaaatttaaaaacacaccttatgatataacatcatgtactctccaataattgacttcaaatcaacacaaagaaggtagaatgaaaggttacacatcagctactaggttgggctcacatagaggaagaggaataggaaggaaggtgggaagagaataacaatttaatattaaatggcaagataccttacccagactgatgataataatgtgccttgaaatagggaggtgaagtcttacatcagtgctggcaggtgagatmtgaagtgggggaaaaatcattggtttctcctttacttctctattctcaaggaaaatgacttaagtatggccatattatgcaatagcacagttacctacaaaagtgataggaatgttgaatacagaggtcctaaatccattggaattttttgggtgatagaaacctcttttgttctaatgtggtgactcttgataggctcctgaatagccttgggatgagagtggtggccaagggaaccaatcaggtgattggagggttggaacttcagccccacccctgccccgtcctctaggaagagga

SEQ ID NO: 151736 - DNA, 601 bp, Human
tttccctgaaaaacttttgcataagtgctcaagaagaaatccacacacatatctattgtaataacttttatgttagcaaaggagagcagcttaggtgactatccccagaggaatcgaatattaaaatataaagtgtacctgtgtgtatgtgtgtgtgtgtgagctctcacacaataaatatactctctaagaatcagaaatgatgaactgggtttttatacggatatctaaaaaacataagaatatgtgaaaaagaaacaagataattaaatacacacagtaccatgtatgtaaatttaaraacacaccttatgatataacatcatgtactctccaataattgacttcaaatcaacacaaagaaggtagaatgaaaggttacacatcagctactaggttgggctcacatagaggaagaggaataggaaggaaggtgggaagagaataacaatttaatattaaatggcaagataccttacccagactgatgataataatgtgccttgaaatagggaggtgaagtcttacatcagtgctggcaggtgagatctgaagtgggggaaaaatcattggtttctcctttacttctctattctcaagg

SEQ ID NO: 151737 - DNA, 601 bp, Human
gaaaatcttcactattaaagaaatgcaattttgttaaaaaaagatacaacaatttacagccaacagaatggcaaaacaaaaatatcaaataatatcaagtattggtgaagtattctgatgctgatgatgggaatgtaaactagcatagccatttctatctgttagttgttagtaaaattaagcaaccctatttctgggtatttttccctgaaaaacttttgcataagtgctcaagaagaaatccacacacatatctattgtaataacttttatgttagcaaaggagagcagcttaggtgastatccccagaggaatcgaatattaaaatataaagtgtacctgtgtgtatgtgtgtgtgtgtgagctctcacacaataaatatactctctaagaatcagaaatgatgaactgggtttttatacggatatctaaaaaacataagaatatgtgaaaaagaaacaagataattaaatacacacagtaccatgtatgtaaatttaaaaacacaccttatgatataacatcatgtactctccaataattgacttcaaatcaacacaaagaaggtagaatgaaaggttacacatcagctactaggtt

SEQ ID NO: 151738 - DNA, 601 bp, Human
attggtctattttgcactttgaatggatttttcacccatgcatggttttgtaacattatacattggtcatttgcaacatactggctcaccgagctacgtagattttctaagcgatgacacatttcactatataatacaaaaacttgcactgattaatatcaccaccaatttcatcagaaaagtttttaattattggaatgtatgaaactcacattgatagttacaagttttccaaaattataaatttcacttgaaatttccaattttataactagcaacaaagactgtcagctgttttcaytgatgtggcaggattgctgtattcattttcaagacaatatctgcctgatacccaggtatgaataactatagttggtctgtcagttgttctttgaagtaaacatgatacaaaaaagtaggggaaaggagttgtttaccttgaaactcacacaatcttgcaaaggcttttcctgtagacaatggtcacatttcagtactcagcaaaagtgctttatgcataaaccccttttcatcacacagaatactatagacttaaaaaggattgacatttaataaaataatagaattagttatcattact

SEQ ID NO: 151739 - DNA, 601 bp, Human
ctcatattgggagatgatgcaactaacaatttactttgaaaattctagagacgcaagaaatagtaaaaactaatttaaaagttctgcaagtttgcttaatagaagatcaacatataactattctacaccagcaattatcgactgaaaatataatcaaaatagtgtgataccggcacacatggagacagatgaatagaacagaatagaaaaccaatagactccaatatgcaggaaacttttgtatatgaaataaataatatttaaatgagaggaaaaaagacagagtattaaataattgggrcaatttgatagatttctcaaataaatttagatcattgcctatcatcctatcccaaaataagttccacaaaattatcagaggaaaacacagaattaaaaacaatctcagagataaaaaaatgggtttctattcatgacactagatttaaaaatgttattaattaaagtaaaaatttctgcaagattaaaagcaaaataaatacaaatgacaaatggggattaaacttttacaaattatatcatagcaaatggttgatcaatcaaagatattagattatacatattgatagataaaacacaa

SEQ ID NO: 151740 - DNA, 601 bp, Human
gtggggcttcaggaactgtaaacgtttacccctagaagctgctgtggggtcagagcccacgctcccaatgacctgcccatctgtctcctccccctaagggttttgcacagtgagacactgaagaagggagccacatcccatcacacaccttgcaagggggacaagggaacttttcccgtttcaataacaagcatataaagataattttgcaaacaactttcaaagctatatactaataagacatttagggctactatggttaagagtgtgtgtgtgtgtgtgtgtgtgtgtgtgtgtgttgaaatctaatcatgagtcttaccatggggggtgggattaatgggttcttgacaagacagcaactagcatgggctactggtcctctctactgaatccagcacttaagatgccctggaacagaacattgctgagcaggctttgaaatttatcgtacttgaacacaaaaactatggtaaagccttagtgtaagtggaaatttgagatcccagtgtatgtttgtgtagctggggtttattgagggtaactccaagggctcataaaggttatcaggcttgggaagaactttctaaatgttctattt

SEQ ID NO: 151741 - DNA, 601 bp, Human
ggtggggcttcaggaactgtaaacgtttacccctagaagctgctgtggggtcagagcccacgctcccaatgacctgcccatctgtctcctccccctaagggttttgcacagtgagacactgaagaagggagccacatcccatcacacaccttgcaagggggacaagggaacttttcccgtttcaataacaagcatataaagataattttgcaaacaactttcaaagctatatactaataagacatttagggctactatggttaagagtgtgtgtgtgtgtgtgtgtgtgtgtgtgtgtgtgtaaatctaatcatgagtcttaccatggggggtgggattaatgggttcttgacaagacagcaactagcatgggctactggtcctctctactgaatccagcacttaagatgccctggaacagaacattgctgagcaggctttgaaatttatcgtacttgaacacaaaaactatggtaaagccttagtgtaagtggaaatttgagatcccagtgtatgtttgtgtagctggggtttattgagggtaactccaagggctcataaaggttatcaggcttgggaagaactttctaaatgttctatt

SEQ ID NO: 151742 - DNA, 601 bp, Human
cggtggggcttcaggaactgtaaacgtttacccctagaagctgctgtggggtcagagcccacgctcccaatgacctgcccatctgtctcctccccctaagggttttgcacagtgagacactgaagaagggagccacatcccatcacacaccttgcaagggggacaagggaacttttcccgtttcaataacaagcatataaagataattttgcaaacaactttcaaagctatatactaataagacatttagggctactatggttaagagtgtgtgtgtgtgtgtgtgtgtgtgtgtgtgtggttaaatctaatcatgagtcttaccatggggggtgggattaatgggttcttgacaagacagcaactagcatgggctactggtcctctctactgaatccagcacttaagatgccctggaacagaacattgctgagcaggctttgaaatttatcgtacttgaacacaaaaactatggtaaagccttagtgtaagtggaaatttgagatcccagtgtatgtttgtgtagctggggtttattgagggtaactccaagggctcataaaggttatcaggcttgggaagaactttctaaatgttctat

SEQ ID NO: 151743 - DNA, 601 bp, Human
aaaataatctcagtgtcattactataaaactctattgtcaacataactattaatgtgtataaactgatttaagcttctagaaatttccatttacaataaaacatgacaatttcactgagatctttgaataccagaattttaaaaagtaaagacaaaaatgatgtccaaaccaaaaacaaacaagtatcccttaagtttctggatctttacactgtagtctgtggagcattttttaaaaaaattaaatgattgcttttttcttcattttattataagtaaaatttctaactggaattttctstctccatattttctccccattccaaatccctttacaacagtttgcttcaggagtaacatacatcaaataaaattgttaatattcttctcatgtttaatagagatatctttttgacacttaacacttaataactaaatcaaatgctacaatgtagaaaagtgccttattcatatatagtaaacattaaaatttcacatattgtaaacattaaaattaaaatgcctttatgatgtctataaaatcttttaaatgttcttgataaattgctataaatcaccctctccaaaaatataaattgga

SEQ ID NO: 151744 - DNA, 601 bp, Human
gaaaagaaaaggaagtattgaatataatattcaatacctctaaaatattttattttgctaagtaacaaatctttcttccaatatgaagcatataaagatatatatctcttctatcacttagtgcttttttgcttttaagaaaatagttttcattaatataatagttatctcattaaggagtgcgttaatcagccgggcgcggtggctcacgcctgtaatcccagcactttgggaggctgagaccggtggataaggaggtcaggagatcgagatcatcctggctaacacggtgaaaccccawctctactaaaaatacaaaaaattagccgggcgtggtggtgggcacctgtagtcccagctactcagaaggctgaggcaggagaatggggtgaacctgggaggcagagtttatagtgagccgagatcgcgccactgcactccagcctgggcaacagagtgagactttgtctcaaaaaaaaaaaaaaaaaaagtgcgttaatcacgaaagcaataaaaatgtatcattaaaataaagcttaattgtcatacaaaagactgtgtccacctgtgtcaaagtatttgtagcaccaccaattaaaat

SEQ ID NO: 151745 - DNA, 601 bp, Human
ctggtataatgcctgattaaatggaatgatctccagtcctgatatttttaaaattaaaattttcgatgaagaactaacaaaagaattgagaatatcataagaaaagaaaaggaagtattgaatataatattcaatacctctaaaatattttattttgctaagtaacaaatctttcttccaatatgaagcatataaagatatatatctcttctatcacttagtgcttttttgcttttaagaaaatagttttcattaatataatagttatctcattaaggagtgcgttaatcagccgggcgcrgtggctcacgcctgtaatcccagcactttgggaggctgagaccggtggataaggaggtcaggagatcgagatcatcctggctaacacggtgaaaccccatctctactaaaaatacaaaaaattagccgggcgtggtggtgggcacctgtagtcccagctactcagaaggctgaggcaggagaatggggtgaacctgggaggcagagtttatagtgagccgagatcgcgccactgcactccagcctgggcaacagagtgagactttgtctcaaaaaaaaaaaaaaaaaaagtgcgttaatc

SEQ ID NO: 151746 - DNA, 601 bp, Human
agataattctagcaataaccaccactgaacaaaccttttaatacattattttatttcaatcatattcaataacctataaagtttagatatttttgtaagattctcaaatctaccacatgtatttttgagtttaatacggtaaaaattttggcttgcttgtccttgaaaaattatatgcatgcacatatgtttgtgtgtgtatacatagacacaaaatttcccagtcttggattgcaactgtgacaaaatgctctttacaatttttgtaatagaaagcatgattctatcatcatatgagccmggggctgagtcttctttatgtgaaactgttaaattttggtcaagtaactcacaaggtaagtttgatcatcaaagaaacaaagatgacaagaggacactcctccaacccaatactttctcctcacactctactgtctcccatttcccagctgtgtagccttgccctgttatttaacaactttctacctaaattttctcatctgtaagatggtgataataatagaaactacctcaaggaagtattctaagaaattacttaataaacataaagtacttagaaacagtgctggcacacagcatt

SEQ ID NO: 151747 - DNA, 601 bp, Human
acgagttacaactttagaaatgaatttttaaagagtaaaactagaaacggaaaagctggttaagaagcttctgtgaaacccaggtgaaagagggtggtagcactggtgatagaagtagcagtggggatggtaagatgggaaatgattttcagatatttgagtcattttttcatagttgaaattaccaatacttgctaaatcagttaatgttagtgtgtggagctggtgaaagagatgttagcaggaagataattgggagaagaagtgtgaccaggaaaggacattgggaaacatctgctaygaggatggaggaaaatagaaaatggtgtaagctaagtcagataacaggaatattttaagcaaggggtaatatcttaatgtcttaagcaacagtgtgttgctcacttatatgtcatcactacttatcatgttatatgatgctttctaggttcatcacaaacatttgttaaataaataatttaatttagtaagcactgctacttataaggttgggtgctgggatgatatattagaaaacatactccttatcttcaaaaagttcatagaacggtaataggagaaagacttacattattaccta

SEQ ID NO: 151748 - DNA, 601 bp, Human
aatgtcttatgaaatagaccaaaagatcatttcttaggtgggattgtgacattttccttcctgttagtcctttatattatgttaccctttatgaaatctgaaaaacgtttagtagatttaattatgaatagtaaattatccattttctatagtcaccaccaatacggcaatgaatacatacacaatgtattcattataacaaaatttgtagtattttactttaaaataagtttttagttaatccaagttaattctttgagtgcagtttgtttagttccgtgaacaaaaccaaaatgaatcmgcatatttcttcacaattaatagcatgatcattagcaatgtccctgctcctcatagaatgtctttaagcatcttaacaatgtttaatttcaatttgtctaatctgagcagaagtaaaaaagaaattaatctttctgttgaaagccagtgataacagacacaaaaacacataactgctttagtaaaaatacagtttcagtagagaagattggcaaatgataaattactcactttaaattattactactgggtaaagaagctgaaaaatctgatgctacctagatatagacatttcaaagtt

SEQ ID NO: 151749 - DNA, 601 bp, Human
gagcactggaagggatatacgattgttacaatgtggcaccacaaatttagagggcaagctgaatccacagaatctgcagagcctggctggacccaccaggagctcttattcaagacaagataagtgaccagagctatgctggtcaggactgggcattggagaggcttcctaatccaacagatatcccctgaaaaaaatgagtcacttcaatcattataatagtctagaaaatactgtggtaaaaatcatctcataggcttcctgacaagtgctgaatcccctttagaccactgactggctstgcaatctttaacaagcttctctgactcttcattataaagcaaacataacttagctcacggagagggctgctttaaagacaaaatgagattactgattacaattgattctaattttatttaaaagcctttacaaatgctcataatatttgaaacagtattcccaagttctaaattttactcattggcatattttcagttcatatttttagaagagaatggttaccattcttacagctatgctttgttgctacaaagataactaatacgccacaaacgaaaattcatttgcacacacagga

SEQ ID NO: 151750 - DNA, 601 bp, Human
tcaggagcactggaagggatatacgattgttacaatgtggcaccacaaatttagagggcaagctgaatccacagaatctgcagagcctggctggacccaccaggagctcttattcaagacaagataagtgaccagagctatgctggtcaggactgggcattggagaggcttcctaatccaacagatatcccctgaaaaaaatgagtcacttcaatcattataatagtctagaaaatactgtggtaaaaatcatctcataggcttcctgacaagtgctgaatcccctttagaccactgactrgctctgcaatctttaacaagcttctctgactcttcattataaagcaaacataacttagctcacggagagggctgctttaaagacaaaatgagattactgattacaattgattctaattttatttaaaagcctttacaaatgctcataatatttgaaacagtattcccaagttctaaattttactcattggcatattttcagttcatatttttagaagagaatggttaccattcttacagctatgctttgttgctacaaagataactaatacgccacaaacgaaaattcatttgcacacac

SEQ ID NO: 151751 - DNA, 601 bp, Human
agcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtggcaccacaaatttagagggcaagctgaatccacagaatctgcagagcctggctggacccacyaggagctcttattcaagacaagataagtgaccagagctatgctggtcaggactgggcattggagaggcttcctaatccaacagatatcccctgaaaaaaatgagtcacttcaatcattataatagtctagaaaatactgtggtaaaaatcatctcataggcttcctgacaagtgctgaatcccctttagaccactgactggctctgcaatctttaacaagcttctctgactcttcattataaagcaaacataacttagctcacggagagggctgctttaaagacaaaatgagattactga

SEQ ID NO: 151752 - DNA, 601 bp, Human
gctaaagaattataatagcggcataaaacgaacaaagacattagacatttgaaagtcacttcactgaggcatgttttccttgcacaaatgctaattgtattaattaaaaagaaatgaatgcaaaattttctataaataaattttattttgatatcagccagcaaatcaatacttcataaatgagagacatttacaatcataaatgtaaacaaaaagtgaactacctattattatagcattactggctttgaggaaatattacaaaagtctctaggataaaccaaagcaattgagccaggtragcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtggcaccacaaatttagagggcaagctgaatccacagaatctgcagagcctggctggacccac

SEQ ID NO: 151753 - DNA, 601 bp, Human
acagaaaaggctttgtctaggtccagaagacacactatgctaaagaattataatagcggcataaaacgaacaaagacattagacatttgaaagtcacttcactgaggcatgttttccttgcacaaatgctaattgtattaattaaaaagaaatgaatgcaaaattttctataaataaattttattttgatatcagccagcaaatcaatacttcataaatgagagacatttacaatcataaatgtaaacaaaaagtgaactacctattattatagcattactggctttgaggaaatattacraaagtctctaggataaaccaaagcaattgagccaggtgagcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtggcaccacaaatttagagggcaag

SEQ ID NO: 151754 - DNA, 601 bp, Human
aaagaattttaccaaagatcaatacagaaaaggctttgtctaggtccagaagacacactatgctaaagaattataatagcggcataaaacgaacaaagacattagacatttgaaagtcacttcactgaggcatgttttccttgcacaaatgctaattgtattaattaaaaagaaatgaatgcaaaattttctataaataaattttattttgatatcagccagcaaatcaatacttcataaatgagagacatttacaatcataaatgtaaacaaaaagtgaactacctattattatagcatyactggctttgaggaaatattacaaaagtctctaggataaaccaaagcaattgagccaggtgagcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtg

SEQ ID NO: 151755 - DNA, 601 bp, Human
tgggagtagtgattttcaggatacatcttggaaaatgctgatacaatttgttattcggagagaaagagaatgtaatttgttttaaaggactgcatttttaggacgaaattttcctaattagatcagttcaaaatcaaagcaggaaaagaaggtcattttgaaaactgggtctgtcgtcagaagaacccaaatctcgtagtggaactatctgaagaaagggtcatctggataatggaaattttgtgttgggctagtagttttggattcacaaaaaggactaggaaccaagagctctgcgggyggtagaaagcctaaggtggatgtcagctatggcagcaagctagacccatgtgtactaagaagccagaagtcgaagtggcagcagttggcaccataagagccagggcagttcctgaaacttcaacagagatgagggtgggctgccgagaaacaaccaattacccttcagggggcaggccagagctggagtgtaaagccaaagagtagatacattagtccattttcacactgctgataaagacatactcaagactgggtaatttacaaagaaaaaaaggtttaatggactcacagttccaca

SEQ ID NO: 151756 - DNA, 601 bp, Human
cattctatgtgatgtcagccacaggcagccatgaaaaaatggaactcaacagaaaagggagaaactggatttttgggtcaagttctgccatttgcaggattaagtcatgtaatgtcagcaaattgtatttttcatgttttgagacagggtaatttatacaaataatatgtacacattatacatgtgtatacatatgtacacatattattagaaagatacagtaaaaaaaatagaaaagccctttgaaaacaacaaagtgctatagaaatacaatttaattattacatgatattccaaagcrgttcctataggatattagggtagttatttttatttttattttttattttactttaagttctgggatacatgtgcagaatgtgcaggtttgtaacatagggatacatgtgccagggtagttcgctgcacctatcaacccgtcatctaggttttaagccccacatgtgttaggtatttgtcctaatgctatccctctccttgaccccacccctcgacaggcccctgtgtgtgatgtccccctccctgtgtccatgtgttctcattgtttaaatcccacttatgagtgagaatatgcggtgtt

SEQ ID NO: 151757 - DNA, 601 bp, Human
tagacatggggtttcaccacattggccaggctggtcttgaactcctgacttcaggtgatctgcctgcctcggcctctcaaagtgttcggattacaggcatgagccactgctcctggcctgacactatttttttaattgaacctattctactgagtaaaagtaaacaggcacacccctgcttcctttaaattttttttatttagaggacacaaagcatgagaggagaaaatatattggatacagaaatcttgttattcaaagagcctatagtatggcttgttaaatgaggaaaatctgtaaygcaaaaaataatgatgctttcatagcagagttcctattactcaacacgtgggaaagcctacaaaatgtctactgcttatgtttggtgtcccattttaaaacggtgaatatcctaatatgtattctacattaaagtttaatgtatgtcagaacctttcattggaaccagcagacagaaatttacttattaacatagagaaatgaacatagaaatgaacacagaggaggcaaaaccaaagcatgtgaatatctgcagaaggacaaactaaagttaacataaagacaagtagtagcgatgatc

SEQ ID NO: 151758 - DNA, 601 bp, Human
tgggttcaagtgattctcctgcctcagccccccgagtagttgagattacaggtgcccgccaccatgcctggttaatttttgtatttttagtagacatggggtttcaccacattggccaggctggtcttgaactcctgacttcaggtgatctgcctgcctcggcctctcaaagtgttcggattacaggcatgagccactgctcctggcctgacactatttttttaattgaacctattctactgagtaaaagtaaacaggcacacccctgcttcctttaaattttttttatttagaggacacmaagcatgagaggagaaaatatattggatacagaaatcttgttattcaaagagcctatagtatggcttgttaaatgaggaaaatctgtaacgcaaaaaataatgatgctttcatagcagagttcctattactcaacacgtgggaaagcctacaaaatgtctactgcttatgtttggtgtcccattttaaaacggtgaatatcctaatatgtattctacattaaagtttaatgtatgtcagaacctttcattggaaccagcagacagaaatttacttattaacatagagaaatgaacataga

SEQ ID NO: 151759 - DNA, 601 bp, Human
taaccttgtacaaaaaccttcttatcattttcaatagcattaaaaaatagtgcaaatggaaatttttttttttttgagacggagtcttatttgtcgcccaggcttcagtgcagtggcttgatctcggctcactgcaacctctgccttctgggttcaagtgattctcctgcctcagccccccgagtagttgagattacaggtgcccgccaccatgcctggttaatttttgtatttttagtagacatggggtttcaccacattggccaggctggtcttgaactcctgacttcaggtgatctgyctgcctcggcctctcaaagtgttcggattacaggcatgagccactgctcctggcctgacactatttttttaattgaacctattctactgagtaaaagtaaacaggcacacccctgcttcctttaaattttttttatttagaggacacaaagcatgagaggagaaaatatattggatacagaaatcttgttattcaaagagcctatagtatggcttgttaaatgaggaaaatctgtaacgcaaaaaataatgatgctttcatagcagagttcctattactcaacacgtgggaaagcctaca

SEQ ID NO: 151760 - DNA, 601 bp, Human
ggtatttaacaaagggccatcaaatcctacagctttggggattaaaaccctacagtgctttttcatgaaataaacaaagattgaacctttaataggtggtaggatgttaagaatggggtgaaaagtgactcagagtttaactcaaataatagttgttccactcatttaccttaaaccctcttaaccacatttggttttgctaattatgttgcatatagaatagcaatagtaatcatatacacccaatgccataatgataatacaaccctgaatgtaactgctatcaaattttgttccataytttattttaaaactataggacaaggtatcataaaaatagaaattaataatgtaattaataatggctataaatatcactttgcttttttttcttatgatgggtaaccttgtacaaaaaccttcttatcattttcaatagcattaaaaaatagtgcaaatggaaatttttttttttttgagacggagtcttatttgtcgcccaggcttcagtgcagtggcttgatctcggctcactgcaacctctgccttctgggttcaagtgattctcctgcctcagccccccgagtagttgagattacag

SEQ ID NO: 151761 - DNA, 601 bp, Human
tgagaaaatgactttgacaccaacatgtaagaagatacaggcagctggtggtgtgctttttcccactgagatctttaaagctgctttatttttagaattttccctatttctcattacagagctttaagacagcttgtagaaaatgtgtgtgtgtgcatatatatatacatatatagtatatatatgtatatactatatatgtatatatgtatatacacacatatatatgcacacacacatatacatatacttacatatatacttatatgtatatacttatatacttatatttgtgtatatmtctacctatatatatatatagatatatataaaatttagtgttgcagtctaaaggactttggattcattaccgtgtattacagattttcccacatcgtaaggcatatgcctaacagaacagatgggtcctgtggtatttaacaaagggccatcaaatcctacagctttggggattaaaaccctacagtgctttttcatgaaataaacaaagattgaacctttaataggtggtaggatgttaagaatggggtgaaaagtgactcagagtttaactcaaataatagttgttccactcatttac

SEQ ID NO: 151762 - DNA, 601 bp, Human
tttaatacactttatttcctacagagataagagaaattaaagatttgttgttggatttattcatttaataaaagatcaatataagctggaatttttatcctttggatactggtaccacagaatttctttaatttggagtgtcctgatactttaatcttaaattgcaattagattaatgcttaagtaatcttcaaaagtcagtatatctaagtaagtcccattagaatgggacttcaggccaggcacagcggctcacgcctgtaatcccaacactttgggaggccaaggccgatggatcgcytgagctcaagagttcgagaccagcctgggcaacatggcaaaaccctatctctacaaaaatacaaaaattagccaaccttggtggtgtgtgcctgtggccccagctacctgggagtctgaggtaggaggatcgcttgagtccgggaagtggggtttgcagtgaggcaggattgtgccactacactccagcctgggagacagagcaaaacaatgtctcaaaataaaaaaaaaaaacacaaaacaaaccaagaggttgcctttaaacgaacatgtttcaaataataaatatccaattcctttt

SEQ ID NO: 151763 - DNA, 601 bp, Human
ctgttattgtgttacatatatcaaagggcaaaataaaaaaattgatttaaatttcataatttaattatatatataaagggtatatatagatatataattatatatatatatattctagccagagaacacttaaattacagatacgaaaacagatcttctttctcataaattttagatttgattctatatatggatgtttaatacactttatttcctacagagataagagaaattaaagatttgttgttggatttattcatttaataaaagatcaatataagctggaatttttatcctttgsatactggtaccacagaatttctttaatttggagtgtcctgatactttaatcttaaattgcaattagattaatgcttaagtaatcttcaaaagtcagtatatctaagtaagtcccattagaatgggacttcaggccaggcacagcggctcacgcctgtaatcccaacactttgggaggccaaggccgatggatcgcttgagctcaagagttcgagaccagcctgggcaacatggcaaaaccctatctctacaaaaatacaaaaattagccaaccttggtggtgtgtgcctgtggccccagc

SEQ ID NO: 151764 - DNA, 601 bp, Human
ttataataaatttaaatttaactaagtttaactgtatttttatctggtagtcttaaagcaaatgctatatacagttttacagggaacttagtcattctaatcaataaaataatagctaacattttcatatcagttatcctttaagcactttataaatgctaatttatttacacaaccctataaaataggtactattattcctatttagcaaataagaatattgagatagtaacagatggatttgcccattgtcatgcaactagtggcagagaaggggtttgaacccagaaggtcctgttayagagtttaacactctaaccacttcagatactgtctcctatgaaatgtatcagtgaattcaaaatcctacaaattgcacatagattgataactcttgaaaatagtattcaacaccatattaacgtgcatcatgcacttactttacccaaggcctctttaacagacagcaacagtaaacttaatattccatcttcactgatcatattttctctcttcaaatggtacttcagaaattggtaatacctcatggtcattgttcagaatatctgttattgtgttacatatatcaaagggcaaaata

SEQ ID NO: 151765 - DNA, 601 bp, Human
gatcccaaatgtcatttagagtcattcaggggcattcctggtaactttaacccattccccaaatagaaaatattatgctgagttcctatataataaaggctactgagttgatcacctgaatttatctgtggatccaaaggattcatctgattcccagcaatccactaaacacaggagagccagaatacaaaatagcatctttaccaccagaacgaaatagagattaaaacttttgatgtggaagtcaatttaagcatatttgcttgaaagttaataaactattagacttttcagtatctaytcaccaggaatagaggcacaatgcaaaacaattacagatgagcagtctgctaaaatcattatctattgaccgaaaatcatcattatatcagcatcataacttagatcaattaaatgtaccagggaaatgaaagcaaatgagatgaagtgaaaataggattgctgaatttggcaaaataaaacaagaaatgtctatcaactttgaatttcagataaactacattttttaaaagtataagtacatcccatgtaatatttagtaagcacaaacctgcacattgtgcacatgtaccctaaaact

SEQ ID NO: 151766 - DNA, 601 bp, Human
cgcctctgccaacaaacctcaagcaggtgggaattttaagaagtcccgcattgagcattgatatagaggtgattcaacaagtcactagggacttgagggattctagcacaatacaattgcaaaattgtaaaaccttagctctgtgagagaactgttctcatttagagctgctgagttttaatagtcactgtattcgtattaaactgcatttttctctttcctatgtttactttctgcttgtcaagtaaaagatcaatgttttggacagagaaggtgacagggttggccaagaagattttgytttcctcagctcctctgagtgagctccatctcattcaaaaacagatcaagctaaatgtgaagcaggaggcatttactgtgctccacttcccaactgccagggcctcacaagaggtaacttcagggctgcgctgcaaggctgtatgggttctgtttgcataagggtacccagctgagaggatgagactgactgaaaagcatcctgggctgcactcatcaaggtatgccccagcatcactgatacaccagaggaaagagcacttttgcacaaatgcaccctatgggtatgaagtgacccaca

SEQ ID NO: 151767 - DNA, 601 bp, Human
atgctatacattttcagaattggtatcctagtatcaattctgaattctataatagcagactcacaggggacctaagggctgggaagcaatcacagcctagtgagtggtgttagcctacacctcctgactgccttcctctcaacttctcacacaaccttgaccgttttcagattctcccacgtcttctggcttcagtacacttctgtatgcttgactagagtcagtcattgtactagtgtgctagggctgccataacaaagtgccaccaactccttggcttaaaaaaacaacatttttttttctcacagtgctggatggaggctggtagtccaagatcaaggtgttgccaaggttggtttcttttcaggcctgttactggcttgtgaatggccatcttctctccatgtcttcacatggtctttcctgtgtgggtgtctgtgtcctaatctcctcttcttttaaggacactggtcatattagacttgggcttaaccttatgacatcattttaccccaattacctatttaaagatgctatctccaaatataatcacattctgagatagttggggttaggacttaaatatataaattttggggcg

SEQ ID NO: 151768 - DNA, 601 bp, Human
atttgtgcacttttagttcagaagtggtttttaaatctcctatgtagcacactttataattacacatatctttgtgtatctaaaacataagttctttaaaaattaattacgtttctcagaaagatcaaagcattgatctacatttttttcatgttcaaccttgtaacctttacttcacaaacgttaaacatgaggttaaatggtgttccttaaggagtaaatgcatcaggagttattctaaaaatgtcttgtctactaagcaaagcaattttccaagatacagttgggatatgaaaaaatmgcacaagaacatgtatactgaatttctgtttattcctagggctgtatttatactgtcataatatagaagaatttcaaacatactaatttaaatgtgtatcttaaagtaactgacagattatgctgcaatgctatacattttcagaattggtatcctagtatcaattctgaattctataatagcagactcacaggggacctaagggctgggaagcaatcacagcctagtgagtggtgttagcctacacctcctgactgccttcctctcaacttctcacacaaccttgaccgttttcagatt

SEQ ID NO: 151769 - DNA, 601 bp, Human
gtgtttatttgtgcacttttagttcagaagtggtttttaaatctcctatgtagcacactttataattacacatatctttgtgtatctaaaacataagttctttaaaaattaattacgtttctcagaaagatcaaagcattgatctacatttttttcatgttcaaccttgtaacctttacttcacaaacgttaaacatgaggttaaatggtgttccttaaggagtaaatgcatcaggagttattctaaaaatgtcttgtctactaagcaaagcaattttccaagatacagttgggatatgawaaaatcgcacaagaacatgtatactgaatttctgtttattcctagggctgtatttatactgtcataatatagaagaatttcaaacatactaatttaaatgtgtatcttaaagtaactgacagattatgctgcaatgctatacattttcagaattggtatcctagtatcaattctgaattctataatagcagactcacaggggacctaagggctgggaagcaatcacagcctagtgagtggtgttagcctacacctcctgactgccttcctctcaacttctcacacaaccttgaccgtttt

SEQ ID NO: 151770 - DNA, 601 bp, Human
cagaggcagggacatcctcacagggcactctactcaaaatgattagaacatttatggagcattgtatacaattctggagacaacactttaaaagatctatttaaaaaattgcacccagggaaagataaataagtttgctaatgataccatattctatttcaaatgcaagtacaagaaagtggcaagaaactcagaaaaactttgtttaaggaagataaatctaataattagaataatccagcaatgaatggagttatctgattgaaattatctgggtacaggctcgatgatcatatatctmtaaaggtcatgcttaaatgactccaaacatcaggacttactcggatttgaatgacctaaaagtccctttctaaaacaatgatgtaattttcagacaaaaagataaatgcagtgcaacactagttatggtacaaagatacttttgtttttcttttgtgtttatttgtgcacttttagttcagaagtggtttttaaatctcctatgtagcacactttataattacacatatctttgtgtatctaaaacataagttctttaaaaattaattacgtttctcagaaagatcaaagcattgatcta

SEQ ID NO: 151771 - DNA, 601 bp, Human
atcaaagggagtattaaactttcataaggctaagttatacgttcactttgagaaatttaaccctcaaaagggttaagattaagcggataatactgaaataacagcaagaaaaacttctattatggcaggctgcattaattaaagtctgtatctacaagtcagaggcagggacatcctcacagggcactctactcaaaatgattagaacatttatggagcattgtatacaattctggagacaacactttaaaagatctatttaaaaaattgcacccagggaaagataaataagtttgctaaygataccatattctatttcaaatgcaagtacaagaaagtggcaagaaactcagaaaaactttgtttaaggaagataaatctaataattagaataatccagcaatgaatggagttatctgattgaaattatctgggtacaggctcgatgatcatatatctctaaaggtcatgcttaaatgactccaaacatcaggacttactcggatttgaatgacctaaaagtccctttctaaaacaatgatgtaattttcagacaaaaagataaatgcagtgcaacactagttatggtacaaagatactt

SEQ ID NO: 151772 - DNA, 601 bp, Human
atatatacatatttacctttcatgaaaaataatagaaataaaagcataaaaatgaaaattccctcaatgcttttatcaaagggagtattaaactttcataaggctaagttatacgttcactttgagaaatttaaccctcaaaagggttaagattaagcggataatactgaaataacagcaagaaaaacttctattatggcaggctgcattaattaaagtctgtatctacaagtcagaggcagggacatcctcacagggcactctactcaaaatgattagaacatttatggagcattgtatwcaattctggagacaacactttaaaagatctatttaaaaaattgcacccagggaaagataaataagtttgctaatgataccatattctatttcaaatgcaagtacaagaaagtggcaagaaactcagaaaaactttgtttaaggaagataaatctaataattagaataatccagcaatgaatggagttatctgattgaaattatctgggtacaggctcgatgatcatatatctctaaaggtcatgcttaaatgactccaaacatcaggacttactcggatttgaatgacctaaaagtccct

SEQ ID NO: 151773 - DNA, 601 bp, Human
attgtgaggcctccccagccatgtggaactctaagtccattaaacctctttattttgtaaattgctcagtcttgagtatgtctttatcagcagtgtgaaaaagaactaatacaatccatccatattgaagtcctaagtgtagatatatacatatttacctttcatgaaaaataatagaaataaaagcataaaaatgaaaattccctcaatgcttttatcaaagggagtattaaactttcataaggctaagttatacgttcactttgagaaatttaaccctcaaaagggttaagattaagcrgataatactgaaataacagcaagaaaaacttctattatggcaggctgcattaattaaagtctgtatctacaagtcagaggcagggacatcctcacagggcactctactcaaaatgattagaacatttatggagcattgtatacaattctggagacaacactttaaaagatctatttaaaaaattgcacccagggaaagataaataagtttgctaatgataccatattctatttcaaatgcaagtacaagaaagtggcaagaaactcagaaaaactttgtttaaggaagataaatctaata

SEQ ID NO: 151774 - DNA, 601 bp, Human
actcaggggcttattatttcccgtctgcctttatagtattttcctaactggtcttcctgtctagtgtctccatcctccaagtccattcttcacatagtagccagattaatcattctggattgcaaatctaaccatgtcaccctttgacttaaaatcttccaatggttcctaaatcttgctttcaggaaacgtagtgagttattattgaaaaggcaatatgatttagaatcagacatgtaaacttaagtcttgattctaccatacgttagtcatatggccttgagcaagctctttatctgamcctcagtttcaaaaaatttactttatctaagactattctgaaaattaagtgaaattatacacacatacacacagacacacacacacgtgacataatcaatggatactttattagaaaatgtttaaacttcaaaaaaagtccaaagttttctgataatctaaacatacaaacacatatatgtatgtatatgtgtgtaaaatatacagtcacacacatgtatatattcatgtaaacacggagtcttaaatatatatatatacatagatatactagtatatataatattgctttgtacaatct

SEQ ID NO: 151775 - DNA, 601 bp, Human
gaagtgaaataaaaagggtggatcctgaagacactttgtaatattggtgcccctgacccttgggcctcttgtttccatgctgtatgttgtctctgaggaatttaacctttcctcaaagtatttgtctactctttcctgaactgtggacaacactgaattcacttaagactgactcctgggcatttctactaccatattttatatgaactccagtgtcccaagaataatcctccacgttttttcctaaattaagatttctttttttggtgactgcattgtgaaatgtaataatcggcctcakacactactatccatgcaggactatcaattttatcatgtaattccctcccccatttttttcctgcctattcctactttccttgctttactcaggggcttattatttcccgtctgcctttatagtattttcctaactggtcttcctgtctagtgtctccatcctccaagtccattcttcacatagtagccagattaatcattctggattgcaaatctaaccatgtcaccctttgacttaaaatcttccaatggttcctaaatcttgctttcaggaaacgtagtgagttattattgaaaaggc

SEQ ID NO: 151776 - DNA, 601 bp, Human
tatatattacaatgtaataataataaaaatatagtgcaaaataaatgtaatgcacttgaatcatcctgaaactattcccaacccagtctgtggaaaaattgtcttccactaaattggtccctggtaccaaaaaggttggggtccactgctctgcttctagtactacctctatgcacccatgctactgaagtcatgcacttgccaacagaatcaaagataaattatatgaaagcaattatgccagcataatgtattaggcaaatatttggcatcatgattgtatgtaatatgattatatgtrataggatattattttagggatactctaaaaccatgtacacacaagagtgggcctttgccacagtgagtttaaagtgtgttccttgcagcctttgccacatcactaaaaatgggcaaatcatattttcttaaaggaattaattgggactgaacaatggctcattgggtttgggtttcttgcctgaaaaaatatgacataaatttggtttcataaaaaaaattctgttaccttgctactcaacgtgtggtctctggatgggcagcattggcatgacctggggactggttagaaatgcagaat

SEQ ID NO: 151777 - DNA, 601 bp, Human
ctagggttgcttaattcaggggcccattagcacccttaagaacacaagttctttctatttttttttttcactctattaccttttgagtattgacttttatctctctaagtagcttccttcaatattccaagatgactgacaaaatttggggcattaagagccaacatgacaacgctcaacctttagtattcaacaaaatgacatttacctaaagaagagctatctctctctctctccctttttttcttttggaactcctacttttagcaaggaaacctttcccagaagccctccagtagayatttttgtgtcctgttggcaagaaatggattatgtccccacccttaaatgtatcccttgaaatgagtttaccttgaaggacttgacttgctgcagtgacctcggctaagcaactcaatctctctaaacatcagcttctttctctacagcattttcctctagtccaggggtccccaacccctgggccatgaaccagtactggtcagtggcctgttaggacttgggttgcaacagcaggatgtgaatgtcaggcaagggagcgaagcttcatctgtatttatagccactccacatcactccc

SEQ ID NO: 151778 - DNA, 601 bp, Human
tctttctgctaatttggggcttgttatttcttgattttctagttatttgtggtacaacattagattgtttatttaaaacctttctactttttaaggtaaacatttactgatatatacttctttcttagtattgcttttgccgtatctcacacgtttccattttcactatttcaagaaatgttttgatttccatcttaatttcttcattgacctaatgattgttcaggagcatactgtttagtttccatgtatatatagtttccaaagttcctcttggtattgatttctagtttcattccaytgtagtttgagaagatacttgatataatttcaacttttaaaaatttgttgagacttgttttgtgggctaacatatggtctatcaagaatgttctatgcgctgatgagaacgttgtatatttggcagttgttggctaaaatgttctgtaaaggtttgttaggtccatttggcctaagtcagctaaacagaaatacaaaagatcaccagagactactagtaacaactacatgctaacaaactcgaaggcctaaagaaaatggatacattcctaaaaacatacaacctaccaagattgaattt

SEQ ID NO: 151779 - DNA, 601 bp, Human
ttgtaatgtctccttttttatttctgatgttgtttatttggatcttctttcttcttttcttggttagtctggttagtgatttaccaattctgttatcttttcaaaaaaattcttcattttgtgatccttttttttcaatttccattttgtttagttctgcttttatcttcatcatgtctttctttctgctaatttggggcttgttatttcttgattttctagttatttgtggtacaacattagattgtttatttaaaacctttctactttttaaggtaaacatttactgatatatacttcyttcttagtattgcttttgccgtatctcacacgtttccattttcactatttcaagaaatgttttgatttccatcttaatttcttcattgacctaatgattgttcaggagcatactgtttagtttccatgtatatatagtttccaaagttcctcttggtattgatttctagtttcattccattgtagtttgagaagatacttgatataatttcaacttttaaaaatttgttgagacttgttttgtgggctaacatatggtctatcaagaatgttctatgcgctgatgagaacgttgtatatt

SEQ ID NO: 151780 - DNA, 601 bp, Human
attactttaataatttaggaggcttggatgaattgggaagggctcaaatttatattcacccaaaggaaatatggattaagaagattgctttcttatgggccttttctccagagatagttgtctgaattaaggatgaaaatgtcaggtcaaactcatttcttattacaatctagcaatctaaatggcagctgttgagatgagtccagagagggttacattcagatttctaatcaagggaacacctttattgactacttaataatcaattcttcttcgcatctctttaactttcaggggaatratttttactagattaaagtggtcacctctttttaaagtaactttgaccctaggtatagccacccctcccgccgacacacacacacatacacactttggtattgagatctattttagtgatttatctatctacatagcaagctgttcctcccaaaaagaacagtatacataatggaaaagttataaatatatacatcaatcattttcctcttcagagcatagttagcatagttatgctttttaattctcctttacatttccttacctaactgaaaaggctacaaaagtaacttactaaaga

SEQ ID NO: 151781 - DNA, 601 bp, Human
tactaattactttaataatttaggaggcttggatgaattgggaagggctcaaatttatattcacccaaaggaaatatggattaagaagattgctttcttatgggccttttctccagagatagttgtctgaattaaggatgaaaatgtcaggtcaaactcatttcttattacaatctagcaatctaaatggcagctgttgagatgagtccagagagggttacattcagatttctaatcaagggaacacctttattgactacttaataatcaattcttcttcgcatctctttaactttcaggrgaataatttttactagattaaagtggtcacctctttttaaagtaactttgaccctaggtatagccacccctcccgccgacacacacacacatacacactttggtattgagatctattttagtgatttatctatctacatagcaagctgttcctcccaaaaagaacagtatacataatggaaaagttataaatatatacatcaatcattttcctcttcagagcatagttagcatagttatgctttttaattctcctttacatttccttacctaactgaaaaggctacaaaagtaacttact

SEQ ID NO: 151782 - DNA, 601 bp, Human
tgcacgttctgcacatgtaccctaaaacttaaagtataataaaaataaaaaaataaaataaaaataacaaccacagaaacccaaaccaaacaaagaaaacaaaaagccccaaagatcaacctttcagcctgaggctgctcataatacacattgcaaagatcttcattcctctcttaaaaatgtaaaagagggaaatgacacaggttatttaacatattgtccttgggctttgatataatttgcttgtgaagagttgataggcaagacctgttttctaattaggtaaatttgaaaaagcccmaaatgagctaatctcgctggttctagctgaatctttggtttagctcctgagttgctggaacttgcattctaatttagttctatcttcccagtaaaactgtcctgagaggtcctggactgtcgccccacagtgcaatggtcctaggaaagtgatagggcaccaaacagcttcaacacctaccaaatcagttagcggaacgttgcaattaatggtcctttcctaaagattaataatgaatatcagtgcattaagacgtagattatcttttgtacaaaaaaaaaaaaaaaaaaaacgcaacaa

SEQ ID NO: 151783 - DNA, 601 bp, Human
tacaaatattacaaagtgaattcattctgttgttttctttttcaatgattacttattctgtcatctgttaatactgatcataaattgtgtcacttccaggaaagtttctctaattacaaagtgaattcattctgttgttttcttttcaatgattacttattctgtcttctgttaatattgatcataaattgtgtcacttccaggaaaggttccctaataaatccagaggaacaaataacactctcccaatgaaagcttgttttactccacagtgagtcatcatggacatgacctttctttygccatcgtatgaaaagatgtgcagatattggctctgcacttccacatccagctaaatccctcctcagctctgaagtctggctacacaaatctgtaaccatcttcttgttccgggaactcttgtggcatggttgtctaaagtacatagttgatcaaaagcatatattaacttaccttgctttgcatctttctaaatataaattctgactacatctaggtgtgattctcttacatctgatacttctctgcaacttttgtctcagcatagtaaccacctaattgggccaacatacaaatcctt

SEQ ID NO: 151784 - DNA, 601 bp, Human
tactctgcctggcttaattgagtgtaaagtctttgtataaagagacacaagagatcacagatggcaggccctgtgggatgacatctgaagtgcactgattgctagggctggaagcctgagactagacacttaaatttttcctgtgctacttggtagctctgtaaccttagagctagtcctttttgccatcatgagtctcagtttcctcgtgtacaaagtggcaagaataagtgaggaagatatctgtcctacaagttttataacgtttttaatgaagatcaatgcagaaagtgcttaataratctttctgttgatgttctcactctcatatttccccccacattcaacctagttctattgtcaagatttacacatctttttgtaaaatctaaattgctgtagaaacatagggtagtgttattctatccggcaatgtgccaggctgctatgcagggctttgctactggcgagcttttccttttattcagtttggtacacagagaggttccacaatgtcaatgattattatttttattcattttaaagacagtttcacttgtgaaacatgtaaccaacactctgtgacttcactaggatcaca

SEQ ID NO: 151785 - DNA, 601 bp, Human
ctgcctagctctggtaacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaattccacacctgatctcacatgatgggtcacagttaaaatgcagtcaaaactttgtgtaatgcacraaactattaaaaaatattgtataaatcatcttcatgctatgttcataactgtatataaaacaaatgcatccctggttactcctgggcctcattctcaagggatttcaatacatatatatgtaaacattccaaaatccagaaaaatataaaaatatgaaacactcctggttccaagtgttttggataagggatacttactctgcctggcttaattgagtgtaaagtctttgtataaagagacacaagagatcacagatggcaggccctgtgggatgacatctgaagtgcactgattgctag

SEQ ID NO: 151786 - DNA, 601 bp, Human
accacccaccctcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttctcgccaaaagggaatgtttaaagtaaagttgcgtaaatctagtttatcgtcatgcatatcaaaacactgcctagctctgrtaacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaattccacacctgatctcacatgatgggtcacagttaaaatgcagtcaaaactttgtgtaatgcacaaaactattaaaaa

SEQ ID NO: 151787 - DNA, 601 bp, Human
ccagcctagtacctaacagctatcttttctgctcctctccctcctcccaccacccaccctcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttctcgccaaaagggaatgtttaaagtaaagttgmgtaaatctagtttatcgtcatgcatatcaaaacactgcctagctctggtaacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaattccacacctgatctcacatgatgggtcac

SEQ ID NO: 151788 - DNA, 601 bp, Human
gtagtacagatcctctcatcaccccggtctccagcctagtacctaacagctatcttttctgctcctctccctcctcccaccacccaccctcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttctygccaaaagggaatgtttaaagtaaagttgcgtaaatctagtttatcgtcatgcatatcaaaacactgcctagctctggtaacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaa

SEQ ID NO: 151789 - DNA, 601 bp, Human
tctctctgaaaataaaccatgctgagaagcctttaagaagttaaatagcagaaactctcttgagaagtaaatgttaaaattatggcaatatcccttagagttttcacttagaattaaagcttttcttttctttattttaaaaacttttatttcaggttcaggggtgcatgtgaaggtttgttacacaggtcaacttactggcatgggggtctgtagtacagatcctctcatcaccccggtctccagcctagtacctaacagctatcttttctgctcctctccctcctcccaccacccaccytcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttctcgccaaaagggaatgtttaaagtaaagttgcgtaaatctagtttatcgtcatgcatatcaaaacactgcctagctctggtaacactcat

SEQ ID NO: 151790 - DNA, 601 bp, Human
taactgtaaacacacgttctcaatttactattctccataggttaagacatttattaattataatctatactaaactattgaaagagatgataaaggaatcaaagaaattccaaatccctccagaaatgatttagtctttttttcctgactcaagaagccaaacttattactctacaaatagctttcactttagaagactctaactgaatatataaaatctattaggtatattatcatttatatgaaaattttattgtgttcagataaaatgtgcacttccaatcttactagaatttcctcytaattaaataaacatatcgctggcagattcaaataatttaaaatgttttgtttcagacatataatttttaaataataaaaactttctaagctttcaaacaaggattttacacctattacacttattttatttctaggaacagaggctaaaagaatgcatctcccatttttaaataatcatatacatatgtgtgtatatatatatgatataacgtatcctgtacatatatatgtatgtataggacacattaaggcaactcaaaaattaattttaaattcttcaatctaaaaacaataagaa

SEQ ID NO: 151791 - DNA, 601 bp, Human
ttgccgtttctactcttgctttcctacagtcaattctcttcatatatgccaacattaccttttaaaactacaaacaagttcaggttacttcttccttgctcaaagtctcaaatatctttttatcacacacaaatcaaaggtggctaagaatggtctgggtcctgcatacctctccaatgtcatctacagcatctctgactttctcgcactgctctggtcacagtggtcttctttttctctaatacactaagcttattccttctttagggtcttgacttttgcctttctccccaaaacttayattgtgtggcttgctttctcactttattcaatattcaacaagtctttagagaggtggcccctctgactactctatctaaaacagcaatcccatttacatactctctctctatcgattttgccttattttgcatttactttatggcacttttcactacttgatattatcattaatttcattggtttgttgactggcaccttctccactagattataaattccacaaaggcaggaatttggtctgtttctgtcttctctaattccagtgactagaatgattcttgttacatggaatgtgctc

SEQ ID NO: 151792 - DNA, 601 bp, Human
aatctgggatctgctagcactggctgttttgtaaatgaatgtcaaccaggcagttcacacgtatgttcaatcacattctcccctacaggagagaatttcagataggcatgaagcctaggacagctgaagagtgcttctggaaaacagacctagacttcacccagtacaaagtaaattcaccccaatgatcaggtagtatatatcaagagcatcctgaacaaagtcagggattgtatgtaaaatgggatgaaacaagtccttataaaaatggctccatgtcacatctcagcgtgtaaggtaycatctatgctccagtgagaacttttaaagctaaacctctgactatagcatactgtgttatctattgctttatataacatcgccttctgtttccatatccttctctgttaatgacatttcacattatctgtgtctttacacatttttagtagctacatcactgtccactgcaaacccacaggatcctagacctgctctttctctaatcttctgtatcttagcaatcggccaaaaaacttgaaatcatacttgatttctcctggccctcaaagcctacattcattctgccaaatcatgtaag

SEQ ID NO: 151793 - DNA, 601 bp, Human
acaggttctatttcctccaattttttaatatttagttgtagtttttacaaatgtaaggtacagtttctattatgtttctgtccagttttacaggtgttatttaatgtgcataatactgtatactgttttgtgcttcccattttacaaagcctaggtattatctcaactaattatcctttttcatatacacaattaccctaattgaattacaaattctatcatgttctttgtgaattaaataaatctgggatctgctagcactggctgttttgtaaatgaatgtcaaccaggcagttcacamgtatgttcaatcacattctcccctacaggagagaatttcagataggcatgaagcctaggacagctgaagagtgcttctggaaaacagacctagacttcacccagtacaaagtaaattcaccccaatgatcaggtagtatatatcaagagcatcctgaacaaagtcagggattgtatgtaaaatgggatgaaacaagtccttataaaaatggctccatgtcacatctcagcgtgtaaggtaccatctatgctccagtgagaacttttaaagctaaacctctgactatagcatactgtgtta

SEQ ID NO: 151794 - DNA, 601 bp, Human
cctatcatactgtgcaaggctgctaattttctccagttttgttctatttatttcactctgttctattctcttccaaaattattatttttccaaattatctttccagtacaggttctatttcctccaattttttaatatttagttgtagtttttacaaatgtaaggtacagtttctattatgtttctgtccagttttacaggtgttatttaatgtgcataatactgtatactgttttgtgcttcccattttacaaagcctaggtattatctcaactaattatcctttttcatatacacaatyaccctaattgaattacaaattctatcatgttctttgtgaattaaataaatctgggatctgctagcactggctgttttgtaaatgaatgtcaaccaggcagttcacacgtatgttcaatcacattctcccctacaggagagaatttcagataggcatgaagcctaggacagctgaagagtgcttctggaaaacagacctagacttcacccagtacaaagtaaattcaccccaatgatcaggtagtatatatcaagagcatcctgaacaaagtcagggattgtatgtaaaatgggatgaaac

SEQ ID NO: 151795 - DNA, 601 bp, Human
atatcaagtaaccttttcttacaattacctcacataaaatttttactctataatttgagaactttataaccatgatccattttactcattttatctcattctttttaaaaaatctgattctttataacattttgcttgtgtacttccctatcatactgtgcaaggctgctaattttctccagttttgttctatttatttcactctgttctattctcttccaaaattattatttttccaaattatctttccagtacaggttctatttcctccaattttttaatatttagttgtagtttttayaaatgtaaggtacagtttctattatgtttctgtccagttttacaggtgttatttaatgtgcataatactgtatactgttttgtgcttcccattttacaaagcctaggtattatctcaactaattatcctttttcatatacacaattaccctaattgaattacaaattctatcatgttctttgtgaattaaataaatctgggatctgctagcactggctgttttgtaaatgaatgtcaaccaggcagttcacacgtatgttcaatcacattctcccctacaggagagaatttcagataggc

SEQ ID NO: 151796 - DNA, 601 bp, Human
ataagatggaatattgggtaacaccctcctttgatgggcagaggaaaaacagcactaaaaacataccagaaaggattagccagagggttaggagaaaaatgatatattattaaagaagaagtaatgttttaataatgtaaaatctttattgctgatgtgaccttgctaaaagcagtttcacagaaatgatgggataaaaaagtgagtaggaggtgggaggaaggttaaaaataagtgaggataataatcagttgactgctaatgaacgagagagggaatatcttaaggatttttgttttgytttgttttgttttgtttgtggggggaaacagggtctcgctctgtcacccaggctagaatgcagtgatgggatctcagctcactgcaacctccgcctcccaggctcaagcaattctcctgcctcagcctcccgagtagctgggattacaggtatgcaccaccacatctggctaattttgtatttttagtaaagatgggagtctcactatgttgcccagctggtcttaaactcctggtttccagtgatctgcctgcctcagcctcccaaagtgctgggattacaggcgtgagccaccgcaca

SEQ ID NO: 151797 - DNA, 601 bp, Human
caataaaataaagacagaaatcaagtaattatttgaaactaatgaaaacaataaaaatcataccagaatctctgggacacagctaaggtagtgttaagatgaaagtttagagcagtaatgcccacatcaaaaagtgagaatgttctcaaattaacaacctaacatcacatctagaggaactagaacaacaagagcaaaccaaccccaaagctagcagaagaaaagagataaccaaaatcagtgctcaactgaattaagtagagatgagagaaaccatacaaaagactaataaattcaaaaktttgttgcttaaaataataaataagattgataaagtgctagctagactaataaggaaaaaaaatgagataagatccaaataaacacaatcagaaatgacaacgatgccattacaattgattccgcagaaatactaagaaccctcatatactattatgaacacttctatacacacaaactagaaaacctagaaggaatggataaatacattcaatctcccaagattaaacctggaagaaattgaaaccctgaacagatcaataatgagttttgaaattgaatcagtaataaaatacctaca

SEQ ID NO: 151798 - DNA, 601 bp, Human
gctgatgattttgattggcagtggttctgtatttccatggggtgtaacttcaagagggaagtggcaggcctctgccattgccactgccaagggccctgtccctgctgccacaaagtgaggagggaacaaaaagcctgagctatccccaaggtggcagcatatagcccagggtgccaagctaaggtctatggccaaaactcaagtgagagggaagctcacactctcagagcactgagagagtgcatggctgcaaatgcgaggaaatatagagaagctgcaaatccttaaagaaaacaaattstaagcaagaattccatatctagccaaactaagcttcacatgtgatggagaaataaaatccttttcagattttactcccctttgcaaatgctaaggaaaatcattaccaccagacctctattacaagaagtacttaagggagtgctaaatatgataacaaaaaactgctattggccactacaaaatatacttaggtacatagaccattgacactataaagcaactacatgatcgagtctacctaacaatcagctaacaacatgatgacaagattgaacctgcatatatcagtattacccat

SEQ ID NO: 151799 - DNA, 601 bp, Human
taagatgttacttgcaagctgcttggtaatctcaaatcaaaacacctacaaaaaaaaagagcaagaaataaaaacataccaccaacaaaaagaaaatcactcacaaaatgtaaaagaggaagaaagaaaggaaaaaagataaatccacaaaataaccagaaaaatccaaggtgacagtattccagaatagaccatatgttaatccacaaaacaagtcttaaaaaactgaacaaattgaaatcatttcagacatcttcactaagcacaatggaataaaactagaaattaataataagatgtwctttggaaattatactaacacatggaaattaaacaatatgctcctcaatgaccagtaataaataaataaataaattttatttatttaaaaataaaatttaaaaattttttgaaacaaaagaaaatggaaacacaacataccaaaacacaggggatacagcagaagtggtactaagaggaaagtttatagcaataagcacttacatcaaaaaagcagaaaaaccacatttttatttttatttatttatttttgagacagaatctctgttgcccaggctggagtgcagtggcaccatctcag

SEQ ID NO: 151800 - DNA, 601 bp, Human
tgatgcaaacagttctaagatcctcccataaagctagggttatgaaacttaatttataaggtactttcagataactatactctgtttcaataattactatatgttattcctctatcctcagtagactaagttaaatagaagagattttgattactttatcaagttactttttggaagaggatttaaaaccaaacttacagaaatccaatgggaacaatttcacaaggctttttttttttcatttcaattattctaccaatttaggctactatgtaaaggtttttatttagcaaaaaaaaaattgctttttcaaaaatctattttttctctaaactcaggcaacaaaaataagttgcattaaaatcactcatttaataagctgtttttcctataatggctgaacaagagaaagatctgaataaaagatgtaagatgtatagtttggtaattgttacagattctctttttggctggcattttatcagagagaaacactgtttaccaacaccacattgcttagttctttccaaattacttcttgcctggagagaaaacatggatatactaggtgtatttccacctaaattatgtgcacagaaaa

SEQ ID NO: 151801 - DNA, 601 bp, Human
tggttcaaaatattgctgtatagatactaattaacaaagcagcgaggaagagaagaaggcaagcaaataaacagttggaaacaaaatctttacaagcaccaatggtttaaattatgcttattatcatattattaaaattgtgttcatagtcaattccagctttaagttaccgtatcagtgaaaacactgagatatttacaatgagatatctgcatatatttcaatatttcactatttcaaactaatcacagcacgaagtaatgaaagacattttatgtaaatctattaattttaatgttayagaaatatcattgtaaactagtatattattataatgtattatagtctgagagttatggccatagagttatttttatatactctatttaaaaatattaaaaatatttttaaatctttttattaattaaagactttagttttatcttctggataagtaatatgaagctacaatgttttaaatttttggttcagatttagtgcctatccaagatactgctgaagtacctgtggaagtacaagttgctattgaggaagattcaacttacctaaataagagaaaatcttaaaatagtcaatacga

SEQ ID NO: 151802 - DNA, 601 bp, Human
gtcaacaacttaattgcaaccttctgaggccctgagcagagaacccaataaagccaggtctggactcctgagtcacagaaactgtgatacataggtattcttttaatttgtaataatttgttatgcagcattagaaaactaacaaaccggccaggcacagtggctcatgaccataatcccagcactttgggaggccaaggcaggcagatcacaaagtcaaaagattgagaccattttggccaacctggtgaaatcccgtctctactgaaaatataaaaattagctgggcgtggtggcatgygcctgtaatcccagctacttgggaggctgaggcagaagaatcacttgaacctgggaggtggaggttgcagtgagccgagattgggccactgcactccagtctgccgaccgagtgagactccatcacaaaaaaaaaaaaaaagaaagaaaagaaacctaacaaaccagattacaagtggaagtcagaaagaagacttggtgaaatgattatcagtaacagagaggtaaagaaaatgggttggccgggcacggtggctcacgcctgtaatcccagcattttgggaggctgaggtgggtggat

SEQ ID NO: 151803 - DNA, 601 bp, Human
aaatcaatagtgcagcaattaaaagctacatacggtgacaaagagaaacagcagttctaataatgcttggctcagagtttatatggcagggctttaaatgtccactgtctaggactctgggaggtgaacctgaaagtatgcatgaagtaccctcagcattggagctggaagtttgcagagcaggaagccaggcagatcattatgttgaattctatctatgtgaaccaagatctgagggtcccgaaagacagggtgcacgggatgtcgtctgcttcaccactgttcctggcataaaatacartccattcacactcagctctgcctaggacagcttaggtgttttgttgaaggagagggggaatgcagagcttactttcatgtataatacattatagcattaagccaggtatgctacatgcatgcacacacacgtatgcaaacatacaccacacacacacacacacacacacaccccataaacatgcacgctgaacaagcatgatatgatttctacaatttttaaatttcctcgattctcttttcaaacactccctggattccttctttttcccattccagcctaaataaaaggaaaaatgta

SEQ ID NO: 151804 - DNA, 601 bp, Human
ttttttttttttttttcactgttcattcaatctgagtttaaatcaagataaagagcatggaagtgacagccaatggcagcatacaggaataggaatgggttaacacagccaggtaagaaatggatagataaggatctaggggcaagtagaggaaactagtagaatataaagtctgatgccaatttgccaagtaagcgtcagaatcaggagactaagaaggggtatagattagattctcttgctagggctggaaaggtagtctatgcaaatctgaactcagcattgacttaagaggccaggmcagaggaacaatggacacagggtaagaaagggaggctaagtcagggcagttggttcagagcgtcttgggaaacaggaagttaagaatgtctgattaaatttcagggacccaagagtgaaaaaagtcagaagagatgctacggaaagttgcagaaatgagacaagtcgagcaaggcatactatatggagtatgtgtaaaatagaatacagtgtgtgtgaaagtgaggttgtgggatagggaatataaggggttctggaaatatctggcaaaaaacaacaggtaaagctctaagtacacaga

SEQ ID NO: 151805 - DNA, 601 bp, Human
gcatttttaaaacttactgcaaagtctgtgtatattaggtattgaggaacatgcttattaattagataggtcgacggatgaaatgaaagagattggatcaggaacagaagttgaagtttgtttttaaaatatagcaagatcaatttttcttcataaacagcaaggaaaaattacgtgtaaatagccaaagaaatgtttgagtgaagaaaaagatctcctgagaccaaagttttaaggtggagtattaagaacttcatgttatactccatggcactgtgaatttggcagcattgtgcaatamaaactttgtcaggaaaagataaaacttaatgagaatgactttaatgccttttcagtaatgcacaatgggggaaaggtccccagattcaaagagtagtaatgagaaccaaaaactcagggacaatctgacaggtgggaggacagggactttctttttttttttttttttcactgttcattcaatctgagtttaaatcaagataaagagcatggaagtgacagccaatggcagcatacaggaataggaatgggttaacacagccaggtaagaaatggatagataaggatctaggggcaagta

SEQ ID NO: 151806 - DNA, 601 bp, Human
tttccatacaactaaaacatagtaaacaaaatcaaaagaaaacatagagtctgagagaagatattcttacaaaagtcctaagaactatgataaattgttacaaaggcaaacaaacccatagaaaaattacagacaagagagacataggtaactcagagagtctgaaactctttgtaggatgagacataaatgaaaagatgagaagtttcattagtaatcacggaaatacaaattacaacagcacttagattctatttcacatcccaaacttaaaagttcaacaatactaagtgttaggtgytggcgagtagatagagcaagaataactcccaggcactgctgatgaaaatccaaattggcttaacaacttcgtaggacaaattaataatatttagtgacattgaaaatgtacacagccattgattcaggaattgcactcctagacatatttctgagataaattatcacaaggagacatatataataaacttatctgtagcattactgttttagcaaataattatgaaaagttataaagtctatgaacagaattgataactaaatgggattaaaatgggaatacaatagaattatatgtatc

SEQ ID NO: 151807 - DNA, 601 bp, Human
ttagaagatttttttcaagtgaaaacattttatgcatttctgaaataaattttcctttactagaaaacatatttaaatgttgatgtattctatttgctaatattctattaaagacttctacatcattgttcacaaggaagattctcaatcaattttttttcttgtactctctttatccacttttggtgccaggaagtcatggtttaacaaaagaatttgcgaagcttcactctctgtcttctgtggagtagtttgtgtaacacagagaatatatgttttctgaaagctataaagtctaatycaatatctttaattataagtctattcaagattccttttctttttcccttgctttttctcttgaacatatatatgggttttcaacttctctgagtaagttttggtaatgtttcttttactataacaatttttactacattttaaatgcattggcataaagatgtttatattaaattttttctacttagtccatatttcagcctactttttcatagtgaatattttttctttctttattctcttggataattttgtcaacattttaaccatttcattagttttcttcaaagaaccaccttct

SEQ ID NO: 151808 - DNA, 601 bp, Human
aattggaaaaaccacaattacttttggaccaacttaataaaacatccgcagagtaaagtatattgtaatagcaaatcacattgcataactaagtattaggaggtccttgaaagtttggaaaactgacagaacacacaatgtatttttgtgctttgtgcttgctggaggagctatgcattttatgttgatataaaatttaaccattcttacaatttgtaaatcgtccacagagtcctttacatcattttgtttcatcagaccatgtgagcctgaattctagatttttttagtcttagttggrtatgtgcatgttttatggtgattgctttttaggctaaaacaaaaacaacaatccaaagaaacccagatgtaacttttttccctttgaccttatcaaaggaagtggaaggggcatggcctcttagaaatcaagcagaaggtaaatgcttcaaatcgctttgggaaaatgtgccatcaacgttagcagtcgaaaaacagcccaggtcagcagagagtttggaaaagattggaggggagagaagagggagatgactcagcaggaacagaattgcctgcggattctggggttaagagccactga

SEQ ID NO: 151809 - DNA, 601 bp, Human
taaaacattggaaagttttaggaaaaagaatcacccttttcttactggattactgaaagtgactttctgctgagttcatcaaaaataaaatcaccctgggtgagcagaattaacatatcttccttatttgcctttcaagcctgattttgattagtctggggactttgacttattacatgaataaaaaattcagggtggtggttaattgaattagtctataattgatagggtcattattaattgattaatggagatttaatacaagtttttgatcaaagagcataatgatatccaataaagrtttttcaggtactttaattacagcagtgactgcacaaataaagtagaaaacacagacaattatcagtaaataatttgcatgtgatttagaaaacaattacatacttttaagtaggacctgaaagagtttgttatttagtattttttgatagcacagtgtgaacgttgtataggtcagcattgtgtcaggatcttttggatagctaaagactcagtgagctggtgatcagacttgcaggtacttcaagtagctacaatttagttgattgtttacacgtgtaaaaactatctgaatatatct

SEQ ID NO: 151810 - DNA, 601 bp, Human
ttatccgtagaatatttcccacttaaaatttttttttcatacatttagaaaaatccctattcttttcttgttctgcacatttaaaaaataggacctatattatcttgttttcccttcctttacttaacttgaaatgacagagaagagtcctggtgtttgtcacatgccagtcatataagctcctctttgtcccttaccatctatcaagcagttgcaagaatttcttagactttctaccaatgcccagcagacatttaggcagtacagtttatctggtctaaagcacaagactctcctcctyttgctgttttcctctgaatatagaaaagttatttattttcttaataatccaaaatccaaagctttctgttattttttattcaatggagattttgctgagataactgaacatccattgtttatttctctattatataatttatgtattatcacaatgttgtcaatcttctcttgtcaaaatgtaaaatcacaggggcagacaacttggtctatgttatttggcatgtgcctggcctatatgtttcatgaaatatctactgaatgaacagtttcatattttaggattaagtaagctaatgca

SEQ ID NO: 151811 - DNA, 601 bp, Human
aaacatgttttcagacaaatttgttgttcttggcattttaaaaaatattattggttaccagacgttggttacacttttcatccatatttgcaggcaattagtttactctttatttcttaatatttcaatagtaattatgttattaaaatatttttatattgtctattttcaatatatatgtacttatttatacctagtatgtcattttaaggagttattacaatcattaacttactattaaacatttactccctctatcctcaatttttctattaaaattaacattcccacacaatcatartcctttcatcctgggccacatatctcttcattcctacagcacaaattcaaataattaaggctacttggtcaaaggaaatgattttaaaaataaacaaaaaaggccttttaaacataaaagaaacatacaaataatagtaattcctaatgactatataacattccgtattgtgcgtgcatgaatgaatatgaaaatttttaaccaatcccttgttgatgttcatttaatttgtttccaattcttttactatcagaagaaaaacagactcaactctcatgtgtatttatttgcccactggtg

SEQ ID NO: 151812 - DNA, 601 bp, Human
tattagtaaagccctgtgttttatcatgaatttcttctctgttcttcagctgtctgggctttaaaatatagattgcttttgttgtcctaaatccaaacctaactgagcagagacagcagggcaaagctgctcttcttcaaagtgttcttaatgttgctggcactcaatacatggaaaaaaaagtcttaaagaacggagttggtgttttgctatcacaggcagtcaacatacaggaactcaaacagtgtcaccaagaatatgaaaacctccaggctgaatttcctcaggtcctaaacttctrtaagtccttagctaagatgatgcattgaggagttttctaacatccccttttctgcggtacttttaaaagtcagctgggtttcctgctgggtggagatgttttctccccaagttgtgtgtcttggcactttccaacagatacgtttttctcccactctaacggctccccttctgcaacattttttttttctatctagaaatgtttttcttttttgttccagttaagccaccttctccacttaaatagtcagcaatctgtttaaagctggattttgtcctaaaatttgcgacattaaactta

SEQ ID NO: 151813 - DNA, 601 bp, Human
taaacatgtattatattatctaaaatgtcttgtgtgtccagcagtaatgcaggatggcaaaactatgatatcctgggaaggaaatggttgctgtctcacattgtgcaaatgttttcttgtgggtcctcatttaatcctcccaataaccaaccaaggtaggatattaattccactttacagatgaataatttaatatcaagagatgtaacataatatggtgtgtgatccaaaaataaacagtgaatagagaaatatcacagattcaaatcaaaggtgcaccatagagattcttagcataacrgatcagtcattgatttttgcagtaagtgattaccattgatcatttatattttctctcaatgatttctttccactctctgtgactccttcagaaatttctaaagcatcaccacactcgtcaaactgacagcaatttaagtcaaacaaaaacaatcctggattcatagtattagtaaagccctgtgttttatcatgaatttcttctctgttcttcagctgtctgggctttaaaatatagattgcttttgttgtcctaaatccaaacctaactgagcagagacagcagggcaaagctgctctt

SEQ ID NO: 151814 - DNA, 601 bp, Human
ttgtaagatctttgccttttatgtttatgttccttgatctacggcttcctctctcttcctgcaatagccacttacttccacctatttcctatgactaagtgccttgctacatccttgatcttatcatctttaactgtcatgatcccatgtgtgatcttggtgctttcaaccactatgtccttttgtttctatttcaggtcctctatcctgtgagatgtaaggtagccacaaatagatagtcatgggtcagatacaggccatgaatgagaagagagagctagagagaatgcatagaataagrccatatttagtgacacagatgcccatcagcaaaggtgtgaaacagtttccaatgtgtcacagcctgtgaatattcaatatttttgaattcacatgagctttttgttaactttttggagcatgtgttaaagcctttagactcaagttgcgtgatggattaggacaaaagaccacctttaatgctctatttaaacattttcaaaaatcaaattttttggctatttttctaaacatgtattatattatctaaaatgtcttgtgtgtccagcagtaatgcaggatggcaaaactatgatatcct

SEQ ID NO: 151815 - DNA, 601 bp, Human
ctattttcagtacagatgtataagcagttaattcaatcaaacttgggtgtaatttgatcctccacttctgaactttataaaccgatttggctgacttaccttatcttttctttgcttttcatcctggtatacagtccagtgttctccatcattgctgtaagccagtttgtaggagccaacaaactgtacatgaccaaaatctttagctccttgtgtaatgatgccagtcactttggttggaacaagaagatccaccttaaaaaaaagaaaaatacaggctttaaatgcgacaaccaagttktaaacttccaagtcttttgatgtcaagagaataaaactatatatatcctaaaatcaaaaatctgtctagttatttgtattttgaaaccaatgactgagtctattattggcttataattttgatattgccactgggttaatgtagtgcaagactccttgaacaaccatttttaccattttgaagtcaaatcatggtgatttcagtccaccaattaattttatattaggtggattcatctatttgtgcaggttttttttttttttttgtaactgagatagaacagatgtggttggggtgacc

SEQ ID NO: 151816 - DNA, 601 bp, Human
taagcaacgaattaacttgatttcactaatccaactgaggccatatttaaacatctgatcccaattagtcattgataaggccttgagcactttcattctccagggtctcacagatactgaaaccaatagatactatgaaaagatgctcaaaatgctaaacattaaaaaagataaaaattgtatggcattgatttgtacagtgtgtgtgtatagaggtatgtatatataaaattcaaagtagatcataaatttaaaagaaaaataaaacaaacctatgaattaaaatacaatgaaggaaacrgagcagaaaaacatctgagttttttgttgttgagctgtgtaatcaaaattgttctatttctaaaattcctacttgttacaataattaagaaaatataaatgtttaaaaataatttcattaatctttgaaatatttttctccaaagaacattttatctaacatcaggaatttattttaataatgaaaatgacagtggcatatattctagcaataactatttacatatgtattatgagaaactattcaagattctatcacctttataaactattaggtgaatcttagatagtcagatcttag

SEQ ID NO: 151817 - DNA, 601 bp, Human
atatcacacaaaatagatttcagagcaaaaaatagtaccaggggtacagaagttcattttctaatgaaaaagggttgatttgatcaaaaggacattaaaaatctgtttatgtacatatcaacagagcttcaaaatacatcaagcaaacactgatataatggcaagaagagacaaatccataatgacagttgaaaatttccacattcctttctcagtaacagatagtacaagtagacagaaaatcagcaaagatatagaaaacctgagtaactctatcaaacgacacaaaaattttatgtamgtttcagattgagataatgaaataaaacacattaacaagaaaatgtctagtctataagaaaaattaaattactcacatatgaaatcacttttttacataaatggagacaaaaaagtatctcaacagtttaacggtttaaccataattttctttatgcttcttccctaaactaatctatataaagatttcactataatagacgtgctgtttactgaatcttacacatggataagtaaatactcatctgtcttaaaattaatttcaagcctgtataacttatgaagtttaaaaaaattcatc

SEQ ID NO: 151818 - DNA, 601 bp, Human
aaaaaggccattgatacatttttcgagttttataccacttactgtaaacctagaaaactgcatttattttcagattacttttctgaagtaatcttgtgtctggatctacattagacttccacacccaccctccaaaaatctattaaagcaagcagtcaataaaaacaaacagcacaaaagaagacttagaagcttttgtttatacatatttctgtttgaaaagtgcatctataaaacatctcacagacacatgttttgccctgaaacattcaattcatctattatatttgtctggatgaaagcttgtggttgaattggcacttgtaaatattgaagacttttttttcctcttatggagagtaatcatggaaaacaagacaaaaataatgttaagaatcaataggagatggcttactcaatgttagaaaaaattaattgctaagtagtattgagcccttttaaacagaagaggacatctataaaggatgtatgaaatgatacataaaatatctagtagaactagtaataataaagcaaaagagttattttgatacctatcaaaaacatatttcattgatatatatgtatatttacatataaa

SEQ ID NO: 151819 - DNA, 601 bp, Human
gtaaaaaacagctccaagtgtataaaacaaatgtcactttcataagagcaaaggaacatttgactttcaaataaaaatgtacctgaattaatgctgtagagaaatataaaagttagttaaatgttagaaaatgctgtagactagtaaggggaaaataaaaatgtatggactgtaatgagagtgtcatcacaggctcaattacaagagatttaatgtggaaattagctaaaaaacaatactaaagtaaactgcaattcttgtgaatgctataggagggtattcaaaaactgacatctcaatwaggagaacagagtattatttttcttcagttgacttttggcatgtgtgtgtacacatgtatatttattacatatatttaaatactcctgtgtgtgtgtgggtgtgtatatatatatatacattatatacatataatatatatacgtatatatatatacggcattgcttttctgaggcttagtcactctgattaataaaaaacaaaaaggccattgatacatttttcgagttttataccacttactgtaaacctagaaaactgcatttattttcagattacttttctgaagtaatcttgtgt

SEQ ID NO: 151820 - DNA, 601 bp, Human
acacggcttattacaggtgtatttgtcccaagagtgctctattcatattaacacactttctctttgagattcaaccaaaggaactacgtaaaaatcattgccaaatgattaactttatagggagtggcagattcagaaatctttttatagtttcccataaacatggatatatgacaggtatcatttgttctttttcagatttaaactgtgaaaaagtagaaaaatactgccacattaattaagacattgtgaaactgttaagggggagacttttaattgcttaacatattgcagctgatgrtgtgatggtggatagtaaaaatggcaatatgtatcatgtagaactaaagtccttgagcatttttttttatcatataataaacaatcaaaatattagttgtttggtgattatttagaaataaaatgggttgaaatttttgctatattctaattgatatagtttggatatttgtcccctccaaatctcatgtcaaaatgcgatcctcaatgttggagctgtagcctagggggaggtgctgggtcatgggggcagatccctcttgtatggcttggtgccctccctattgtattgaatgagttc

SEQ ID NO: 151821 - DNA, 601 bp, Human
tgtaaagtcttatgaaaattttcacggaattagtatgcatgaatcacgtcaaacataacatttttccatttgaacagtttgggaaagagctttctttgtttctaattctagggctagattttcagtaatattttaggataatctaaaatttatgttctactttgccctatatgcaagcattccaaaaatcaaattttttttattaaaaaggaaaaaaatatcaaaatatatagaaaattatttttaaacattttagttagtggtatacatctatatcatattaaacaaatcttattggaasctttgcatgtatgaaacttctataagtgattggctataaaaagtctgaaaccaaagtttaattcttttagccaaaatagactgcagctatcattctgtgaattcaattttctaggaaaatttaccagcatcctgaaaccatttcatgattgaatggctagtatattattcttgatgtttttctctgcaatcaattccactaaaccaatgaaactctgtaacaaaattagcctcaatatgagtacattcttccggatgtaataaggaaacaagaaattcatttccagataaatttcaatat

SEQ ID NO: 151822 - DNA, 601 bp, Human
gactccagcctaacagcaaaggaggctgggcactggagagaagcacaaggctatctggtgagcactaacggcctctatcacagtgccttttgcccacttcttctcacatagagaataaaactagcccatctccaaatgagacaacacaatcaatgctgtttttgaactgtttttctcttcttttttggcttcatctattaattcctggatccatacaatactattgggatgaatatgacttataatatcctgaccctttgcattgcacgtctattcttctttcttcttttgtaaaaatgctttttttttttttttttggagctttactattactatggccacttgctcttccccaaaagactttcataataacttggacaaatgtctgcttcagaaaacaaaacaaatttaaaacactgggtccctgataggaatggcattaaattataaattatgttggggtaaactgaggtatttatattatttagtctttatctgaagattttatcctttttttcttatagattctgaacatttcttattaaagtgatttctaactattttatatctacatttttaaaaatttagatttagtttagat

SEQ ID NO: 151823 - DNA, 601 bp, Human; identical to SEQ ID NO: 40453

SEQ ID NO: 151824 - DNA, 601 bp, Human; identical to SEQ ID NO: 40452

SEQ ID NO: 151825 - DNA, 601 bp, Human
agttaagtttctgatagattcttttattgcattatctagtctgcaattatcaggcttaacaggataatttgattatctccttcttcccctgagcttcattgttggtcttaaattagtatatattcaatttacataccatggtagctgcgctcattggtagcagtaatttcacctctaacagtagagggttgtgctttgatcctggcacttaaacgtaataacattaatagaaaatggtagtgtctcatttccttttcaaaacactctctatgttcattactaactaatcccatctctgcckcttgagagagatgcaaatgaatcagacgaaccatagattgaaataccgcaagtttagcttgagttacatcatgaacctgatcatagtcaaaggaagaatcaagagtactaagaattttgttttgaatgtagttcccatactttaaatacatatctcttttctgaagatgttttgtcctgaatggaactttaaaacatattgccttatttccctttgccctcattagtggaaatgtaaagtttccaattctcttgaaaattaaaaaatccaatttcccttttgaaatgcagtaggcaacag

SEQ ID NO: 151826 - DNA, 601 bp, Human
aataaaaagaaaagaggaaatttaaaacttatatttatgcaacccggggatagcttctattaacattaacatgttgttgtattgtctttcatttcaaatatttttctatgcaaaaatatatttcaaatggaattacgttatacatatagttttagaatccttttttcttaatgtatcatgaacatcttttcacatctgtaagtattcagctacattttaaaaataggtagtattctgctttttggaagaatcaaaatgtatttagccagggttgtaatatagaacccttaagttgttttcrgttttgatattgtaaatattaatttattgaacaagtgcaggtgtcacaggatggtttgggatgagtttaaccatcccctcaatctcagccaagcccttctctttttttttgctaaggacagttaatgttttcatagcaaaatgctatgccaacagagctcaggtttacctctcttccaattagattttcacctaattctttcctaaatagaaattctagaattaccactagtgtctaatattcttgtacctaaatcatttaccatgttatccattatttccctaggataaattcccataa

SEQ ID NO: 151827 - DNA, 601 bp, Human
ttgctgggaaacacaaggaagcaacttcccctgaacggatcctttcagtttgtatagacaagagtaacactggatttaatgggcagtaggtagagggtaaggggatcgttagtatgtttcctctgaagaatcaccagtaatatgagtcagctgtaaataccagttgatcaaatattttaggggctgtaatcccagcactttgggaggctgaggcaggcagatcacctgaggtcaggagttcgagaacagcatggccaacatggagaaaccccatctctactaaaaatacaaaaattagccrggcatggcagtatgtgcctatagtcacagctactcgggaggctgaggcaggagaatcacttgaacccaggaggcagaggttgcagtgagctgagattgtgccgctgcactccacacttcagcctgggtgacagagcgagactctgtctcaaaagaaaaaaaaaattagaggaaaagatgaaagggttgagatgaagaactgaaagatgaacatctccctaccctccaacctattaggaaagataaattgttcttagaaactgtgggggcagaaggagtcctggaagaatctagaaatgag

SEQ ID NO: 151828 - DNA, 601 bp, Human
tctgtcacccaggctggagtgcagtcgctagatatcggctcactgcagcctctgcctcctaggttcgactgactctcctgcctcagcctcccgagtagctggaactacatgtgcgcaccactacgcccagctaatttttctatttttttagtagagatggggttttgccatattggccaggctggtctcgaactcctggcctcaagtgatcctcctgtctcggcctcctaaattgctgggcttacaggtctgagccaccacactcagccaaaaaaagatttttttttttaatgaataaatrttgaagggcttttggaataggatgtaagaggatacaggtagtatttctggtagaagtgatctgccaggttatgagtaatacagcctttaaatcttgatagaaataagcatcctgcagaaaccacctggctggatagaagatatggctgatgctcttctagtatctggcgtaaagacaactttccaatttgtatcctgagtttgagtcacaaactgcatcaccatgaatacatctctgaatctctcttagcccttgttgattgcctataaaatggggataataatagctacctcacaggct

SEQ ID NO: 151829 - DNA, 601 bp, Human
ctcgaactcctggcctcaagtgatcctcctgtctcggcctcctaaattgctgggcttacaggtctgagccaccacactcagccaaaaaaagatttttttttttaatgaataaatgttgaagggcttttggaataggatgtaagaggatacaggtagtatttctggtagaagtgatctgccaggttatgagtaatacagcctttaaatcttgatagaaataagcatcctgcagaaaccacctggctggatagaagatatggctgatgctcttctagtatctggcgtaaagacaactttccartttgtatcctgagtttgagtcacaaactgcatcaccatgaatacatctctgaatctctcttagcccttgttgattgcctataaaatggggataataatagctacctcacaggctggttgcaagaactgaattatataaggtataataactttcttcagactatgaggcttaataaaattttcatactcttaaacagtattagagacagatttccactatttaggcaactgttttctaatgatgatggtttggtgaactcttggcttgccttgatgacaatttcacctttcagaaaaagaa

SEQ ID NO: 151830 - DNA, 601 bp, Human
catttggaatgaagatcagactaaatctctgtctagctctgaagagtaaaattaggatccattggtagaagacagaggaaacagatattggctctgtattaggaaaatcttggagagtgatccaaaagtgaaatggacttctctgcaaagtaatgagttccttgttactggaaatgtgctggtagaggctgcacttttattgaaggaatttgtgaagtgagatattaagctggatgacttataatgctaatattttgtcattgtaccaaggctagagaagtttcataggcacttaagaaaytgctttgcacctctttcctgtaacatgaccttgggcttctgtgcacactcactgctttgttgtctactagatagttgcatactatgatgaatctcatactttttcaaaacacaaagtcctctgcagatgtttagcataattgctgtgtttcctttcactagatagatgtgtgtgtgtgtgtgtgtgtgtgtgtgtgtgtgtgttactctgtatactttacatttattcaaattgccataagaaaactttgaaacagactgcatttatcacagctaggagtcacccagagtactttcagaa

SEQ ID NO: 151831 - DNA, 601 bp, Human
gggcttctgtgcacactcactgctttgttgtctactagatagttgcatactatgatgaatctcatactttttcaaaacacaaagtcctctgcagatgtttagcataattgctgtgtttcctttcactagatagatgtgtgtgtgtgtgtgtgtgtgtgtgtgtgtgtgtgttactctgtatactttacatttattcaaattgccataagaaaactttgaaacagactgcatttatcacagctaggagtcacccagagtactttcagaaaaagcaatttgctgatttaccttttgtatgtayttccaaagcactaaagttacaaagacctagtgtatagggcatgaagatgaataagcaaaggcaaacaagaatatccatcacaagagacattaatgtcaaggaggcaatttttaaatgtacaattatttaaaaagaagaggaaagattgacaatgatggcttccatcatatgtttaaaagtgccaaagagcaaagccatttgccaaacaaagcaaagagctccagactacctttgtgagtttgctgcctgcaggccaggccactctggactcctttgcccaagcagacaaaatattatcat

SEQ ID NO: 151832 - DNA, 601 bp, Human
attgttgttatccttagtagagatggggtttcaccatgttggccaggctggtctcaaactcctgaccaaattgtcaattacacaaagatgccaagtttagagggaaaggatttatataaccaacaaagtgttccacattttaaaaaagacataattgtgagtaataaaagtcagagtggacacactctattttatctattttttttcacttcccataagtagttgtagtggtgccctcagatactatgggatgtgggaaaatcagtaagatatagacttggcagcatgaagggacttaagktggtgggaagattagggccagtcctgggataaggagttgaaacattatttagaatccactagggagttattgaaggatttcatttgcttgcttgctttgaggaggcaataacgatcagaacagtcctataagaagttcaatctctcagtccaaaaagtccgtgcagaaagagacctaaagtaggaaggggagtcaggaatctaacagagcagcccagaggtggagcagagtcagagacaccgtttgagatccgagcacccactgactgacagccttcagttccaatccaatctgcactgc

SEQ ID NO: 151833 - DNA, 601 bp, Human
tcagtaagatatagacttggcagcatgaagggacttaaggtggtgggaagattagggccagtcctgggataaggagttgaaacattatttagaatccactagggagttattgaaggatttcatttgcttgcttgctttgaggaggcaataacgatcagaacagtcctataagaagttcaatctctcagtccaaaaagtccgtgcagaaagagacctaaagtaggaaggggagtcaggaatctaacagagcagcccagaggtggagcagagtcagagacaccgtttgagatccgagcacccrctgactgacagccttcagttccaatccaatctgcactgcattctgggtactaaccctgcacaataaccagctgcaattgccaagaaaacctgtgcagctggtggtgagtgaaaaccaaggatgtgaactcaatgtgctgcagctgaagaaacagagttgtacctggaaccgcccagtgggttcaccttgcccactgcctacacagaacccatttatcaagacaggggaattgcaatggagaaagggtaattcacgtagagctggctgtgtgggagaccagagttttattattactcaaat

SEQ ID NO: 151834 - DNA, 601 bp, Human
agaaatgattgggccacattactggtctgggtggtgtcagctgatacatccagtgcagggtctgcaaaatatctcaagcactgatgttaggctttacaatagtgatgttcccccaatttggaggtatttggggagcaatttggggattgctcagactcttggagccagaggctgcatgacctctaaactgtaatttctaatcctgtagctaatttattagtcctgcaaaggcagactggtccccaggcaagaagagggtcttcgggaaagggctgttatcaattttgcttcagagtcaaascatctactgaattccttcccaaagttagttcggcctgtgcccgggaatgaacaaggaaagcttaagtgttagaagccagatagagtcggttaggtctgatttctctcactgtcataatttcctgagttataatttggcaaagacagtttcatacccagtgactgttttcctgagtgctttccagggtggtggccaggcagaggtgtggtcgagtcgggaggtgggatggttccagcctcaggggcctggcttcttcttccttcctggagggacaaaatggtcatcttcctcctgctgtag

SEQ ID NO: 151835 - DNA, 601 bp, Human
tccttcccaaagttagttcggcctgtgcccgggaatgaacaaggaaagcttaagtgttagaagccagatagagtcggttaggtctgatttctctcactgtcataatttcctgagttataatttggcaaagacagtttcatacccagtgactgttttcctgagtgctttccagggtggtggccaggcagaggtgtggtcgagtcgggaggtgggatggttccagcctcaggggcctggcttcttcttccttcctggagggacaaaatggtcatcttcctcctgctgtagtgttttcccctgygttttgttccttctgctatgtgtggatgtgttgggataagatagggcaagatgagcaccgggaaagggggctggcaagaggaagggaaccctgtctgttctcttccccttcccagtgatgctgcctctggagaaggtgaggaaaactcgcacccaacaggctgcaggctcctggggccagagctttctgctttttccagactccatatgactgatgtgaaaacgttgagtttcctgagcctgcttgccctctgggtagtctaactgctctgataataaaataagtgtagaggcactgaag

SEQ ID NO: 151836 - DNA, 601 bp, Human
tgcgttttcttttgctattgtcatgagatctaggggcatgagggatttgtcatttgagtgttacattgcaacaaaaagcaaggcagaagtacagaatccacttaaatgagagtatgaacacaataggaggttttgctacctggaattagatgttgaattgctgctctctaaactttattttctatataaaaagctttaaatacaatcatttaattattcatttaaagtttatattaacaacatttagtgtgcacctgctatatgtaaagtatcccactaggtactattcatcaaattaaasccagctatttagttatgaaaataaaccatggcccacataccctgtgaagccctgttaaaagcaggcaacatgcccaagaaaatatgtttcctttgaatttcacagaaatcttagtttgaggaagaaaaatcaagagtttttgttataagccactatgtgtatgctctgaaacagttaatgtagagaacagaggtagtggccataactgaaataaggagatagtgagtgagtgtgtgtgtgacctaattcaagtttggtggtccaagtggtatttttcttggcctgtaaaaactacaggta

SEQ ID NO: 151837 - DNA, 601 bp, Human
cacaataggaggttttgctacctggaattagatgttgaattgctgctctctaaactttattttctatataaaaagctttaaatacaatcatttaattattcatttaaagtttatattaacaacatttagtgtgcacctgctatatgtaaagtatcccactaggtactattcatcaaattaaagccagctatttagttatgaaaataaaccatggcccacataccctgtgaagccctgttaaaagcaggcaacatgcccaagaaaatatgtttcctttgaatttcacagaaatcttagtttraggaagaaaaatcaagagtttttgttataagccactatgtgtatgctctgaaacagttaatgtagagaacagaggtagtggccataactgaaataaggagatagtgagtgagtgtgtgtgtgacctaattcaagtttggtggtccaagtggtatttttcttggcctgtaaaaactacaggtatttgcaaaactgttctaaatagtaatgtaatagaagttttttaaaaattgagttagtgcatatgtttggactcaatttctccctcttttggttactatatatggttctaatttccagc

SEQ ID NO: 151838 - DNA, 601 bp, Human
ctttttacatatttaaggggtacatgtgaattctcaacaattaatattaaataaaaggagaagaattctgttctatcccagattagaaataccttagaatttctatttgtgtctatttccctccattccattattttcttcctcttcataccacatttatatacgtcttaccatttatttatatttatttaatactttacttcaggaaacttagtattgttctggaatcagaaagcccttctagctagtctgtcttgccaggtctttccgattcttctccctcaagaagcaagtggtggtraccacgtcgacataagagatttcccgtctgactcctcccaccatctgtgtaggtcacagaacctcacgccaactggctctcttcagactgtggtcaactggaaaatcgagtcagatttcagaagggtgggaaaatgaacctagaaagtctaatgtggagaaagccttaaaatatatccttcatgttccacaatagtgattattatctttggcgatactgcaacataaataggtattcttggctagttcatctctggcggcaccatcttggcatttacactctacagaaaaggtacctgag

SEQ ID NO: 151839 - DNA, 601 bp, Human
gactcctcccaccatctgtgtaggtcacagaacctcacgccaactggctctcttcagactgtggtcaactggaaaatcgagtcagatttcagaagggtgggaaaatgaacctagaaagtctaatgtggagaaagccttaaaatatatccttcatgttccacaatagtgattattatctttggcgatactgcaacataaataggtattcttggctagttcatctctggcggcaccatcttggcatttacactctacagaaaaggtacctgaggagaaagatggtccaagttacttgccacaratcacacagattaacagcagcacagtctgggtgtatatgtgtaatatatatctttttattatttttatatacaagtaatggttgtttcttgtagaaaagttaaaacaatgaagatgagcaggaagaaaaaaataccatccaaacacccagcaaataaccatactaatgtagacatattttcttctaatcttctaggtatgtatgtatacatatatgtacatatatatacacatgcacacttttttctaaacccatattgacctataacctccttttttttttacttaacaaaatactggg

SEQ ID NO: 151840 - DNA, 601 bp, Human
agttaaaacaatgaagatgagcaggaagaaaaaaataccatccaaacacccagcaaataaccatactaatgtagacatattttcttctaatcttctaggtatgtatgtatacatatatgtacatatatatacacatgcacacttttttctaaacccatattgacctataacctccttttttttttacttaacaaaatactgggaatgtctttttgtgtttttaatattcagctattccatagtattccattttataattatactgtaatttaagtagccagccctctccttttggacatayatgttgtgccaagtgttgattacaataagtatttctgaaatgaacattctcacccatacatcttggtgctgctttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatg

SEQ ID NO: 151841 - DNA, 601 bp, Human
tctaatcttctaggtatgtatgtatacatatatgtacatatatatacacatgcacacttttttctaaacccatattgacctataacctccttttttttttacttaacaaaatactgggaatgtctttttgtgtttttaatattcagctattccatagtattccattttataattatactgtaatttaagtagccagccctctccttttggacatatatgttgtgccaagtgttgattacaataagtatttctgaaatgaacattctcacccatacatcttggtgctgctttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatgatgtgtttaccacctcccttatccagcaacatttgcaattagcctccgaccttgttcctgggattgtttccggtgaaaattagcc

SEQ ID NO: 151842 - DNA, 601 bp, Human
cattttataattatactgtaatttaagtagccagccctctccttttggacatatatgttgtgccaagtgttgattacaataagtatttctgaaatgaacattctcacccatacatcttggtgctgctttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaasgctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccatattggtcaggctgatcttgaactcctgacctcgtgatctgcccacctcggcctcccaaagtgctgggtttgggaatggtacctgtggatgcacctagaggtgtgtttagacacta

SEQ ID NO: 151843 - DNA, 601 bp, Human
cagccctctccttttggacatatatgttgtgccaagtgttgattacaataagtatttctgaaatgaacattctcacccatacatcttggtgctgctttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccatattggtcaggctgatcttgaactcctgacctcgtgatctgcccacctcggcctcccaaagtgctgggtttgggaatggtacctgtggatgcacctagaggtgtgtttagacactagctgaaatcactttggtctttctagcaaacc

SEQ ID NO: 151844 - DNA, 601 bp, Human
tcagttttagttcctagaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccwtattggtcaggctgatcttgaactcctgacctcgtgatctgcccacctcggcctcccaaagtgctgggtttgggaatggtacctgtggatgcacctagaggtgtgtttagacactagctgaaatcactttggtctttctagcaaaccttagccaatgggctccactcacaaagggtcagcttccaagagcagattttagctcagggcctcttatgttcaggacaataatggagtaaaaaaacaaggctgaaaaccagaagatatgtgggcttaagcagatatgtgaatagctacccacat

SEQ ID NO: 151845 - DNA, 601 bp, Human
agaagtggcaatgctgggctgttgggtttacacatgtttaaggttctgatgcatgtgactaaattaccctccagaaaagttctgctttaagttctacttaaggctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccatattggtcaggctgrtcttgaactcctgacctcgtgatctgcccacctcggcctcccaaagtgctgggtttgggaatggtacctgtggatgcacctagaggtgtgtttagacactagctgaaatcactttggtctttctagcaaaccttagccaatgggctccactcacaaagggtcagcttccaagagcagattttagctcagggcctcttatgttcaggacaataatggagtaaaaaaacaaggctgaaaaccagaagatatgtgggcttaagcagatatgtgaatagctacccacataggaaaaacaaaaca

SEQ ID NO: 151846 - DNA, 601 bp, Human
gtttagacactagctgaaatcactttggtctttctagcaaaccttagccaatgggctccactcacaaagggtcagcttccaagagcagattttagctcagggcctcttatgttcaggacaataatggagtaaaaaaacaaggctgaaaaccagaagatatgtgggcttaagcagatatgtgaatagctacccacataggaaaaacaaaacaaaacaaaacaaaaacaaaaacagaaaataaggtgggagtccttcttttacaaccatggataccttttcttttctttttttttttttttttgagacaggatcgctcttttgcccaggctggagtgcagtggttcgatcatggctcactgcagcctcaatcccccaggctcaagcaatcctccacctcagtgtcccaagtagctgggactacaagtatgtgccaccacacctggccttttttttttttttttgaaatggagtcttgctctgtcacccaggctggagtgcagtggtgtgatcttggctcactgcaacctccacctcccaggttcaagcaattctcctgcctcagcctcctgagtagctgggactataggcgaacaccaccatg

SEQ ID NO: 151847 - DNA, 601 bp, Human
ccccctctgccacttatcacaccattggttgacctgtgcttgcttccagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagcctcaggtaraaacccacaaaccattctctgaagtggaaaaatgagctgccagtgcctagggagtgcagaggagcgtgctgagaaattcctgctgcaggtcagtgggtctaatgccgcttgcacatcagaatcacctgcggagcttgaaaagcaagtgatagggggctgcccctaggacaaactgaatccgaatctgtcgggtggggcctagcatatttttatgctaggggcatcagcatatttttaaaataccaattctaatgtgatgccgaaattgagagcttgtgctttcaatgataagtagagact

SEQ ID NO: 151848 - DNA, 601 bp, Human
cccctctgccacttatcacaccattggttgacctgtgcttgcttccagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagcctcaggtaaraacccacaaaccattctctgaagtggaaaaatgagctgccagtgcctagggagtgcagaggagcgtgctgagaaattcctgctgcaggtcagtgggtctaatgccgcttgcacatcagaatcacctgcggagcttgaaaagcaagtgatagggggctgcccctaggacaaactgaatccgaatctgtcgggtggggcctagcatatttttatgctaggggcatcagcatatttttaaaataccaattctaatgtgatgccgaaattgagagcttgtgctttcaatgataagtagagactc

SEQ ID NO: 151849 - DNA, 601 bp, Human
ttgtcagaacatccactaacaaaagggagcttagcttagctgcatttggtcttaagataccatcacctctgtcttctgttttactccaggttgatggtatttttattattctgtcattgcacctgctgtagaaattgccacatacatttcttttagaattttgtgctaggcagtgctttgttttctataaagaactagtattctttgtcctttccaataatgtataactggttaaagttcctgaatttcatccgctatataagccaatgtcaaatcagtaactatgttcttctgtaatggyccatattatttttgtctgctacctctcaatcctcactttccatttgttaattcattatattaatatatgctttagttacaagctactctgagccctttgtacagagaagcagggtgtaagcaataatttccattgcaagtaggaatgctgtgcagttttagatagtaatataaaaactatgaatctgatcctagaagttttgcccttgaacaacaggaagcatttttaatcagaaattccaagaaagctaaaatccgaggtttttggggatttttgtttttcagtcatatatagagagat

SEQ ID NO: 151850 - DNA, 601 bp, Human
ttacaagctactctgagccctttgtacagagaagcagggtgtaagcaataatttccattgcaagtaggaatgctgtgcagttttagatagtaatataaaaactatgaatctgatcctagaagttttgcccttgaacaacaggaagcatttttaatcagaaattccaagaaagctaaaatccgaggtttttggggatttttgtttttcagtcatatatagagagatttttaatgtagatttacatatggaaaaaaattaatagaaagatatgctaaactctctttctgcatccccatagtarcgcatgtaatcagaatgacagtcagaaattgtgtcactgcttatttcagaaattagtgttcaccaccaaataagtcaatttctaaaagtcaggactcacccctgacaaagtcatcagaaactgtacttactggaattttctcagaagctctacctccttagaccatggtagtgatcacagtggctcagtctcataatcacctactcactcattcagtcagtcaacaaatgggcacattctaggcattagtgctaccatggtgggcaaagccagtcattttcctgactctgcggagattat

SEQ ID NO: 151851 - DNA, 601 bp, Human
aactatgaatctgatcctagaagttttgcccttgaacaacaggaagcatttttaatcagaaattccaagaaagctaaaatccgaggtttttggggatttttgtttttcagtcatatatagagagatttttaatgtagatttacatatggaaaaaaattaatagaaagatatgctaaactctctttctgcatccccatagtagcgcatgtaatcagaatgacagtcagaaattgtgtcactgcttatttcagaaattagtgttcaccaccaaataagtcaatttctaaaagtcaggactcasccctgacaaagtcatcagaaactgtacttactggaattttctcagaagctctacctccttagaccatggtagtgatcacagtggctcagtctcataatcacctactcactcattcagtcagtcaacaaatgggcacattctaggcattagtgctaccatggtgggcaaagccagtcattttcctgactctgcggagattatagtctgatgtccaatacaatatgtgttaaatagcacatgttgcctaaatcttagctaaatcaaaaagcagaattcctctgaaaatccttagctgtgctc

SEQ ID NO: 151852 - DNA, 601 bp, Human
cagaagctctacctccttagaccatggtagtgatcacagtggctcagtctcataatcacctactcactcattcagtcagtcaacaaatgggcacattctaggcattagtgctaccatggtgggcaaagccagtcattttcctgactctgcggagattatagtctgatgtccaatacaatatgtgttaaatagcacatgttgcctaaatcttagctaaatcaaaaagcagaattcctctgaaaatccttagctgtgctcatttctaaaataaggatgatgacttcactttggcagttaacayaaatgttttgttgtatatagatataataaaggtgattgcaagcagcattcacaagataaaagggcaaggaaattgactttttgactaacaatgaataatatcaacccgtaatgtaaaaatatgataccaactacctaatgatcatagaagatatcatttattcattctcatatcccaaagaagtcagaggctttgctaggcccttgagccaagacaactaaaaaataatactgtttaaaattggggttaacaccttatttattattatctaaattccataaacaaattacagacaattct

SEQ ID NO: 151853 - DNA, 601 bp, Human
ccatggtgggcaaagccagtcattttcctgactctgcggagattatagtctgatgtccaatacaatatgtgttaaatagcacatgttgcctaaatcttagctaaatcaaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggaaattgactttttgactaacaatgaataatatcaacccgtaatrtaaaaatatgataccaactacctaatgatcatagaagatatcatttattcattctcatatcccaaagaagtcagaggctttgctaggcccttgagccaagacaactaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttaca

SEQ ID NO: 151854 - DNA, 601 bp, Human
agccagtcattttcctgactctgcggagattatagtctgatgtccaatacaatatgtgttaaatagcacatgttgcctaaatcttagctaaatcaaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggaaattgactttttgactaacaatgaataatatcaacccgtaatgtaaaaatatgatrccaactacctaatgatcatagaagatatcatttattcattctcatatcccaaagaagtcagaggctttgctaggcccttgagccaagacaactaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagt

SEQ ID NO: 151855 - DNA, 601 bp, Human
gcctaaatcttagctaaatcaaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggaaattgactttttgactaacaatgaataatatcaacccgtaatgtaaaaatatgataccaactacctaatgatcatagaagatatcatttattcattctcatatcccaaagaagtcagaggctttgctagrcccttgagccaagacaactaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagtcaaaaagatagggctggcaggctttaggaaaaaatgtgatcctacaaaattatgtaagatgtcagagggtccaa

SEQ ID NO: 151856 - DNA, 601 bp, Human
caaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggaaattgactttttgactaacaatgaataatatcaacccgtaatgtaaaaatatgataccaactacctaatgatcatagaagatatcatttattcattctcatatcccaaagaagtcagaggctttgctaggcccttgagccaagacaacyaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagtcaaaaagatagggctggcaggctttaggaaaaaatgtgatcctacaaaattatgtaagatgtcagagggtccaagtatacaggactacttgat

SEQ ID NO: 151857 - DNA, 601 bp, Human
actttagtcaaaaagatagggctggcaggctttaggaaaaaatgtgatcctacaaaattatgtaagatgtcagagggtccaagtatacaggactacttgattatgaaaattgcgtgagtaggcaagcacattggcttttgaacagtgtcagcaatctgtggtatgaatgtgatttcttccaggacttcttggaagagctgaagctggtggtgagaggctcactgttccaggtggccagcctgcaagactgcttcctgcagcagagtgagccactggctgccacaggcacaggtgtgggctyttgggcagtttgcatgccttcatcaacacaaactccaaagaccctgaataggctgggtcccatcaccgaaaagtgggactgtcaacagagcagcccaacaaaacgtatctatgaaaatcagtctcttgaacaaaatccagggcacagaatattttcattatgcttttatttttatgattcacatggaatttagacttagtcagtggcatcattatcattattttttttagctgaattaaagaaattaccccaaattaaattcaaagattctgggtttttgaatcatcttgtcaggatgat

SEQ ID NO: 151858 - DNA, 601 bp, Human
aggtggccagcctgcaagactgcttcctgcagcagagtgagccactggctgccacaggcacaggtgtgggctcttgggcagtttgcatgccttcatcaacacaaactccaaagaccctgaataggctgggtcccatcaccgaaaagtgggactgtcaacagagcagcccaacaaaacgtatctatgaaaatcagtctcttgaacaaaatccagggcacagaatattttcattatgcttttatttttatgattcacatggaatttagacttagtcagtggcatcattatcattattttttttagctgaattaaagaaattaccccaaattaaattcaaagattctgggtttttgaatcatcttgtcaggatgatttcctggggaataatttggttttgagtcacttagaaatgaccatcactggctgaaaactctttgccttttgctgttcctacaggggactttaaccggcagttcttgggtcaaatgacacaattaaaccaactcctgggagaggtgaaggaccttctgagacagcaggtaacaagcgggacatatcatcagaaaagccctcgtcttcttagagcagctccccacaagct

SEQ ID NO: 151859 - DNA, 601 bp, Human
tcagtggcatcattatcattattttttttagctgaattaaagaaattaccccaaattaaattcaaagattctgggtttttgaatcatcttgtcaggatgatttcctggggaataatttggttttgagtcacttagaaatgaccatcactggctgaaaactctttgccttttgctgttcctacaggggactttaaccggcagttcttgggtcaaatgacacaattaaaccaactcctgggagaggtgaaggaccttctgagacagcaggtaacaagcgggacatatcatcagaaaagccctsgtcttcttagagcagctccccacaagctagtggagctgcaggcctgcccaggcacgggggcagcctctgagccagatctccgggggcccacgcagccccgcacgccagggctctgctggaagttctctggaaatggggtccaagctcgtgatgaacacaccatggctctaagcagagcgggagccatcaagggctgctaacgctactgtaagaagtgttacagagagccaggtgcggtgcctcatgactgtaatcccagcactttgggaggctgaggtgggcagatcacgaggtgaggag

SEQ ID NO: 151860 - DNA, 601 bp, Human
ttaaattcaaagattctgggtttttgaatcatcttgtcaggatgatttcctggggaataatttggttttgagtcacttagaaatgaccatcactggctgaaaactctttgccttttgctgttcctacaggggactttaaccggcagttcttgggtcaaatgacacaattaaaccaactcctgggagaggtgaaggaccttctgagacagcaggtaacaagcgggacatatcatcagaaaagccctcgtcttcttagagcagctccccacaagctagtggagctgcaggcctgcccaggcaygggggcagcctctgagccagatctccgggggcccacgcagccccgcacgccagggctctgctggaagttctctggaaatggggtccaagctcgtgatgaacacaccatggctctaagcagagcgggagccatcaagggctgctaacgctactgtaagaagtgttacagagagccaggtgcggtgcctcatgactgtaatcccagcactttgggaggctgaggtgggcagatcacgaggtgaggagctcgagaccagcctgaacaacatggtgaaaccccgtctctactaaaaatacaaaa

SEQ ID NO: 151861 - DNA, 601 bp, Human
gaaggaccttctgagacagcaggtaacaagcgggacatatcatcagaaaagccctcgtcttcttagagcagctccccacaagctagtggagctgcaggcctgcccaggcacgggggcagcctctgagccagatctccgggggcccacgcagccccgcacgccagggctctgctggaagttctctggaaatggggtccaagctcgtgatgaacacaccatggctctaagcagagcgggagccatcaagggctgctaacgctactgtaagaagtgttacagagagccaggtgcggtgcctcaygactgtaatcccagcactttgggaggctgaggtgggcagatcacgaggtgaggagctcgagaccagcctgaacaacatggtgaaaccccgtctctactaaaaatacaaaaattagccaggcatggtggtacatgcctataatcccagctactcaggaggctgaggcaggagaattgctggaacccaggaggcggaggttgtagtgagctgagatcgtgccactgcactccagcctgggcgacagactgagactgtctcaaaaaaaaaaaaaaaaaagtgttacatagatagctccacaag

SEQ ID NO: 151862 - DNA, 601 bp, Human
tctagtaatccctcaattggagaaacaactgcatacatttcactgaactgcatctggtttttatctgtgaggtagaattttcctctttctgaaagggcaggaagtggtcatgttttttacattagttgaagtggtttaaaaaaaacaaaaaacaatctccaagattcctagagccttggaatagcatggacttgacaggacatggaggcaggcacaggccctgagggattacatggtaatgaagaggcaccggccctggctttgccttctcgaggtctttctgattgagtagttggtttgstgatgcttttggaggcatctaacagccagctaagtggtccagggacatagtcctttcacagagatttgcaaattccatgtcagaatatcagggagcttattacattgagaggtaggctggttaatatcaaggaccctttcaacatgcatgtgccattattctacagcacagcaaagcctactaaaaagcaacctcagattgtgtggtcagggattcagtgggtaactggagttggaagcctttatttccttttattattttttccaccaaaagatagttaaatgactaaacaagtatgtg

SEQ ID NO: 151863 - DNA, 601 bp, Human
cagctcctcaggaggctgaggccgaaggatcatttgggtacaagagtagtttgaggctacagtgagctgtgatcgccactgcactctaacctgggtgacagagggagaccctgtctccaaaaagaaaaaaaagaaatgttacgtatttagactaaggtcacacatcttccaggttggctacagagcctgagttcttctccgcaatgctatattgcttaggaatagatggggatttattgcttctcagcttttaccaggacaaagtagtctgcaaatagatttgcgagatcttggtgtaaasgtaataactgagccacctagagagaaggaaagtagacagtaaatagaactccaggaaaccccaaaaacgaaggactaggccaaggaaaaagagcagaagccagaaaaaggagcgaactgatagcacagccagggaggctgaaagatcgagacaagtcattggaaagcatgcattggatttggcaactaagaggttgtgagtgacttaaatcattaaacaatatatatacttcaaatggatgtcttttacgacctgtaaatgttatgccaataaaactgcataagatgaaaaagatctaat

SEQ ID NO: 151864 - DNA, 601 bp, Human
gcagatcttaagtgttctcactgaaaaagaaaaaaaggaaggtaactatgtcagttgatggatgtgttacttaactgactgtggtaatcatttcacaatgtatacgtatatcacatcatcacactgcacactttaaatatattcagttttgtcaattatacctcaataaagatgaaaattttaattttcattttttaaacatattgtataatatttattacatatatagtgtgcagtgtgataatatatattatatatataaaagctaaaaaaacctggcccctgaagtgtcattgcagcrgagctgacagctcatttgtcagtttctcagcctacctcatcagaaattctcaatgcaggccaccagcatttctctgtgcacccattcctttgtcattccattgtaaaagagccaaaggaacagcaataagaaaaattaacttgctttttaagcagatcatctccctgtccccagagtaaacttctcacaccacctcccaggacttcactggaacttttgacctgtcccctatgccctccacggtggcgcgggcaactcagtgtcattggttcacagtccagccttcttccttcacttcta

SEQ ID NO: 151865 - DNA, 601 bp, Human
agagtctgtctgccttgacgctcctgttgggggtgggccatcgtgtagaggtggggactgtcatagtccctccgggagaaaccttccgtctttggcaggtgactggcagggccagacggcgccatgctgtatgtctacctccactccaatcagggacagctccatgaatggtcacgcttcctgtgcattctccagccacggagctggtctggggaggggaggctgggaagagagtagagcagtcacagcagggcctgacatgggtcccatgctgagcttgtagtgggccctatgtgaaggmgagggcatgctcctgccatccattcccaaatccaaggatccagagtcctcagcctgccatccattcccaaatccaaggatccagagtcctcagcctgccatccattcccaagtccaaggatccagagtcctcagcctgccatccattcccaaatccaaggatccaaagtcctggggatcctaggcactgaaaaatcagcagacttcagctgcccccctcctctgcacttcctgggatgccaggccctcggccggtggcccgtcagactctggggtcactggttcacagtgatcacccctg

SEQ ID NO: 151866 - DNA, 601 bp, Human
caaggatccagagtcctcagcctgccatccattcccaaatccaaggatccagagtcctcagcctgccatccattcccaagtccaaggatccagagtcctcagcctgccatccattcccaaatccaaggatccaaagtcctggggatcctaggcactgaaaaatcagcagacttcagctgcccccctcctctgcacttcctgggatgccaggccctcggccggtggcccgtcagactctggggtcactggttcacagtgatcacccctgagtagcaagatggattctcggagcccttttccrtctttatctcaaagttatgcttctttatctttatgcatacacaattttccacaatgagcctaccacttttcaaataggaaaaataagagtcaaaaatgagttaataaataaatataatgaagtcagccctccttggcaatacagatattctgtaacaaggtcagatggaagaatgtggtgtatcagagggggaataaccccagcaatttcctgaattcctcatggttgggcttgtttattaccaaaaagcagtcattgagaaacaagtgtatatctctgttgaaatccccattttctgtg

SEQ ID NO: 151867 - DNA, 601 bp, Human
caagtccaaggatccagagtcctcagcctgccatccattcccaaatccaaggatccaaagtcctggggatcctaggcactgaaaaatcagcagacttcagctgcccccctcctctgcacttcctgggatgccaggccctcggccggtggcccgtcagactctggggtcactggttcacagtgatcacccctgagtagcaagatggattctcggagcccttttccatctttatctcaaagttatgcttctttatctttatgcatacacaattttccacaatgagcctaccacttttcaaatrggaaaaataagagtcaaaaatgagttaataaataaatataatgaagtcagccctccttggcaatacagatattctgtaacaaggtcagatggaagaatgtggtgtatcagagggggaataaccccagcaatttcctgaattcctcatggttgggcttgtttattaccaaaaagcagtcattgagaaacaagtgtatatctctgttgaaatccccattttctgtgaacaaattgacaactcccctgggatgatgggtgatggggctcttaatatgtttttgaatttgtaataaggcacaac

SEQ ID NO: 151868 - DNA, 601 bp, Human
gagaataagcaggctgtggctgaggaagtcactggtctgaaagcttttgggtggtgaggccaggaaatttaacctgtgctcacataagtctgatttcccttggcccagactctgctcctcagactctctccctcttccttcctttacctcccgtcccaggtcagctttctctccctctgcgtttccagttccctgtgaccttctgggtcccctcctcccatctcccttctgctgctctgcctgttcctggaagtgggagtgggagggagagttttctctctgagtctccctttatatctttgaatagtgaaccattacactattcaagtgcaattaaatagtttctaagccccacccaacaaggctgagtgactctgggccctccccctgggattgagcaaaggagcagagaggcccttgtcagccaccagcttcctgccaggctcagcttcccaggcctctgatgggctttccctttacagtgtggagtcggttgggctggagatggctatatctgtggaaaggatgtggacatcgacagttaccccgacgaagaactgccatgctctgccaggaactgtaaaaaggtaaggggtgtggg

SEQ ID NO: 151869 - DNA, 601 bp, Human
ggcttttttgaaaattcagcattgtgcctacaccaatatggtgttgtccttttgcagttttgcaccaccccggttccagagaaataattccccaaatccaatgatgatgggtgaggtctgccttctctggaacattcggtacatgcaggcccaggaataaataacatgtgctgttctctttgcagtctgatgtggataatgatctggttggggactcctgtgacaccaatcaggacaggtatggcatgtctcccaactgcagagagacagatgcaaacatccggagagggtttttggtttgtttttttttttgaggcggagtctcactctatcacccaggctggagtacagtggtgcaatctcggctcactgcaagctccgattcccaggtttatgccattcttctgcctcagcctcccaagtagctgggactacaggcgcccgctaccatgcctggctaatttttttgtattttcagtagagacggggtttcaccatgttagccaggatggtctcgatctcctgaccttgtgatctgcccgcctcggcctcccaaagtgctgggattacaggcgtgagccactgtgcccagcccggagag

SEQ ID NO: 151870 - DNA, 601 bp, Human
ctgcctcagcctcccaagtagctgggactacaggcgcccgctaccatgcctggctaatttttttgtattttcagtagagacggggtttcaccatgttagccaggatggtctcgatctcctgaccttgtgatctgcccgcctcggcctcccaaagtgctgggattacaggcgtgagccactgtgcccagcccggagagggttttaaatttcagaacttcctgctgctccattccttgggatctttctgggtggactgagctgctggtgggataatagccctgcctctggtcagaattaccaygaaaattctccctgaaagttctgtatagggtataacggtgtcagaataggttactaggcactccagcaagtgagatctatttcaggagaggtaatatagcatcatgcttcacagatgggctctggaataagacagctagatataaatttcagctccttctcttacatgccagctaaccttaggcaaattacctaatacttttgcctcaattttctcatctgtaaaatgaggatgacaatagatctagctcataggaccatcgtgaagattgagttgatccatggaaagtgctcattatgg

SEQ ID NO: 151871 - DNA, 601 bp, Human
cattagctcttttatttttatattctttcagctcaggaaaacttcaccatcatcccaaaatagaaggctgtcagtttgctgagggattgctattatttcctggtccttgaaatttttttaattcagttttccttatttaagtggaattgttctgtggaagtgagttttgtgaaccctcctagctcaacacgatggagtcccacattaagactcaaggctggatcaactgatcagattctggaagaacatcaccaaaaacagacgtgtgtcactcagccctagcggcacctgcaacccaagkttctaaacccttttgtctccatagggaattcttacaaaggcagccaggacaaggatgagagggaaaggattctaaaagagaaagcaaaaaaagatgtaatttctctcctgatacctggatcagaggttgccctgcagaaaaccagttcctgacccaaaccttactcaaggacagctcctatgaagccacagctctctctctctttttttttttttttgagatggagtcttgctctgtcacccaggctggcgtgatctcggctcactgcaacctccacctcctgggttcaagcaattctca

SEQ ID NO: 151872 - DNA, 601 bp, Human
tcctggtccttgaaatttttttaattcagttttccttatttaagtggaattgttctgtggaagtgagttttgtgaaccctcctagctcaacacgatggagtcccacattaagactcaaggctggatcaactgatcagattctggaagaacatcaccaaaaacagacgtgtgtcactcagccctagcggcacctgcaacccaaggttctaaacccttttgtctccatagggaattcttacaaaggcagccaggacaaggatgagagggaaaggattctaaaagagaaagcaaaaaaagatgyaatttctctcctgatacctggatcagaggttgccctgcagaaaaccagttcctgacccaaaccttactcaaggacagctcctatgaagccacagctctctctctctttttttttttttttgagatggagtcttgctctgtcacccaggctggcgtgatctcggctcactgcaacctccacctcctgggttcaagcaattctcatgcctcagactcccacgtacctgggattacaggtgtgtgccaccatgctggctaatttttgtatttttagtagagacagagtttcaccatgttggcc

SEQ ID NO: 151873 - DNA, 601 bp, Human
aacggaaaacactgtagggcttcctaagagtcagcactttttcatatattgaaatttaatatgcaacattctgattttcatcatttaatctccataacaactctatgaggtaggtactattctcattttacagatgaggacactgagccatagagaggtcaggtgtcatgcctgaggtcacacgctgggcacagtggctgagccaggatttacactgaggctgtctggttccactgcctgtcattgttcccctcacacatcctctgagttgagtatcatctagcagttcccagggactgaytgataggagcatctggtcataaatcatagaaatagacccttatcttctttagtaggaaatgactcacttgttttaagaggttggggatgggaaaattgtctctgaggcccatagggcagccttatctaagggaatgaccccagtgggtttgattttaagagccaaccctggtttaaaaaaaacctcaagcacagactctccttcctaaaaatggatccttcctgttccctgctgaactgtgagccacatcacctgtcctttctcctgcagtgatggagatgggcaccaggacagcacaga

SEQ ID NO: 151874 - DNA, 601 bp, Human
cacattacagtccagaaagtgctgtagacatttgcttatgtgaggtcaagcttaagatccaccagttggtgaactcaactgtaggtaataagaacttcttgaggacagagtggagggcaactgctcaaattgatctttcaaaaaactctgggaggactggcctggtcacccagtacaaggactccagaatggggcctggcaccagctcagacatgtccccagggctcctctcccaacactgatgggaaatcatggccctggttgtgggagcttgagcccttctgttcctcatgcagccccyttccctgccaaggagtggcggtgggtgtgagcgctattgagctcctgtcctttctccaccccactcaggcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccaggtgagtgtcacatgggcggcaatggctcagccttgcctctcaacagaggccct

SEQ ID NO: 151875 - DNA, 601 bp, Human
gacccaggcagtctgaccctagaacccacacttctgatctctgcagcagactgccttctgcatatcctcctcattgtgtaactaagaagtgcaggcacagagaggcttagtagattttccagagtcacagagcaagtcacattgattagaagtatatgttgtatgctccccagttaagggcctgtccaatcagcttaagtgacagtctcagcaaacttatttctattcagctttgagcttttttttaacctttacaagcacatgctttctttgagcacataacacaatagagcaactatttcagataatgaaatctttatatggaggtcagacatcactggccactcactcatatggtgcctgaggttttgagcttccttaaggttacttggccccttcaagactgttctgaactccctcaactctctctgcagggcatggagattgtacagaccatgaacagtgatcctggcctggcagtgggtatgtccagggcctcagttgccactcacatagaattcttccagctactagtgtggtttgtctattgttctaatcttatctggtccctacagggtacacagcttttaatggagttgac

SEQ ID NO: 151876 - DNA, 601 bp, Human
acccggacaggacagtaggaccaagatggggatagaaggagcagagctgaggggacgacccagcgttgtggggttggtgcatttggatggctgtgcccttctgccatgctctgcagagaagcctgagggtggacatgccaatcggtatgaggtaagaggtgtggcagggtctcttctccacaccctcccctgtggcacctctgggccctgtgtaatcacttactagtgcacatttcaccctgactgcagcactatgtcccttacagtctgtcttccctgctggatcacaaactgcatgagrgcagcgcttgtatctttttttttttttttttttttttggagacggaatcccactctgttgccaggcaggagtactgtggcgtgatctcagctcactgcaacctccgccttcctggttcaagtgattcttctgcctcagcctcccgagtagctgggattacaggcacgcgccatcacgccaggctaatttttgtatttttagtagagatggggtttcaccatgctggccaggctggtcttgatctcctgacctcgtgatccacccgcctcggcctcccaaagtgctgggattacaggcatg

SEQ ID NO: 151877 - DNA, 601 bp, Human; identical to SEQ ID NO: 19520

SEQ ID NO: 151878 - DNA, 601 bp, Human; identical to SEQ ID NO: 19521

SEQ ID NO: 151879 - DNA, 601 bp, Human; identical to SEQ ID NO: 34699

SEQ ID NO: 151880 - DNA, 601 bp, Human; identical to SEQ ID NO: 34700

SEQ ID NO: 151881 - DNA, 601 bp, Human; identical to SEQ ID NO: 34701

SEQ ID NO: 151882 - DNA, 601 bp, Human; identical to SEQ ID NO: 34702

SEQ ID NO: 151883 - DNA, 601 bp, Human; identical to SEQ ID NO: 34703

SEQ ID NO: 151884 - DNA, 601 bp, Human; identical to SEQ ID NO: 34704

SEQ ID NO: 151885 - DNA, 601 bp, Human; identical to SEQ ID NO: 34705

SEQ ID NO: 151886 - DNA, 601 bp, Human; identical to SEQ ID NO: 34706

SEQ ID NO: 151887 - DNA, 601 bp, Human; identical to SEQ ID NO: 34707

SEQ ID NO: 151888 - DNA, 601 bp, Human; identical to SEQ ID NO: 34708

SEQ ID NO: 151889 - DNA, 601 bp, Human; identical to SEQ ID NO: 34709

SEQ ID NO: 151890 - DNA, 601 bp, Human; identical to SEQ ID NO: 34710

SEQ ID NO: 151891 - DNA, 601 bp, Human; identical to SEQ ID NO: 20245

SEQ ID NO: 151892 - DNA, 601 bp, Human; identical to SEQ ID NO: 20246

SEQ ID NO: 151893 - DNA, 601 bp, Human; identical to SEQ ID NO: 20247

SEQ ID NO: 151894 - DNA, 601 bp, Human; identical to SEQ ID NO: 20248

SEQ ID NO: 151895 - DNA, 601 bp, Human; identical to SEQ ID NO: 20249

SEQ ID NO: 151896 - DNA, 601 bp, Human; identical to SEQ ID NO: 20250

SEQ ID NO: 151897 - DNA, 601 bp, Human; identical to SEQ ID NO: 20251

SEQ ID NO: 151898 - DNA, 601 bp, Human; identical to SEQ ID NO: 20252

SEQ ID NO: 151899 - DNA, 601 bp, Human; identical to SEQ ID NO: 20253

SEQ ID NO: 151900 - DNA, 601 bp, Human; identical to SEQ ID NO: 20254

SEQ ID NO: 151901 - DNA, 601 bp, Human; identical to SEQ ID NO: 20255

SEQ ID NO: 151902 - DNA, 601 bp, Human; identical to SEQ ID NO: 20256

SEQ ID NO: 151903 - DNA, 601 bp, Human; identical to SEQ ID NO: 20257

SEQ ID NO: 151904 - DNA, 601 bp, Human; identical to SEQ ID NO: 20258

SEQ ID NO: 151905 - DNA, 601 bp, Human; identical to SEQ ID NO: 20259

SEQ ID NO: 151906 - DNA, 601 bp, Human; identical to SEQ ID NO: 20260

SEQ ID NO: 151907 - DNA, 601 bp, Human; identical to SEQ ID NO: 20261

SEQ ID NO: 151908 - DNA, 601 bp, Human; identical to SEQ ID NO: 20262

SEQ ID NO: 151909 - DNA, 601 bp, Human; identical to SEQ ID NO: 20263

SEQ ID NO: 151910 - DNA, 601 bp, Human; identical to SEQ ID NO: 20264

SEQ ID NO: 151911 - DNA, 601 bp, Human; identical to SEQ ID NO: 20265

SEQ ID NO: 151912 - DNA, 601 bp, Human; identical to SEQ ID NO: 20266

SEQ ID NO: 151913 - DNA, 601 bp, Human; identical to SEQ ID NO: 20267

SEQ ID NO: 151914 - DNA, 601 bp, Human; identical to SEQ ID NO: 20268

SEQ ID NO: 151915 - DNA, 601 bp, Human; identical to SEQ ID NO: 20269

SEQ ID NO: 151916 - DNA, 601 bp, Human
ttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtatgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagc

SEQ ID NO: 151917 - DNA, 601 bp, Human
tctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtrtgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggccc

SEQ ID NO: 151918 - DNA, 601 bp, Human
ttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcrgttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaat

SEQ ID NO: 151919 - DNA, 601 bp, Human
gaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaatyagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaattttttttttttttttgtatttttagtagagatg

SEQ ID NO: 151920 - DNA, 601 bp, Human
atctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaagggctcatttagttgttgtgaattttaagggatattttcaatgatgttggctggtttatcccattatgtggtctttttttttttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctg

SEQ ID NO: 151921 - DNA, 601 bp, Human
tgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcattkgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctc

SEQ ID NO: 151922 - DNA, 601 bp, Human
tctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttata

SEQ ID NO: 151923 - DNA, 601 bp, Human
cgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagmcctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaa

SEQ ID NO: 151924 - DNA, 601 bp, Human
cgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgygtctgaaaccaaatcattgtttttgtttttaacttttttcttaatatattatccttagttcagccctgaagtttattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattatta

SEQ ID NO: 151925 - DNA, 601 bp, Human
tctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctatraggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtga

SEQ ID NO: 151926 - DNA, 601 bp, Human
gtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatyttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttt

SEQ ID NO: 151927 - DNA, 601 bp, Human
taaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacycaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggagg

SEQ ID NO: 151928 - DNA, 601 bp, Human
agtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatactcaggaagaagcaaaaagaaagatggaggtgcagctagaggttgtggcctttgaasgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcac

SEQ ID NO: 151929 - DNA, 601 bp, Human
tttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtrtcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaatttttta

SEQ ID NO: 151930 - DNA, 601 bp, Human
taataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacacygtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttc

SEQ ID NO: 151931 - DNA, 601 bp, Human
tgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaamccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacaca

SEQ ID NO: 151932 - DNA, 601 bp, Human
ctgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttg

SEQ ID NO: 151933 - DNA, 601 bp, Human
ctttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaargctctgaggtgagttgtttgcccagagtcacccagtgctgtttgaacccactcacataaccaaccaataccattacgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacct

SEQ ID NO: 151934 - DNA, 601 bp, Human
ctcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgargtgagttgtttgcccagagtcacccagtgctgtttgaacccactcacataaccaaccaataccattacgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttat

SEQ ID NO: 151935 - DNA, 601 bp, Human
gaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccrcgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactg

SEQ ID NO: 151936 - DNA, 601 bp, Human
ctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagccygtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggttt

SEQ ID NO: 151937 - DNA, 601 bp, Human
cacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagygagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttc

SEQ ID NO: 151938 - DNA, 601 bp, Human
ctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcrctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctg

SEQ ID NO: 151939 - DNA, 601 bp, Human
gggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagmtctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagc

SEQ ID NO: 151940 - DNA, 601 bp, Human
tatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccacta

SEQ ID NO: 151941 - DNA, 601 bp, Human
agatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagarttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtct

SEQ ID NO: 151942 - DNA, 601 bp, Human; identical to SEQ ID NO: 34627

SEQ ID NO: 151943 - DNA, 601 bp, Human; identical to SEQ ID NO: 34628

SEQ ID NO: 151944 - DNA, 601 bp, Human; identical to SEQ ID NO: 34629

SEQ ID NO: 151945 - DNA, 601 bp, Human; identical to SEQ ID NO: 34630

SEQ ID NO: 151946 - DNA, 601 bp, Human
attagcgggtgcaagagcatgcacgtgtagtcccagctacttgcgaggctgaggcaggaggatcccctgagcccaggtgacagaggccacagtgagctatgattgtgccaccgcactccagcctgggaaacaagagcgagaccctgtctctaaaaaaacaaaacaacaaaaacaaacaaaaaaaatcatagttctactaggttgaaaatcgttatgttttgggaagtttctggcttaattaccaggtttaaaaataaatgtgtgcagtttatttcaattatacatcaagaaaaaaaaaaaacaaaaacagaaggctgggcatggtggttcacgcctgtaatcccagcacttcaggaggctgaggcaggcgaatcagaaggtcaggagttcaagaccaacatagtgagaccccgtctctactaaaaatacaaaaaaaaaattagctgggcatggtggcaggcgcctgtaatcccagctactcaggagaggctgaggcaggagaattgcttgaacccaggaggcggttgcagtgagccgagatcacgccactgcactccagtccagcgacagtgcgaaattccatctcaaaaaaaaaaaaaaa

SEQ ID NO: 151947 - DNA, 601 bp, Human
aggaagactgtttgaggccaggagttcaagacaagcttgggcaacaaagcaagacctcatttctacaaaaattaaaaaattagcgggtgcaagagcatgcacgtgtagtcccagctacttgcgaggctgaggcaggaggatcccctgagcccaggtgacagaggccacagtgagctatgattgtgccaccgcactccagcctgggaaacaagagcgagaccctgtctctaaaaaaacaaaacaacaaaaacaaacaaaaaaaatcatagttctactaggttgaaaatcgttatgttttggsaagtttctggcttaattaccaggtttaaaaataaatgtgtgcagtttatttcaattatacatcaagaaaaaaaaaaaacaaaaacagaaggctgggcatggtggttcacgcctgtaatcccagcacttcaggaggctgaggcaggcgaatcagaaggtcaggagttcaagaccaacatagtgagaccccgtctctactaaaaatacaaaaaaaaaattagctgggcatggtggcaggcgcctgtaatcccagctactcaggagaggctgaggcaggagaattgcttgaacccaggaggcg

SEQ ID NO: 151948 - DNA, 601 bp, Human
ctgccaggcacaaacaatcctcccacctcggccacacaaagcaatggaattacaggtgtaagccaccgcacctggccaggggtatcaatgttttattcaaggctggtaacttggggctgttacacagagacttgagagacttttgacctgattaaaaaaacaaaattttttttaactacaaatcttcaaggaaatccatcagcaactcttcatatagcaaatctctgagtaagagaaacctctatacaacatttcactctgctttttgtttaacattaaaggttcttttttttttttttttaaatgaaacagggtctggctctgctgcccaggttggagtgcagtggcatgatctcagctgaatccaaccttgacctcccagactcacaccatcctcccacctcaatttcctgagtagctggaattacaggagtgcaccaccacacccagctattttttgtatttttagtattgatggggtttcaccatgctccccaagctggtcttgaactcctgggctcaaatgatccaccagcttcagcctcccagtgttaggattacaggtgtgaggaccatgccttgccccaaaattctcttattc

SEQ ID NO: 151949 - DNA, 601 bp, Human
tatttttggtagaaacggggttttaccatattggccaggctggtctcaaactcctgacctcaggtgatccaccggcccgggcctcccaaagtgctgggattataggtgtgagccactgcgcctggccaactgattacattattaaccactggtgactgagctcaatctccacaccttccctctctggaggtggcagggggaccactgaaagttccaaccctctaaaatcatagctttgtccttctggtgaccagcccccatcctaaagctatctagagatccccagataagggatcccttmctcattaattagtatctattttgtgtgtgcctacatcctgaactgggacaatggctacagtcatttcagaaatctcattagcgtaccaaagaccctgttatcacttcggagattccaaggattttagcagttgtgagccaagaacgtaaagaacaaatatttattttttattatatgacagtcagcctggcaccagtctgtggcgtggtctttgggcatcactccaatagatgacattatcaaagagggaaaggcagaagccatggggaattaggatcaagtgatggaatggaatggaaa

SEQ ID NO: 151950 - DNA, 601 bp, Human
tatttacttcttattattattattttgagactgagtatcactctgtaactcaggctggagtgcagtggcgtgatctcggctcactgcaacctccgcctctcgggttcaagtggttcttctacctcagcctcctgagtagctgggactagaggcgcacgccaccacacctagctaatttttgtatttttggtagaaacggggttttaccatattggccaggctggtctcaaactcctgacctcaggtgatccaccggcccgggcctcccaaagtgctgggattataggtgtgagccactgcrcctggccaactgattacattattaaccactggtgactgagctcaatctccacaccttccctctctggaggtggcagggggaccactgaaagttccaaccctctaaaatcatagctttgtccttctggtgaccagcccccatcctaaagctatctagagatccccagataagggatcccttcctcattaattagtatctattttgtgtgtgcctacatcctgaactgggacaatggctacagtcatttcagaaatctcattagcgtaccaaagaccctgttatcacttcggagattccaag

SEQ ID NO: 151951 - DNA, 601 bp, Human
tcttctttttattgccaagcataatgtcaaggtcatcctctggttcagttggttcttgaacatcactttcaatcttaagatcctaagaaagtgagatgagtctgaacatttgatactgggactattcttttttatttattttattacattttctgttgagatgaggaggtcttgctttgttgctcaggctagtctcaaactcctggcctcaagagatcctcccgccctggcctcccaaaatgctgggattacaggcatgagccaccacacccagcctgttcttttttaaaaatgacgtggrctgacattattttggcagggaaaaaaatcacatattcaaaattgaagttacagataagaaacgcctgtcagaaatggaccaaactggctcacagagactctgccatttgaactgtgaattcttcaagacacttgtgggatctttccccctcattcatctctttattcttcagccttaggatcttataattattgtccttatttccaaaccaggctactgtcagaatcacggcagaggccaggcgtcttggctcacacctgtaatcccagcactttgggacgtcgaggcaggtggatccct

SEQ ID NO: 151952 - DNA, 601 bp, Human
tcttctaatttttctacaatgagtatatactactattgtcattagccaaaaaaatctaaactatttaaatatatgtaagtaatgaaaacaagtggttatctctgggtggtaaaattttgagtgaatattatctcttttgtgtttaccatattttctacaacaagcatgtagcacttaggaaattaaagaacaaagagtggataaactcagtggtcctaaggaaactgccagaaaacatgcagctgaggagctcagagaaaagccattcccagacagtaacccagggctgactctggcatasaatgtgatggtaattaagaaagatacaatctcatcaattgtgtcctggcaatgatcatccaaggaagaggcacccaaattcaggcactttccctgagctcactgcttgcttggcaggcctatcctagagcaactgatgagcctttccactccctgggctcccaaggctcctgagaactacattgagcctcctcactcttcactacatctagttaggatccatcctcagtgggtcagcatgagttgatttctctcacctctgaatgcactaataaaacaagccctcctgggcaacacagca

SEQ ID NO: 151953 - DNA, 601 bp, Human
ccattcaatattttcatttcattttttaaatctatactgtggcactgaacttgttccaacaagcaggtgctaactacaacaatttttaagcttttttccccaaaatgcaataggtgagaactggtaaaaatataataaaataggtaagctcctacattgctagcgggagtatgaactggcacgaccttgctagaaagcaatgtgctaatgtttgccataaaaatatccattccttttaactcagcaatttcatcttgccttaagattctattctgagctactggaaagatacatgtataaagatgttcggtgaagttttgcctctgataataaaaacctgggagcagccacgtccaacttatggaactgttaaaatatgttgtgtagctatttaaaacacttactcagactaatgacatgagtaaaactttcacaatatattgagaaaataggttaaaaaccagtatgatagcaatttatttttaaaatatgtacataaaactggctaaacagaaaaatattaaactatgataagttagctacctcttttttttttttttttttgacagagtctcacactattgcccaggctgtagtgtgc

SEQ ID NO: 151954 - DNA, 601 bp, Human
cttctttttaaagaagtaaaaaaatctgaagcaaatgtgtcaaaagttcaacatataccaaacctaggtgatggatacttggatgttatcaaacaggcttataaatatatatgttaatccatatatatttcatgtgtaaaattttcattaaaagaaagtgtatgtctagaagggttccatggtagcacaacagaaaaatggaaacatcttaaatattcaccaactagaggagtggttaaataaatccattcaagggtgtattctacttttagaaatatctcaatatacaaaaaaaaaaaaatgtacatacacatataaaataaaaaacacaaatatagagcaatgccattcaatattttcatttcattttttaaatctatactgtggcactgaacttgttccaacaagcaggtgctaactacaacaatttttaagcttttttccccaaaatgcaataggtgagaactggtaaaaatataataaaataggtaagctcctacattgctagcgggagtatgaactggcacgaccttgctagaaagcaatgtgctaatgtttgccataaaaatatccattccttttaactcagcaatttcatctt

SEQ ID NO: 151955 - DNA, 601 bp, Human
ccatattacattttatgactacatacatgtgcgtaagcatctagaaacaaggatggaaaacatcaacaccgacttcagagaataacaacttcctctgggaaggaaaaaggggccaggaaaagatacaaaggtggccttaattataactataaaaccacctttttcttttgtttttgagactatcataaaatagcataaaaccttctttttaaagaagtaaaaaaatctgaagcaaatgtgtcaaaagttcaacatataccaaacctaggtgatggatacttggatgttatcaaacaggctwataaatatatatgttaatccatatatatttcatgtgtaaaattttcattaaaagaaagtgtatgtctagaagggttccatggtagcacaacagaaaaatggaaacatcttaaatattcaccaactagaggagtggttaaataaatccattcaagggtgtattctacttttagaaatatctcaatatacaaaaaaaaaaaaatgtacatacacatataaaataaaaaacacaaatatagagcaatgccattcaatattttcatttcattttttaaatctatactgtggcactgaacttgtt

SEQ ID NO: 151956 - DNA, 601 bp, Human
gtggctgcagtgaggtagagaagtttctgccttcttaaatacatctacaaagaactccacaagcccaggctgagaatttagctgggcacccagaccagggaagcgcagctattcgaggggtaagaaaacacaagctgtctgctgtggcgcttccggcactaaacatgggctgatactcaatgccccaggatgcaaggaagcctgccagcttgcttattctcgtttctgtctagaggagagccactcaaacatgttgacagacatgccaattttaaataactaggaacaaaagggggccaargccaggcctgaatcacaggcaagtttctctgacttggccttcagccctacaatcaaccagcagcttcaatcagctgggctttctttaaaaatccaaatccttttctatctatacccctagttagtaggcaagagccacctccctttcactatcattttgtctctgatctttttaaggccagcttttcccagctcactgcaatcaaatggctcttcctctaacactgcagcctcatgagaacatttcagggtgatctaatgaaatgaattatacacttactgatatatcttctcaagacat

SEQ ID NO: 151957 - DNA, 601 bp, Human
ttcctgtggttgtgggcctgaggtctccatttccttgctagctgtctgctaggagttgctctctgttcctcaaggccattggtatttcttctcacatggcccctccacctttaaaccagtaatggcatggtgagtccttactcttcaattctctctgacttcctcttcagccaccagccagagaaaactgctattaaagggttcacctgtttgggtcagcccacctggataatctctgaattgtaaggtcagctgacttggggctttaattatacctgcaaaatcactttataacagttcytaaatttgtgtttaaatgaataatcagtggatggaaatccagggggaggagtatgaatgtctttagaattctgcctaccatttcttgtattagcatggaaatgactccaaatctgtagggactttaggcatacactactgcacctggcttgctggatggagtgtcttcaagcaaatatcagacatattgttgtacttgtatctcttattctatttatttatttattttgtagagatgaggtctcgctatgttgcctaggctggtgtcatgaactgacctcaagcaatcctcctgccacgg

SEQ ID NO: 151958 - DNA, 601 bp, Human
cttcacctctgcccctcgagtagctgggactacagtcacctgtcaccatgcctagctaatttttttttttttttaatatttgtagagacggtgttgccatgttgcccagggttgtctcaaactcctcgggtcaagccatcctcctgcctctgcctcccaaagtgctgggattatggacatgaaccactgtgcccagcctccaattgatgtctttttttgttgtttgtttgacatggagtcttactgtcatccgggctggagtgcagttttgtagtcttagctcactgcaacctccgcctcstaggttcaagtgatcctccagcctcagcctcccaagtagctgggactacaggcattctccaccacgcctggctaatttttgtgttttttggtagtgacaggattttgccatgttggccaggctggtcctgaactcttgacctcaggtgatccacccgccttggcctcccaaagtgctgggattataggtgtgagccacccctctcagcaattgatatctttcaatccatttcaattgttatcctttttggtgctcaaaatgttccatttttgccaatgggccaaactgtgtgtgtgtgtg

SEQ ID NO: 151959 - DNA, 601 bp, Human
tcccaagtagctgggactacaggcattctccaccacgcctggctaatttttgtgttttttggtagtgacaggattttgccatgttggccaggctggtcctgaactcttgacctcaggtgatccacccgccttggcctcccaaagtgctgggattataggtgtgagccacccctctcagcaattgatatctttcaatccatttcaattgttatcctttttggtgctcaaaatgttccatttttgccaatgggccaaactgtgtgtgtgtgtgtgtgtgtgtgtgtgtgtgtgtgtgtgtgttaacatccattcatttacacattgggtacaactggttttcagtttaactgtagagttaaatagttactagactggccagaaagcctaaagtatttaccaactggtcctttacagaaaaagtttgctaatcgcagctatatgagatccagcttactcaaattttttcctgacaaccagctctccgtttctgcccaatgttttcttcctgtgtgtgactctattaaagatacagacgtttcctcatgattacactcttataaaccctaaaggtgaatgtacctcctgataaaattagttctgc

SEQ ID NO: 151960 - DNA, 601 bp, Human
gttttgttaatacattataggagaagttgaattgacgaggtaatgggcttccagatggagagacagggtgtacaaagcctggaggcttccaagtgcttgttgtgctttggggcagtgaggtgcttgtgcaactggagcagagatgggtggggaagtgcagtaggaagcacctggggaaaagcgggcctggttagaaagggtctggcgtggggccccagccagtgtgtgcctgggcagcacatcacagtaacaaagtctgaagagatgacaaagcacagtctgagaggcagccagagtagcrgggagctgtttatggaggaaataggggaggggagggcagatgagagagatttgcggtcttttctataggcctccgtatttgattaggttcagggagttgtaggggaaaacctatgatggaagaaagcactggtgttctttgctcaagagggtgtttgattaattggggtattagcacagaaagttggaagcaagcagatcgggggtggacatttagggggcagttttcagccttcagtcgggaagatgagtctagaacgttggagggcagctggagtcagagtttccagtcccccgacag

SEQ ID NO: 151961 - DNA, 601 bp, Human
ttattaccacatctttttgaatagctgaattttatattacttcagccaaaatattggcagtctattgatttgatactgtttcttggagtcgaggagagtcgtagtagcgggggcttggcgattttgtgatgtgtttcctttgtgccagtcactgtgatgggcatttggcaaagtccctgatcttgggccactagtcactgggggaactagtaagtgcagtgtggtacgtgctttgggggagcacttgagagggtggatacctggcctctcctgggaggactgtcaggaagaggtgaacatstgagcagagttgaagataggacctggtttggcaggcaggaaggacaaggaaaaggtgctcccggcagggtgggtagcagggtcaaacacgtcaaatggcgagagcgtggtatagctgcaggaggctagagggtaagattttggagttggagttagggctatggtgatgcaggcagcatggagagggagggtcagtcttgagggcatttcatgctgtgtcagaagttggatcttgtctgagaaaaacagggaaccactgaagggttttaaaggtaaagcaacacggttacacttgtatttt

SEQ ID NO: 151962 - DNA, 601 bp, Human
attgatttgatactgtttcttggagtcgaggagagtcgtagtagcgggggcttggcgattttgtgatgtgtttcctttgtgccagtcactgtgatgggcatttggcaaagtccctgatcttgggccactagtcactgggggaactagtaagtgcagtgtggtacgtgctttgggggagcacttgagagggtggatacctggcctctcctgggaggactgtcaggaagaggtgaacatgtgagcagagttgaagataggacctggtttggcaggcaggaaggacaaggaaaaggtgctcccrgcagggtgggtagcagggtcaaacacgtcaaatggcgagagcgtggtatagctgcaggaggctagagggtaagattttggagttggagttagggctatggtgatgcaggcagcatggagagggagggtcagtcttgagggcatttcatgctgtgtcagaagttggatcttgtctgagaaaaacagggaaccactgaagggttttaaaggtaaagcaacacggttacacttgtattttgtgaagatcagtcttgaagcagtgtgcagaatggattgcatggctttagaccgcttaggagat

SEQ ID NO: 151963 - DNA, 601 bp, Human
gacctgttctaaaactctgtgtctgccaattctttcttagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatcctaagagggctcattcattggttcagcaaatastttctgggcaagtacttgcagtaaatacttccgtgtgccaggtgctctgcaaggcaccgcagacatgattgcatgaaggcaagtaaggtccgtgtcctcgtggagctcacatggacacagtcttctgcgagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtgga

SEQ ID NO: 151964 - DNA, 601 bp, Human
tctaagtggctttggccttcccttggcatcccaagaagcactcagtgcccttactgctcgtctcagcaaggaggagactgtgctggcgtgagttgtcatctcgagcatttctcaggcttcatttgtctcgggtcctatcctaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcragcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggt

SEQ ID NO: 151965 - DNA, 601 bp, Human
aatgttgtggtaacttgcagaagttatttagcctcctttagcctcagtttcattttttgggaaacattgataatagcaatcttttatagtttttgtcaaaatttgagttaatgcatgtaaagcacctatcatgatgcctggcatatatagacattaacaaataattactattatatatatttcataatatagtttcatatctcagtagttatctggaagtaccctgcatttgtgtagtaagcattattatgatttttttttcagacagagtctttctctgtcgcccaggttggagtgcagyggcgcgatcttggctcactgcaacctccacctcctgggttcaagcaattctcgtgcctcagcctcttgagtagatgggattacaggcgcatgccaccatgcctgactaatttttgtatttttagtagagttggggtttttctctatgttagtcaggctggtctcgaactcctgacctcaagggatctacctgccttggtctccaaaagtgctgggattacaggcgtgagccactgcacctggcctgtataataagcacttattaaataactgacaaatcatgaatttcagtttataaagg

SEQ ID NO: 151966 - DNA, 601 bp, Human
tcccagaactttgggaggctgaggtgggaggatcgcttgagcccaggagttagagacaagcttgggcaacacagggagatcccatctctaccaaaaatttaaaaataaattagccatgtatggtggcatgtacctgtcccagctacttaagaggctgaggcaagcggatcccttgagcccggggtttgaggctgcagtgaactatgatcacactactgcactctagcctgggcaacagagtgagaccttgtctcaaaaaaacaaaaagcctgggcgcagtggctcacacctataatcccarcactttgggaggccgaggtaggtggatcgcctgagatcaggagttcgagaccagcctggtcagcatggggaaaccccgtctctgctaaaaaaaaaaaacaaaaaaaacaaaactgtgcaatccagtgtttttagtattttcacagacttgtgcaacccttgccacaatgccattccagaatatatttatcaccctggagagcaatgctatatcttttagtgggcactcctcattctctcttcctactttctgctttctgtctctgtggttgcctatttgggacattttgtgtaaatgaaa

SEQ ID NO: 151967 - DNA, 601 bp, Human
tttttgcaagaaagcttgctctggttctgagccttgcgtgagttgtaacgctgttaactcagcagagagcccaaagagccaaagtgaggctcctagctcccttcttgggggtgtctattcaacctgatgggccatcgtccctcctcctccactgccataatttcacccagttgcctagactcaatgacaggcaatgatcctaaatatagttctgctatgaattcataggtggctgtgaattcaaaagtagatggtaatatccttacagcttctggtaataaacctttacagttttttttttaaagcaaaacaacacccctattcaacatgataattgaggctgttgtcataaaatagttattacagaggcaggaaagaaggccgttagaaggaattacttgataggtatctttatttttaatttttcttctttgcccttgatttgaggttgtcacacctcgatatggtatttcagaaaactgccaaagctatccttcaattatttgcccagcccgttatctctattccttgatcctgacttagactataaaccagtggatttggcaaggatttccttaagtgttacattcaaacctatcaa

SEQ ID NO: 151968 - DNA, 601 bp, Human
gacaggcaatgatcctaaatatagttctgctatgaattcataggtggctgtgaattcaaaagtagatggtaatatccttacagcttctggtaataaacctttacagttttttttttaaagcaaaacaacacccctattcaacatgataattgaggctgttgtcataaaatagttattacagaggcaggaaagaaggccgttagaaggaattacttgataggtatctttatttttaatttttcttctttgcccttgatttgaggttgtcacacctcgatatggtatttcagaaaactgccaragctatccttcaattatttgcccagcccgttatctctattccttgatcctgacttagactataaaccagtggatttggcaaggatttccttaagtgttacattcaaacctatcaaatatttggaaggcttacagatctgtttgcacataaaagcgccttgggtttgcataatttgcacattcaaacttgggttttaattcagaaatttaacatgttttctgtctcttttggatatttacattgattttaatctaattttaaaatttctcatttattggcattagcccctctttgtgaaga

SEQ ID NO: 151969 - DNA, 601 bp, Human
aggaagcaaggtattaatttacattctggtgcgatctccttatcatcacagtcctgaatttgcttttagtgacctaatggcaagtctctctggcctatgatgggtctgaaattagttggaagcctcacacgtgcttaaaattgagatggcagatacccagcactagggctgccatttccccctcccaagtccatggaggcagtactaagaagtcatagaacatttgctcccactgaactcagacacagcctcagaatctttttttgaaacataatcttctaagtagacactaacaattgawcagagttgggccagaatgctgtaagaagcctgctcatcagccctcccccagatccttattggctcagcggggatctagatttctggggtatagtccagaccccaactttactcaactagggtagctatagaggccagaagacagtagggtgaaccatcaaggctctttgaagatgggatgttagccagaggctggaagccaagcagctactccttttaaatcacatagagttggcctttgtgtctctgggttggctatttttgtagtgatattggagataagagcactgtttaagaatcc

SEQ ID NO: 151970 - DNA, 601 bp, Human
catggaggcagtactaagaagtcatagaacatttgctcccactgaactcagacacagcctcagaatctttttttgaaacataatcttctaagtagacactaacaattgatcagagttgggccagaatgctgtaagaagcctgctcatcagccctcccccagatccttattggctcagcggggatctagatttctggggtatagtccagaccccaactttactcaactagggtagctatagaggccagaagacagtagggtgaaccatcaaggctctttgaagatgggatgttagccagagkctggaagccaagcagctactccttttaaatcacatagagttggcctttgtgtctctgggttggctatttttgtagtgatattggagataagagcactgtttaagaatccactgaagaaatgtctgtgcgagcgctttgctgtttaattctctgcctagatgaagagttggtcttacttacgagtaaatgtaaaatgtgagtataaaataaagccaggtctgagctctgtaaccatttggctggtttatcccctggccatcttaccctaaaatcccaggagatagctgtgaaaagaagttt

SEQ ID NO: 151971 - DNA, 601 bp, Human
agacagttctcttaacctgaaatgtgaatggatactagagtttacaatgtggtctataacatggactagagagaattccacgttcctgctttcaggttttgaccgaaccctgacagtccatcaggttctcccacatgacactctcacccttctactggttgtagtcctttacctgggatacacccttctttctaaaaagttagctggtattgaggagaggtacttaaggcagatttgcacttaattaaggtcattccttcctccctccctccctcagatggactcttgctctgtcacccargatggagtgcagtggtgtgatctcagctcactgcaacctctgcctcctaggttcaagcgattctcctacctcagcctcccaagtagctgggatacaggcgtgcattaccatgcccagctaatttttgtatttttagcagagacagggtttcaccatgttggccaggctgttctcatctcctgacctcaggtgatccgcctgcctcagcctcccaaagtggtgggattataagcatggcactagactcgaggctttttctttctgatttaaaaaagggaatgtgctggccaggcatggtgg

SEQ ID NO: 151972 - DNA, 601 bp, Human
gcttcagggcagacctcagaggcaactggatttacttgagaaccttcttgctttctgtttcttgcagctgcagctgttggacttgtgccccaggagcacgttcctctatggccacagtcctgggagtcctctgctcctctctcctccctactcccaaactccagacagcttggttagggcccttagccaagcctaactgacctttgagtacttcagcctcttagcatttcccagcttcttcccagaatgacatttgccaaccaaatagcacaagggaaggaagagtacaaagagaagaaaktaaaagactaaactagtaggattaggattagagcaaggagagttagtgaggaagtgtaactttcactgaatacttgtctcatccagaattctgctgtagaatcatggcttagagaccttccaggtggaggtggcattttggtgatgaacttggcagctgcctgcacttgattgtgataggaaggagatctggcatccggtctccccattccattcctggccaagactaattgctgtagttgggatgcttcatatctctgggcctctttccctaaatgctttggtggtggttctttgttgt

SEQ ID NO: 151973 - DNA, 601 bp, Human
ggccacagtcctgggagtcctctgctcctctctcctccctactcccaaactccagacagcttggttagggcccttagccaagcctaactgacctttgagtacttcagcctcttagcatttcccagcttcttcccagaatgacatttgccaaccaaatagcacaagggaaggaagagtacaaagagaagaaattaaaagactaaactagtaggattaggattagagcaaggagagttagtgaggaagtgtaactttcactgaatacttgtctcatccagaattctgctgtagaatcatggcytagagaccttccaggtggaggtggcattttggtgatgaacttggcagctgcctgcacttgattgtgataggaaggagatctggcatccggtctccccattccattcctggccaagactaattgctgtagttgggatgcttcatatctctgggcctctttccctaaatgctttggtggtggttctttgttgttcaggtatagattaacacatgagatgtagattttctgtagatacagtgctggctctgtcaccctgccaactcatttaatgcttgtgccttgtgatctgtaaattggatc

SEQ ID NO: 151974 - DNA, 601 bp, Human
tgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttacyatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggca

SEQ ID NO: 151975 - DNA, 601 bp, Human
ctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgtttt

SEQ ID NO: 151976 - DNA, 601 bp, Human
gtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatyggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtg

SEQ ID NO: 151977 - DNA, 601 bp, Human
cccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacrtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggg

SEQ ID NO: 151978 - DNA, 601 bp, Human
agttgatacgttggaggaaaaatcttttttaaaaagttctatttgcataatgagttacagcttacaaagcataatcaaatgcactatttcatttggtctttagagtatctttacaagcctagcagggtggtcatggccctccccacccccaattttccagctggaaagtgaggtgaagagtgggaaagtgacttcccttctggtcacacagccatacgtttcagtttgggcctaaacggaggtctccagaatcccacaccattgctgcttctgctaggtcacactatctaggtgagcttcrtaaagagaattcatgtagaattgctcaggaaaaaacaaaaaacaaaaaaaaaaccaagaaatatcatcagaatgcttgtcgagccttctggtttaactctggaaatcaaagttgggccaggcatggtggctcacgcgaatcttgctttgcagggccaaggagggaggatcacttgaggtcaggagttggagatctagtgagactctgtctctacaaagaatttaaaaattaagctgggtgtggtggcgcgtacctgtagtcccaactactcaggaggctaaggcaggaggatcttttgag

SEQ ID NO: 151979 - DNA, 601 bp, Human
taggtgagcttcgtaaagagaattcatgtagaattgctcaggaaaaaacaaaaaacaaaaaaaaaaccaagaaatatcatcagaatgcttgtcgagccttctggtttaactctggaaatcaaagttgggccaggcatggtggctcacgcgaatcttgctttgcagggccaaggagggaggatcacttgaggtcaggagttggagatctagtgagactctgtctctacaaagaatttaaaaattaagctgggtgtggtggcgcgtacctgtagtcccaactactcaggaggctaaggcaggaggatcttttgagcccaggtgtatgaggttacagcaagctatgatggtgctactgcacttcaacctgggtgacacagtgaggtcctgtctctttaaaaaaaaaaaaaaagaaaaagaaatgagagcgggaagttcgtttagggcttccttagagccatggctcagggagagagggatgaattatggttggaaagatctgtagtgaggctctgttaccttttaaaaaggtatagtgttaccaccattagccaattaagtggggcagcagcatatgccagggccaccctaggaacccagaaac

SEQ ID NO: 151980 - DNA, 601 bp, Human
aattagcgtgggcagcatgcgtctggcgccagacccagcagatgcattccttccaaaggaggctgtgttgtctggcctcagtaaagctccagaggggtccagcagctgtgacctgaattgatgctcaagacattttagaatgaccaaaagttcccactgtggaggagtggccaaataaactgccgcattaacaagtgggcatgagaaagtacctaacagccactaagaatgacaaaagtggatggactgtgatgccgtaggagggttcagatgagatctagtgtgaacagagcgagatccratgctggtagctataaaaaacagcacaaaggctgtggatttcagcactgcttggggcagaaaaccagaaacaacctaaagttcataagatggaataatatgcagcttttcaaagaatggatagatttatatgctgataggacaagattgccaagatgtgttactgagtgaaaaaggcaaggggtagggtagtgtgtttagtatgatcctctgtaaagttttaaaaggtggctgggtgtggtggctcatgcctgtaatcccagcactttgggaggccgaggtgggaggattgcttgaagct

SEQ ID NO: 151981 - DNA, 601 bp, Human
agaaacaacctaaagttcataagatggaataatatgcagcttttcaaagaatggatagatttatatgctgataggacaagattgccaagatgtgttactgagtgaaaaaggcaaggggtagggtagtgtgtttagtatgatcctctgtaaagttttaaaaggtggctgggtgtggtggctcatgcctgtaatcccagcactttgggaggccgaggtgggaggattgcttgaagctcaggtgtttgagatcagcctgggcaacatagcaagaccccatctctactaaaatcagaaaattagraaaaaaaaaattaatggtgacgtatgcctgtagtcccggctacttgaggagctgaggtgggaagatcacatgagcccaggaagtcaagtctgcagtgagccatgcattctaacctgggtgacagagtgagaccctgtctaaaaaaaaaataaaaataagttttaaaaggcgatatgtgttagtgttggtcatctctgaggagaggacattctggagaatgtagaggaagtaacttttaccttttctccttttcagtaccatttgaatttttttttttagccaattgtgtttttctctttt

SEQ ID NO: 151982 - DNA, 601 bp, Human
tttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcagtcctcctgcctcagcctcccaaaatgttgggattacaggtgtgagccactgtgcctggccacacacttggccacagctgagaggygaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgcagctatgctgggactcatgtatgtctactggactcagctcaacatgttccagaccttgaagtacctggccatcttgggcagtgtgacgtttctggctggcaatcggatgctggcccagcaggcagtcaagaggt

SEQ ID NO: 151983 - DNA, 601 bp, Human
gtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacagaagccagaagcactttgaagtcagaaaagagccttagtggtcagctttgaatgtattacaaccattgtaattgatgccccaatacaatagaatgagagaggaaaattatagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtca

SEQ ID NO: 151984 - DNA, 601 bp, Human
ctttccatggatgtgtgagcataagctgggtcacctagtcctcaacacagaagggaactgcatttgtttgtttgtttgtttgtttgtttgtttccaggtttaatggagttgtaatttatctgcagaagaatgtaccctttttagtgtacaattctgtgaatcctgaaaaacctctgtagtcatgtagccaccacctcagtcaagatataggtattgccactctccagagagctccccggtgccccttttagagtccgacccttctcccacccccactccctggctatgcccgtttggtttyatcctacattatagtcactctgtctgagatttgctttcagcaactgtccttgctgctacatgttgagttctttaattctttaaataagtcgatttcttttcttgattaaaaagaactttttttatagagatggggtctcattatgttgcccaagctggtctcaagctcctgggctcaagcaatcctcctgctttggcccctaaaagtgctgggattatagacgtgagccaccttactcagtctcttgagttttaaagtccgttcccaccctgctatccccaaatcattgcttgaggaaga

SEQ ID NO: 151985 - DNA, 601 bp, Human
cattcattgtgcttccccatccctccttagagtctagggaaaggcagcggaggggaaacaaagagtacaggagataggttcttatcccctttaacactttctgtgagctgagtcccatttttgagaatctttctgtgttaggttagatgctgagtgtgacttggcaagaacacggccacacggcaggaatgtgcaggtttctgtaatgaatggtcaggatgtcatgttctaagctacagaagggccaagtgttggttggcagagctggagtctgggagattgatgatgagcattatttaarctttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtactttagtctctctgttgtcaccagt

SEQ ID NO: 151986 - DNA, 601 bp, Human
gattgatgatgagcattatttaagctttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtacyttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctct

SEQ ID NO: 151987 - DNA, 601 bp, Human
atcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggargggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcct

SEQ ID NO: 151988 - DNA, 601 bp, Human
cccaaacctaagtgttctgaggccaggccagcaccccctgcacagctccaggcacacatcagagagccagcccccactgactgactgaggacacgtgccagtggtccgccaggacagtactttacagtttacaacaccccgtcgcgttccattgcctcacctgatccagggaggcaagggttaatggttatgcagtgtggatggggaaactgaggctccaagcagcattgagacgcctcctcacccagcccggtctgcctgttgctctccaagtcaggacttagggattcagctcccaccrggtcctgacccccaatgccccggggcccctgagtggcggctgcggtgactctgatactcaccctcggccatggtcgggcgggggcggtggctccttccactggcggcgagaccctccaagtgcgaccactggcggctggcactgccgaggcggagagcggcgctaacttatagcccgctttggggcgggccgggggcggggccccgcgggaaggcggcgacctgggaggccacccattgcccagtcccgggcccacgccgccagcgctggggctcacccaggggaccggagcccgaggga

SEQ ID NO: 151989 - DNA, 601 bp, Human
accacctggtcctggctggcaagaaccacccaaacctaagtgttctgaggccaggccagcaccccctgcacagctccaggcacacatcagagagccagcccccactgactgactgaggacacgtgccagtggtccgccaggacagtactttacagtttacaacaccccgtcgcgttccattgcctcacctgatccagggaggcaagggttaatggttatgcagtgtggatggggaaactgaggctccaagcagcattgagacgcctcctcacccagcccggtctgcctgttgctctccaartcaggacttagggattcagctcccaccgggtcctgacccccaatgccccggggcccctgagtggcggctgcggtgactctgatactcaccctcggccatggtcgggcgggggcggtggctccttccactggcggcgagaccctccaagtgcgaccactggcggctggcactgccgaggcggagagcggcgctaacttatagcccgctttggggcgggccgggggcggggccccgcgggaaggcggcgacctgggaggccacccattgcccagtcccgggcccacgccgccagcgctgggg

SEQ ID NO: 151990 - DNA, 601 bp, Human
agggtgacagatgggtgggggtcttgggggaaaacaaatctcataaaccttgtcctataaaataaggacactgttgtccttattttataggtgagactcaacaattggccaaggtctagggttgcagaacgtgagggcgggaagaacaagcctgatttccgaaggctcctggataggatgccgaaagctcctctctggccgctggagccaaggactcagccaggcttggcttgcacaccaccggcgtggcatgcacaccacctggtcctggctggcaagaaccacccaaacctaagtgttytgaggccaggccagcaccccctgcacagctccaggcacacatcagagagccagcccccactgactgactgaggacacgtgccagtggtccgccaggacagtactttacagtttacaacaccccgtcgcgttccattgcctcacctgatccagggaggcaagggttaatggttatgcagtgtggatggggaaactgaggctccaagcagcattgagacgcctcctcacccagcccggtctgcctgttgctctccaagtcaggacttagggattcagctcccaccgggtcctgacccccaat

SEQ ID NO: 151991 - DNA, 601 bp, Human
ggcacggtcagggtgacagatgggtgggggtcttgggggaaaacaaatctcataaaccttgtcctataaaataaggacactgttgtccttattttataggtgagactcaacaattggccaaggtctagggttgcagaacgtgagggcgggaagaacaagcctgatttccgaaggctcctggataggatgccgaaagctcctctctggccgctggagccaaggactcagccaggcttggcttgcacaccaccggcgtggcatgcacaccacctggtcctggctggcaagaaccacccaaacytaagtgttctgaggccaggccagcaccccctgcacagctccaggcacacatcagagagccagcccccactgactgactgaggacacgtgccagtggtccgccaggacagtactttacagtttacaacaccccgtcgcgttccattgcctcacctgatccagggaggcaagggttaatggttatgcagtgtggatggggaaactgaggctccaagcagcattgagacgcctcctcacccagcccggtctgcctgttgctctccaagtcaggacttagggattcagctcccaccgggtcctg

SEQ ID NO: 151992 - DNA, 601 bp, Human
gaggacaagcggccaccgaggcgacacatcacagtgtgttgggagctgggcccgagggaggcaggtggctgagatcacacagcagggtcaggtgggtccacagttcctgccacccattcctgctccacctgccccatgtccctgtcccacaccccttcctgggggttgcaatgggtgcagaagccatccccagatgaacttgacccaagagccagctgggattctgggtccagcagtgacatcctccattgtagaaatccctccagctgggacctacgagagtgctgcttgtgtgtggggwgggagtcaggggcaccagtatgaaattagttaagcctctgttccactcctctcgttcctcacagatgcaccaaaggctggagcagaggaccagggcacggtcagggtgacagatgggtgggggtcttgggggaaaacaaatctcataaaccttgtcctataaaataaggacactgttgtccttattttataggtgagactcaacaattggccaaggtctagggttgcagaacgtgagggcgggaagaacaagcctgatttccgaaggctcctggataggatgccgaaagctcctctctgg

SEQ ID NO: 151993 - DNA, 601 bp, Human
agaggaccagggcatggtcagggtgacagatgggtgggggtcttgggggaaaacaaatctcataaaccttggcaagctcaaggtcaggattgggaagcccttaaggtgggaggagtgggcaagacagacttctgagtgtggagccactggacagcatgtggtccaagtgaggcccaggggcaggaatttgttcaaagtcacgccgcaagttggtccttgcagtgggagagcccaggtctcctgctcaccatcgactattccaaaaatgagatgcaaagtgccttgtatgtgaattatctcracttaaatcccaaaacaactccgcttacatagatgctatcatgattcccattttgtagacaaagacaccaggtggctccaggtcccagagcaagtggctgctttgggattggaatccagagctgtaggattctgtaggattctgccctgggaaccacctcactacagctcagttttttctccagcccctcttatgaccaccccttcgccaccatgtcctgtgttgttctcaaacctgggggcagatagttctgcgccactgaagtatcagggatgtcggtccccgtgtaatcacaacaga

SEQ ID NO: 151994 - DNA, 601 bp, Human
gtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgatatgtgaaagttccatttacagtttcagatggagcagaggaccagggcatggtcagggtgacagatgggtgggggtcttgggggaaaacaaatctcataaaccttggcaagctcaaggtcaggatkgggaagcccttaaggtgggaggagtgggcaagacagacttctgagtgtggagccactggacagcatgtggtccaagtgaggcccaggggcaggaatttgttcaaagtcacgccgcaagttggtccttgcagtgggagagcccaggtctcctgctcaccatcgactattccaaaaatgagatgcaaagtgccttgtatgtgaattatctcgacttaaatcccaaaacaactccgcttacatagatgctatcatgattcccattttgtagacaaagacaccaggtggctccaggtcccagag

SEQ ID NO: 151995 - DNA, 601 bp, Human
ggaatttattaaacaattctgtctatttttgtgtatgttcaatattctccaaaacaaaacatttttaacacaataggtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgatatgtgaaagttccatttacagtttcagatggagcagaggaccagggcayggtcagggtgacagatgggtgggggtcttgggggaaaacaaatctcataaaccttggcaagctcaaggtcaggattgggaagcccttaaggtgggaggagtgggcaagacagacttctgagtgtggagccactggacagcatgtggtccaagtgaggcccaggggcaggaatttgttcaaagtcacgccgcaagttggtccttgcagtgggagagcccaggtctcctgctcaccatcgactattccaaaaatgagatgcaaagtgccttgtatgtgaattatctcgacttaaatcccaaa

SEQ ID NO: 151996 - DNA, 601 bp, Human
aggggcagtagacaccacggtggtcagtgctgggtgatgaggacataggaatttattaaacaattctgtctatttttgtgtatgttcaatattctccaaaacaaaacatttttaacacaataggtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgataygtgaaagttccatttacagtttcagatggagcagaggaccagggcatggtcagggtgacagatgggtgggggtcttgggggaaaacaaatctcataaaccttggcaagctcaaggtcaggattgggaagcccttaaggtgggaggagtgggcaagacagacttctgagtgtggagccactggacagcatgtggtccaagtgaggcccaggggcaggaatttgttcaaagtcacgccgcaagttggtccttgcagtgggagagcccaggtctcctgctcaccatcgactattccaaaaatg

SEQ ID NO: 151997 - DNA, 601 bp, Human
attttaaaacatttattacatgtatgagacaactggaaatttaaatactgatggcataatggtgatatcaaagaatttttgttaatttgtttgtgttaaaaaaaagagagtccttatcctttaaaggcatatactgaaacattgacagatgacatgatgtgatgtctgagatgaaggtgcgcaggggcagtagacaccacggtggtcagtgctgggtgatgaggacataggaatttattaaacaattctgtctatttttgtgtatgttcaatattctccaaaacaaaacatttttaacacrataggtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgatatgtgaaagttccatttacagtttcagatggagcagaggaccagggcatggtcagggtgacagatgggtgggggtcttgggggaaaacaaatctcataaaccttggcaagctcaaggtca

SEQ ID NO: 151998 - DNA, 601 bp, Human
tattttaaaacatttattacatgtatgagacaactggaaatttaaatactgatggcataatggtgatatcaaagaatttttgttaatttgtttgtgttaaaaaaaagagagtccttatcctttaaaggcatatactgaaacattgacagatgacatgatgtgatgtctgagatgaaggtgcgcaggggcagtagacaccacggtggtcagtgctgggtgatgaggacataggaatttattaaacaattctgtctatttttgtgtatgttcaatattctccaaaacaaaacatttttaacayaataggtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgatatgtgaaagttccatttacagtttcagatggagcagaggaccagggcatggtcagggtgacagatgggtgggggtcttgggggaaaacaaatctcataaaccttggcaagctcaaggtc

SEQ ID NO: 151999 - DNA, 601 bp, Human
aatagattgcaagaaagaaaatgaaaaaaacattgaagagagaacctataaagagaaacttaaacccgttgtgatgtattgatctatttggatcttgatttcaaaaaagtattttaaaacatttattacatgtatgagacaactggaaatttaaatactgatggcataatggtgatatcaaagaatttttgttaatttgtttgtgttaaaaaaaagagagtccttatcctttaaaggcatatactgaaacattgacagatgacatgatgtgatgtctgagatgaaggtgcgcaggggcagkagacaccacggtggtcagtgctgggtgatgaggacataggaatttattaaacaattctgtctatttttgtgtatgttcaatattctccaaaacaaaacatttttaacacaataggtgctttggagacttccagaggtaggttttagttctgctgtgttgctgtgtgagcctggataagtgtctctccctctctgtgactcctcctctgaagtctcaaggggctgctgtgagtctagaagatgtgttgggaacccccttccccacggcccagcccaggacagaagcttgatatgtgaaagt

SEQ ID NO: 152000 - DNA, 601 bp, Human
ttgcggccctcaaagtgcagggtcagccagaagggctggccccgtcgcaccaccagcttctcccggcacaggtcggccgtgtggtggtctcggccattggtctccagctccagatcacacctctctaagaccagctctatggaaacagaaggagacgcatgagcctcgggggcatccttcagacctccagtgatgcacctgccctccctagacatgggggccttgtgccctcttactccccacaaagcacagccattgtttcgactgacctgtctccccagccctggtcacacgggggctrggtggggcccaatctccctaactcttttttttctttttaatttaattgagaaaaggtcttgctttgttgcccaggctggagtgcagtggtgtgatcatagctcactgtagccttgaattcctgggctcaagggatcgtcccaccccagcctcctgagtagctgagaggacaggcgtgcaccactaattttttcatttatcagtgagctgggactataggtatgtgcccagctaatttcttcatttttggttttgccatgttgcccaggctgctctcgaactcctgggccaagtgatggct

SEQ ID NO: 152001 - DNA, 601 bp, Human
tgaggtgggaaggtcagcagcagcccttcacccaaccccaaactcagggccctaattacctaacactacgctgcccagacaattggagaaggagaaataagaaaggggacatctggagtgaaagaagaggaaagaaggcagccttatcctcagcgaacgaacgcaggagcagaaaagcaaatcccccatgttctcacttataagtgggagagaaatgacgagaacatatggacgcatagagggaaacaacacacactggggcctccttgagggtggagggtgagaggagggagaggagcaraaaaaataacgcttgggtactagacttagcacctgggtgacaaaataatcggtaccacaaacccccgtgacacgagtttacctatataacaaacctgcacgtgtacccatgaacctaaaataaaagttttaaaaaagaaagaaagaaagaaagaaaaataaataaaaaagaaagtagaaatcacaggctgcccaagccagcagctcatctaccattccatttcacagaggaacacactgagccctggcaggcacttgtgataaatgcgcctgctgcagggacatagggatgaaaagcctc

SEQ ID NO: 152002 - DNA, 601 bp, Human
ggccacatgctccattcgctgagtgaccttagccagctctcctgcttctctgggcctcagtttcccatcacaagctacaatgttcccacacaggagcagagtcagctggccaggccttgagccgggcgctgacccaggccaggcctggagttgggggagggcctggtttcctggtattgtccctcaggcttctccgggccccgggaatttcttggttgcttggacagggaagctgtgtgcactctgtactcagagatctgggctcttccgtggctgcctacaggggctgcggaagtgaccrgggcaggttggttatggtttgagataagttggtggagactggaggacagagattagcttgctgaggtgggaaggtcagcagcagcccttcacccaaccccaaactcagggccctaattacctaacactacgctgcccagacaattggagaaggagaaataagaaaggggacatctggagtgaaagaagaggaaagaaggcagccttatcctcagcgaacgaacgcaggagcagaaaagcaaatcccccatgttctcacttataagtgggagagaaatgacgagaacatatggacgcatag

SEQ ID NO: 152003 - DNA, 601 bp, Human
gccgactggaagcctttgaatgctccctgacttccagagctggcatttggggaggagccatgcaggcctggggtcccagacccaccctacgtctggctccctgactctgcccctgagcactgtgtgacctgggccacatcaccaggcctctctgatctgctttcttatccaagaagaaaacaggcttaggccacatgcctgggagagtccaatctcaggttcgaaactggctctctgaacttcgacaagttacttagcttctctatgccacagttttctcatctgtaaaatgaggccagtrgcagtacctccctataaggttgttgtgaagcttaaagaggacaggcatacaaagcatcccacaaggcacctggtgtatagtaagtgctcaggaaacaatagttagtcttgttcagttttcatgaacgcctcctggctctgtttagagggttccgtgagagagttcatagaaagcattttgaacagtgaccagctcacagtaatcatgcaggaaatgtgagctatcgtcagtgttattaaaaggggccattaaaagtctgaattctcaggccaaatagcagatcgtgaggactggagtgga

SEQ ID NO: 152004 - DNA, 601 bp, Human
ccatccctctctctgggatcacctggccccatttgtgtagcatagacaaggattaggcaacatgccctagggccctcctttcctgcctacatcctctacctgctagcgtcccgctttttctctcagagaaggaagcccagacgctgagcaggaagggacctcggtcctctgagagccccttgctgtaggccagcggaggatgctggctggcccacacagcctcaaggtgtctgtctccccaggccccccatctgctgtcccccacatctccataggcagttccgagatgctggtcataacracccctcaccttcctacagccttttacacttcatgaagcacctgcttcctttgagaccccttgcccaggtgagaaaactgaggctcagagcaaagcggtctcccaaggatatcctaggagtttgtggcaaaggtcgcatctgaagtgggtctttagctctcagttgtcttctacggtgcctcttcttcccaaagaggacactccccagccgggttctcaaaggcacagtgatgggcacactctcaaagcagctgcttttccaggtggaggggagggcccgcccccacaggcaggtctgag

SEQ ID NO: 152005 - DNA, 601 bp, Human
gcctcctggctaggggctgggcctgtggagggagaagcagtagccgtgagctaggggtagcagggctggcagggcagggcacctacgtggggtcccccagcttgggctccaggcctagttctgccactaaccactgaaataagtttggcaagaagtttgtctccctgagcctcagtttcctcatctgtaaaggggggctcagaaccccagccttttagggtggttttgtgggaatgcataaaaagccacaggcatacagcatgtcctcaactaaagagtcctcctgagagaggggccatgyggcccagagccaaggctcagttccactgctctgcaatgatgtgactcgggacaagcccatccctctctctgggatcacctggccccatttgtgtagcatagacaaggattaggcaacatgccctagggccctcctttcctgcctacatcctctacctgctagcgtcccgctttttctctcagagaaggaagcccagacgctgagcaggaagggacctcggtcctctgagagccccttgctgtaggccagcggaggatgctggctggcccacacagcctcaaggtgtctgtctccccaggc

SEQ ID NO: 152006 - DNA, 601 bp, Human
cacccgattcccaggaggggcctggcccatgatgcttctttccctgctttgtttcattagaataggaaggaaacagatcattagatctgactgccttgctagttagatgggaaaatcgaggcctggggaggtgactggcaacccctgcctcctcccccttgctcaagtcagtttcctttgttccaagctctcccctctgactttctagttttgtccaaggttgtccacttatttattcaaagagattccaaaggccacttcaccactctgagcctcagtttcctgtgtgtgaagtggggamgtgtcatctcccccttgggattgttgagaggcccgactgagatagtgtataaggaggcagctggacggtctaactgctcctactcacccccctcccccagccctccccccaacctcacctccgggtttcccttccccaaaccagtctgggtgagatttaaaacagggcctcccacctcagccgggcacggtggctcacgcctgtaatcccagcactttggcaggccgaggcgggtggatcacctgaggacggtagctcgggaccagcctggccaatgtggtgaaactccgtttctactaa

SEQ ID NO: 152007 - DNA, 601 bp, Human
tgagcagatgtggccgggcgtggtggctcacgcctgtaatcctagcactttgggaggccgaggtgggcggatcacctgagatcaggagtttgagaccagcctggccaacatggtgaaactctgtctctactaaaaatacaaaaattagcccggcgtggtggtgcatgcctgtaatcccaggtactcgggaggctgaggcatgagaatcatttcaacccgggaggcagaggttggagtgaggcgagattgcaccactgcactccagcctgggtgacagagagagccttggtctcaaaaaaaaaaaaagaaaaaaaaaaaaagaatgaatgagcagatgtatgcagaccaatgtggacagagcctcacggtgtattgtgaggggaaaaaaccaagttgtaggttaatgtatacagtgggatccttttatgtttgtgatagagagacagagacctataaaatacagcaatttctccaggcacatacagactgacctaaggaggtgagcccccgcaaaatatctaacaatggtgtcccccaaggaggaggggtcaaagggggaggccatttctctgtagtcttgaagccctccccttctctcccc

SEQ ID NO: 152008 - DNA, 601 bp, Human
agcccaacttcctgcctctgcatcaccagctccacagttcccgccccgggatgtgggtcactttagtcactgtgccgcttggctgaccgccactccaacccgccgccgggtgaggccaagcaggaggaagggggccatcccccagaaccacgcttcccattccctgaactctgaaaccttgtggtgtggacgagggtggggacaccggcgtgttcctgtcctgttggcagagctgccaactagttgctaccctctgcagattgactaaaattcaaaacaaacctatggggcggggggggggatccagtaaggccacttctgtcccgagaaatcattccattggccacagggtatgaagcaagggtgctcgttgacgcatggtccctgcgtgccatgagcctccaggcacaacctcatgtccatcagtgggggctggaccatccacatgggcaagaaacaggacactcaacgcccttagaaagaatgagcagatgtggccgggcgtggtggctcacgcctgtaatcctagcactttgggaggccgaggtgggcggatcacctgagatcaggagtttgagaccagcctggccaacatggtgaa

SEQ ID NO: 152009 - DNA, 601 bp, Human
cctgattttaaattacattaaaacatgttcacgggcccctaagagtttctcaggccccaggcacagtgcctgccgggtctaatggagaagctggcctgggaaggaagcagctgccggcccctcagacccctgggctttgtcatgcccgtctgcagcaaccagcagccctgactttcatcgtagtgaggaaaaatgggaaagaggccaagtctcttgtgtattctgatctttggctctggaaacttctataaaaattaaccttgaagtcaatgaactataatggctctgcagcagccggggkgtgtgggataagaatgaaagagaaagaagaacccacagtgtttcaacattagaatgagtgtcagcacttgttgaattgtccccaccccagctcaggatgccaagactgtgacatccccagctcaggtccccatctggtaaaggtgggggcactggggacgtgaagccttgcatataactggcactcgatcatattggtcttggaactgacatacaggagggtcccattttccaggcagacccggccctttcccacccatcagactgatttcctcccgcagcgcccctgcgctcaccccag

SEQ ID NO: 152010 - DNA, 601 bp, Human
gctaggaaaactgagactaaggacacaggagcactggaccgggagtcaggaaactcctgattctcacttgctgtgtgaccctgggtaggctactttgccttctctgcccaccttaacacctcactgtgtcagcccaaaatgcagatctgaaaggtgctttggaaacgaaagccctgaggtagcgtgagggaggcgcatgattcaaggcagagagaactcagtagcagaggggaaggccaagaaagggttcctgcagctcaggagaggtggggtcctgtccagcttgagagagttacagagrgctccctggaggaggtggcatctgaatgttgtcttaaaaaatgattaagttttagagagttggaacctggagggtagcattctaagcagaggaccagaaagcacaaagctttggctgctggaaaatgcagggcatttagttgtctgtggccagtgaggggagaagaaggagctgaggaagttggggcaagatggtaggagcccaaaggtcaggctggctttactgactccacttaaccggtgaagaaactgaggccaagaaggggcaatctggagccccattatgactttggtgagcccc

SEQ ID NO: 152011 - DNA, 601 bp, Human
ttaacacggtgaaaccccgtctctactaaaaaaatacaaaaaattagccgggtgtggtggtgggcgtctgtagtcccagctactcgggaggctgaagcaggagaatggcgtgaacccaggaggcagatcttgtagtgagccgagattgcaccactgcactccagcctgggcaacagagcgagactccgcctcaaaaaaaaaaaaaaaaaaaaaaacaggaccctgggaaataaaggaagaacttgactttgttctccttctcaggagagaataaaaagccatgaaaaatcagagccaattmattttctgatgtattttatgcatcacggtcataccaccatttcatttatatcccacagcaggctacggggttgctgagcagttagttttgcaattatcatcatgatattcagatgagaaaactttggtcaaagcctgagatcatacagggaagatttccctatggtttcagggtaggaccctccctagagggtcattgaacattgaaacctgacccagaggctgctgggggaagcctcagggtgaaccccaccccaggaggccaatacctcctaacacaccaggaggttgaggggccagg

SEQ ID NO: 152012 - DNA, 601 bp, Human
ccagcccacacacgctgctctgatgggaactgagacagattctaaatacagaaatccagtcccatcactcttctgtttcaaccgtatccacagtaaaacctagacttcaccgtgcaaacttcaaggcccttcatgatctgctcccatcccctttttgacctcatctctcaccactcacacccacactcactctgcccaggctcactgccccagggcccttgcatgtgctatttctctgctcagaatgctcttcccgctgctctctgcagggctcacacctcctcatccttgccattcaaaygtcatctttctcaaaagcaggaccccttcttgccaccttccactggaccacccacctccaggggcccttctgtctgctcttttccccccacttctgtggtcctttcctgggccagatctccctccaagctgcacaacagccttccacggtgtgaaccctctgtggctccctattgccatcggcctaatgttcagggctgttccacaaactggacactgctggcttctcccacctcatctcttggggctccttcacacacaaggtatgccccaagctacaatatacctctcaggcacgaca

SEQ ID NO: 152013 - DNA, 601 bp, Human
tcctcagacttgtccggagggagggccctgcatacctgccaacgccctgtttgctgggaaaggggctgatgttgcaatgacaggttaaacagcaacaggacattgactggcatctgcaagctgagctcagctcagagaggcgaggagcacaggggagggaggaaaatcccggtgtggatctcacccacacggcccactgggtgctcctggcagacggaattatgggtgcttttactctctcattttaaaaatgtgctttttatgtgtattgtaaaagtaacagattcccagaaaaaaatayctaaaaaatgaagagaaacaagattaggcgtaataaggtaatctgtgggacttttgttttacttttagttttgattgaagttgagtttgggagtgggggagaagggatgcgacctttgccctggggccaccatcgataggccagggtaagagcttactggttggccctggattcctgccaggagatttgtaggagcttcgaggaaggaggaaggaacagctatgacctccccctcttgcctggtttctgtccccctgaggcctgggcagggctcagccctaaggctgccctcagtgaagg

SEQ ID NO: 152014 - DNA, 601 bp, Human
tgtaagtgaggtcccccacccttctgtggacccatcagtggtctccgggtgagctcctagttctgccgccctccagctgagtcactttaactctccaagcctcgtcttccccatctgtttgacgcgacagtgcccgcccacgcaccttcgctcttctcctggggcgttgggtccagggcctgccagccctcgtaccccggctgcaggtccggcctggtcatccacgactccacccagcagtggaagttcctgagggggataggggggcgggaatgaagcagaacatgagcaacattcatcrccacctcccacgggcagaccatgcattcatgtccccagatgcaagctcgcctcgtcccaaactgagcccagggtgtctccccactgccttgttcttccccccacgggggcccatctcacagcaccctctctagccaaggcgcccactcctacacctcagagcccttctcaactcctctcccctccttgcccctctcagtggcccctttgacctcctaatttcttggctccatcccttcttttctgtccgttcagggcttatcactccccacctggaccacgccccagccccccgcccatc

SEQ ID NO: 152015 - DNA, 601 bp, Human
tgcacgtgaattatttttgagatttatcaagaagtgtgttattaagatgtaagtgaggtcccccacccttctgtggacccatcagtggtctccgggtgagctcctagttctgccgccctccagctgagtcactttaactctccaagcctcgtcttccccatctgtttgacgcgacagtgcccgcccacgcaccttcgctcttctcctggggcgttgggtccagggcctgccagccctcgtaccccggctgcaggtccggcctggtcatccacgactccacccagcagtggaagttcctgarggggataggggggcgggaatgaagcagaacatgagcaacattcatcgccacctcccacgggcagaccatgcattcatgtccccagatgcaagctcgcctcgtcccaaactgagcccagggtgtctccccactgccttgttcttccccccacgggggcccatctcacagcaccctctctagccaaggcgcccactcctacacctcagagcccttctcaactcctctcccctccttgcccctctcagtggcccctttgacctcctaatttcttggctccatcccttcttttctgtccgttca

SEQ ID NO: 152016 - DNA, 601 bp, Human
ccagacagtggaagggacccagaggacaaccactgtgcaggaagcctggtgacaaagtcttggctcggggctgggttgggtggtctaatgacaccatgtcactgcgaaggggatctgcctaaaaaggcaactaggctggtgctggggacactggagagggacaatcaagtccaggaagaaagcacttctccctgcagaggcctggacgctcccacctttggctcgccgatctgctctgcccaacatagcagcttctggccacatgtggctgtctaactttcaacacaattaaaactttagytttggccaggtgcggtggctcacacctataatcccagcactttgggaggccgaggcaggtagatcacttgaggccaggagtccgagaccagcctggccaacatggtgaaatcccatctctactaaaaacacaaaaattagctgggcatggtggtgcacgcctgtaatcccagctacttgggaggctgagattgcagtgagctgagatcgtgccactgcactgcagactgggcaacagagtaagactccatctcaaaaaaaataaaaaaacaagcaaacaaacaaacaaactttagttcta

SEQ ID NO: 152017 - DNA, 601 bp, Human
cttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagaraaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacagaggacctgataaccccctacccaggggtgagcaggtgggtcagccagaggtgtacaaattcagtgatctcatcagtt

SEQ ID NO: 152018 - DNA, 601 bp, Human
cttttgtatcccaagacagcctcagcctctctaggctctggctccacactttttcttctggtgttttctgagttgagatggttcagactcgtgtttaatgaggttgtccatttgagggtctttgtgggcccagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaaygaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccaga

SEQ ID NO: 152019 - DNA, 601 bp, Human
gtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgcccccgccttccccaccaacccatggccctacttgagctgccygctgagcctactctgttgtggccacagtatcctcctgctgcccagagtttgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttgg

SEQ ID NO: 152020 - DNA, 601 bp, Human
gaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacacyggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaacca

SEQ ID NO: 152021 - DNA, 601 bp, Human
ccccacagggagttgtataggaacctggggatggggtgactgaggtagggggccagaagtggcccagatgatactcacttctgctggaacttttctttgtccatctttcagcatcctctggtggagaaggcttagctccattaatgctctcctaggtcctggctgtgtattttctttggtatgggagtggggaactgggagggactcatctgtttgccacagactacatgtggagagggtgattggtgagaggtcattttggagatctacacacctcttctgacccctgggaccactctcytgaatctcctcatggtcttggcttcgggcccagcagggcgtgggtgctcggcatcctgctgcttttactgtttttcccaaagctctgttagcttcccgtggttcccactggctataggaatctttatgtaaggacttcccagtgtttccagactgtatttgcccccaggggtcacattccccccaactatgcctgctgctgctttttctgttcccgttgttacctcactgaccactgcattttcagtatttgttgtagcccctcagcctctgtggcccactgtgccacctcttccaggaa

SEQ ID NO: 152022 - DNA, 601 bp, Human
gttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctrtttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatccc

SEQ ID NO: 152023 - DNA, 601 bp, Human
gtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgcccmctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcc

SEQ ID NO: 152024 - DNA, 601 bp, Human
ggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccrggcctctaagtagctgcccggagagccagaggacccaggggaccttaagtggggccaggagggtgggcagaaggttctgccacgtgtagctttctgcacaaagtcctctggtggccttggtgtgagctggtgagaggagccagccacatgctgtgtgccctgccactatgggcagagactggatgtgtagaactggctttgggtgtcctggaggtgagggtggccagtagcgtgtgaagggtgccctgaaactctggctctgagacctggtatggcagccagaggggccaaggagagaag

SEQ ID NO: 152025 - DNA, 601 bp, Human
gaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcrtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggcc

SEQ ID NO: 152026 - DNA, 601 bp, Human
ggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctca

SEQ ID NO: 152027 - DNA, 601 bp, Human
cacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccackggcacctgggactcaagtgatggagaggagcggcaggaggaatgtggggagtgggaaggcttttcctgactttgggctcagcagtgaaccaacgagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaagg

SEQ ID NO: 152028 - DNA, 601 bp, Human
tacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacayggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctt

SEQ ID NO: 152029 - DNA, 601 bp, Human
ctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctsctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtcatctgtcaaatgggccagcagagtagtccttcccctcatggggtgtgggaaggaggaaatgggatgagatagaactcatttgagccagtgcctgcggtgtggagtggggtggagggggtgagatgtct

SEQ ID NO: 152030 - DNA, 601 bp, Human
actgaaaacaatgccctggctctggacatgggcacgcggaacactgcagcctctaagaaacccaaacggataggtaggtcaacttctatccactctgcccattaaattataccttcatatcacgctaataaattatgcagacggtttactgggacacgctgtgggtctggcactctgataagcgctttacacgccccatttcactgaaccttaagaggcagggacggtattagcagccccttttccaaccaagacacaaagactttttaagtgtcttgcctaacggggcagagccgggttyggcacccgttttggacacctgggccgtgctcttaaccactaagctacagacctgggccggcgacactgagaggctccagccctcggggacctgaagcagggacccccccctcccccccgcctgcgccccagccccgggaataacttcggcatccccgcgcgcgccatgcgggacgaggaaaggcggccgcagcacctgtttgtggcaccggtgagggctggaggggatgggggcgcccggggccaggcctcagggcgccccgaggcgagggaacgcaagaggacccgcctcctccgggaa

SEQ ID NO: 152031 - DNA, 601 bp, Human
cgcggaacagaagaaaacttccacacaagcaatactgcaacacggaggcggggcaagggcttaaaaggaaagtcagccaacagggaggggtgaatataagcaaagcttccgtgaaaaaaaacttatcgaggtgtagagcaagacaagacagacaaatttttccatctccgtacaccccccttcagagcccaacacacagcaagtgctctagataggtttgctcaactcaagggaagcttctgccagcaactttcccagaaatggaatgacaagaagaagctggatgatggcggggcggggrgaaatggacaggttgctcatcctgcgggagatggtgaatatcctgcagttgcctaagcggagatggaaagaaacagcatccatcgtttacagactgtcaactacagtgtcccaattaagcgtacgcccctttcagatgttaacaactgaaaacaatgccctggctctggacatgggcacgcggaacactgcagcctctaagaaacccaaacggataggtaggtcaacttctatccactctgcccattaaattataccttcatatcacgctaataaattatgcagacggtttactgggaca

SEQ ID NO: 152032 - DNA, 601 bp, Human
ggtataaatcaaaatagtttcagttcactaaggaaatttaatgcctaaaacaatcctaagatacaggaggatcactcaggtaaacacacactccttactcatataaaattgaacacccataagttgcatttccttagagtacacctataaaactaagtacagaatttttaaaaacccagtatgttttagtaaagttgctgttctaaaaatcccacctgtcaccaggataaccgaaactgctccctctacactccaactgtatttttagtttttacctcaacaagtagcaatgtaatttacmcttggtaagcacggattcctgaaacgccaaaatcaaccgggaacctgatttaactccaccacgctcttaacaatgaaagctacaagcagaagagaagtgtgaccttaaaaacttccacacagccgaagaacagtggcagaacagactgaagcacgtatcttcgcggaacagaagaaaacttccacacaagcaatactgcaacacggaggcggggcaagggcttaaaaggaaagtcagccaacagggaggggtgaatataagcaaagcttccgtgaaaaaaaacttatcgaggtgtagagc

SEQ ID NO: 152033 - DNA, 601 bp, Human
agggttggggtggctggagcctatctcagcagcttagggtgcaaggccggaaccagtcctggacaggacatccactgcagaaagcactcacacttacacacacagctccacacaccagtgaacctcacgtgcacagctttgggatgtgggaggaaatcaagagtacccagagaaaacccatgcagggatagggagaacgtgtaaactccacagacagttttttttctcaacattatcttgaaacaacattattcaaggacctgctgtaatctgtatatacatggactttctggctgaaacmtaaaagagagcaacttattctcaagaaactatatttatggtaacaattctcaatgcttaaaagttttacgttaagcttaatgggaagcactacacatttttaaaaatgtgttgtgtcctttcccagatactaaattggcgtttctttcctaaatcaattttaagaggtgtatctttccccatcttccaggtagtcataactaaaacataacatgtaacatttccactgtacctgatcaagctcaaagtacacctacaaaactcaaataacagacctaaaagctgaaaactattcacgacc

SEQ ID NO: 152034 - DNA, 601 bp, Human
cgataaccgctcactgcaacctctgcttcccaggttcaagcaactctcctgcctcagcctcctgagtagctgggattacaggtgcccgccacccagcccggctaattttttttatttttagtagagacggggtttcgccatgctggccaggctggtctccaactcctgacctcaggtgatctgcccacctcagcctccaaaagtgctgggattacaggcatggggttgcagtaagccgagactgcaccattgcactgcagcctgggtgacaagagctaaactccatctcaaaaaaaaaaawttttttttttaccacttattccagttcagggttggggtggctggagcctatctcagcagcttagggtgcaaggccggaaccagtcctggacaggacatccactgcagaaagcactcacacttacacacacagctccacacaccagtgaacctcacgtgcacagctttgggatgtgggaggaaatcaagagtacccagagaaaacccatgcagggatagggagaacgtgtaaactccacagacagttttttttctcaacattatcttgaaacaacattattcaaggacctgctgtaatctg

SEQ ID NO: 152035 - DNA, 601 bp, Human
caagagttaggttctagggcatatttctcatcagaaaaatatcaccaaacttttaaataaagaccaaacacttcgaatattaaacactgaaataaatgtgaagtatacatgccttttttttttttttgagaagtacttttgctcttgttgccccggctggagtgcaatggcacgataaccgctcactgcaacctctgcttcccaggttcaagcaactctcctgcctcagcctcctgagtagctgggattacaggtgcccgccacccagcccggctaattttttttatttttagtagagacrgggtttcgccatgctggccaggctggtctccaactcctgacctcaggtgatctgcccacctcagcctccaaaagtgctgggattacaggcatggggttgcagtaagccgagactgcaccattgcactgcagcctgggtgacaagagctaaactccatctcaaaaaaaaaaatttttttttttaccacttattccagttcagggttggggtggctggagcctatctcagcagcttagggtgcaaggccggaaccagtcctggacaggacatccactgcagaaagcactcacacttacacac

SEQ ID NO: 152036 - DNA, 601 bp, Human
ggaaactgagacttccgactaacacacgcttattgatacaaacaagagttaggttctagggcatatttctcatcagaaaaatatcaccaaacttttaaataaagaccaaacacttcgaatattaaacactgaaataaatgtgaagtatacatgccttttttttttttttgagaagtacttttgctcttgttgccccggctggagtgcaatggcacgataaccgctcactgcaacctctgcttcccaggttcaagcaactctcctgcctcagcctcctgagtagctgggattacaggtgccygccacccagcccggctaattttttttatttttagtagagacggggtttcgccatgctggccaggctggtctccaactcctgacctcaggtgatctgcccacctcagcctccaaaagtgctgggattacaggcatggggttgcagtaagccgagactgcaccattgcactgcagcctgggtgacaagagctaaactccatctcaaaaaaaaaaatttttttttttaccacttattccagttcagggttggggtggctggagcctatctcagcagcttagggtgcaaggccggaaccagtcc

SEQ ID NO: 152037 - DNA, 601 bp, Human
accagactttctttcaaattgatctagggttctaatgagcaaaattcatcctagctgctgcggtggggagagtcaggggagggccaccagtgacaagcagaatcaattatcctaaacaaaaagcacctaagcataatttagagacaaagcatggttcagtggaaagaacactgactttggagccagaccagcctgtgctctagaactaatacttggtgcctcaggactctgagccagttatctggcccctcggaagcgcatcagcatcctcagcaattattatgagctttacgctgcaaaratgtttatgagtattagaaatacaacataaagggtctaagaaacccttttctttggttcaaggaaagagctaaatgaactgcaacttttatattattaggtaaattcaacctgaccttttaattccttttctgcataaaataactttcaccctgtaattctaacctggcacatggtaagagctcaatagcagtaaatattattatccagcaaattcactaaacctgtccttacacataaacatctataaaacttacagcaacactccacttgtaaaaaattttaaataggatcagagaat

SEQ ID NO: 152038 - DNA, 601 bp, Human
taagagaagactgcccaggtggaataccaaagaagcttctgattcagatcaccgtttcaaacaaaagtaaaacaaaattgttcaggaagcagttcaattccaaacaggaagctgtactaaatactcccaacagtattagccacaagagggatgttagaaagggctaggaagcaaagaggacaaccagcacctatcctataaagttaattggaagcttagttaactcatttccactaaagcagaatgttagaattcagaagaaatgaatttttttttttagcaacaacctggactacagttttttttttttttttcccccccctggatacagagtcttgctctgttgcccaggctgaagtgcagcggcacgatgtcaggtcactgcaaactccacctcccgggttcaagccattctcctgcctcagcccccggggtagctgggattacaggcacgtaccaccacacccagctaatttttgtatttttagtagagatggggtttcaccatgttggccaggctggtctcgaactcctgacctcaggtgatgcgcctgccttggcctcccaaagtgacggaattacaggcgtgggccaccatgcc

SEQ ID NO: 152039 - DNA, 601 bp, Human
tactaaaaataaaaaaaaattagtctggcatggtggcacatgcctgtaatcccagctacttgggaggctgaggctgaacaatcacttgaacccgggaggcagaggttgcagtgaactgagattgggtcactgcactccagcctgagtaacagagcgagactctgcttcaaaaataaaataaaataaaaatataaaaattagccaggcatggccgggcgcggtggctcacgcctgtaatcccagcactttgggaggccaaggcgagtggatcacaaggtcaggagatcaaaatcatcctggytaacacggtgaaacaccgtctccactaaaaaaaaaaaaaaaaaaacaactagctgggcatggtggcgggcacctgtagtcccagctactccagaggctgaggcaggacaatggcgtgaacccgggaggcagagcttgcagtgagtcaagatcgcgccactgcactccagcctgggcgatagagcaagactccatctaaaaaaaaaaaaaaaaaattagccaggcatggtggtacgcacctgtaatctcagcttatcgggaggctgaagtgggaaaatcgcttgaacctgggaggtggagg

SEQ ID NO: 152040 - DNA, 601 bp, Human
ggccggcgcagtgactcacacctgtaatcccaacactttgggaggccaaggcaggtggatcacctgagatcaggagttcaagatcagcctggctaacatggtgaaacactgtctctactaaaaataaaaaaaaattagtctggcatggtggcacatgcctgtaatcccagctacttgggaggctgaggctgaacaatcacttgaacccgggaggcagaggttgcagtgaactgagattgggtcactgcactccagcctgagtaacagagcgagactctgcttcaaaaataaaataaaatawaaatataaaaattagccaggcatggccgggcgcggtggctcacgcctgtaatcccagcactttgggaggccaaggcgagtggatcacaaggtcaggagatcaaaatcatcctggctaacacggtgaaacaccgtctccactaaaaaaaaaaaaaaaaaaacaactagctgggcatggtggcgggcacctgtagtcccagctactccagaggctgaggcaggacaatggcgtgaacccgggaggcagagcttgcagtgagtcaagatcgcgccactgcactccagcctgggcgatagagca

SEQ ID NO: 152041 - DNA, 601 bp, Human
caatttcaaaagataatccaaagccatcatgatcattatcaatatatctatatagtgcacacttaccactgcaattttccccagtcaagaatgcatactaaaccaggcaccgtggctcacgcctgtaatcccagcactttgggaggccaaggtgggccaatcacctgaagtcaggagtttgaggctaggctggccaacatggtgaaatcccatctctactaaaaatacaaaaattaggccggcgcagtgactcacacctgtaatcccaacactttgggaggccaaggcaggtggatcaccwgagatcaggagttcaagatcagcctggctaacatggtgaaacactgtctctactaaaaataaaaaaaaattagtctggcatggtggcacatgcctgtaatcccagctacttgggaggctgaggctgaacaatcacttgaacccgggaggcagaggttgcagtgaactgagattgggtcactgcactccagcctgagtaacagagcgagactctgcttcaaaaataaaataaaataaaaatataaaaattagccaggcatggccgggcgcggtggctcacgcctgtaatcccagcactttg

SEQ ID NO: 152042 - DNA, 601 bp, Human
tcatttttagaagtgaactttacattacagaatttgagtttaattctcaaattctgcggtctgatttatctagaggttcctcaacttaaatggtagttgtcagtagtaacacagaatttcttaccttgagatgcttttatacattcttacaacactaagtgtttttgcttgtttcagtttctcactgctactatggcttaacaggcaataaaaaattgctgttcattgtctgattgattccagaaataaatcatgagctctagtttattttctggtattttaacagctcaggttcttttcrtagatagtatattatactaacaactttccagtctagagctcagttgttctaatatctcagctattcaaagactggcatgaatgggaactgaaaaaggcctctgagcagcccaaataccaaagaccttctaacatagcccatgccttttaccaataggggcctcacctgagccaagaagttttctatgttgaacaatttttgtaagtttgggtgtctagtttttgttttgtttccaaattccctatcccctattctgagaagcagggtgtctagtttttttttttttttttgagacagagt

SEQ ID NO: 152043 - DNA, 601 bp, Human
cttttcctgtacttactttctaattaaatcaagagtaaagatgaaattcaaactgcataaaatttgtttctctaatattatagccagaagtaaaaatcattctccacacaactcattaaagaattcaaaagtaccactgattatcaacaggccagaaattataaagccaaattatatgtaccttttttaaaaagagggcgttccaggaacaatgttgtctttgttcagttctgagaggttaagtggttaataaactctggaaaataaaaaataataataatttagtagggtaggtcttttytctgaaactgaagacatactgctcaagttttggggaaacctataatttacaagtagggaagactgaaggcatgacgtcatggtttgaggcagcatgcagtagagtcttcaaaagacacaagcggccagacatggtggctcatggcctgtaatcccaacactttgggaggccgaggcgggcagaccacctgagacccggagttcaagaccagcctggccaacatgatgaaaccccatctctactaaaaatacaaaaattaggctgggcatggtggctcatgcctgtaatcccagcactttg

SEQ ID NO: 152044 - DNA, 601 bp, Human; identical to SEQ ID NO: 38520

SEQ ID NO: 152045 - DNA, 601 bp, Human; identical to SEQ ID NO: 38521

SEQ ID NO: 152046 - DNA, 601 bp, Human; identical to SEQ ID NO: 38522

SEQ ID NO: 152047 - DNA, 601 bp, Human; identical to SEQ ID NO: 38523

SEQ ID NO: 152048 - DNA, 601 bp, Human; identical to SEQ ID NO: 38524

SEQ ID NO: 152049 - DNA, 601 bp, Human; identical to SEQ ID NO: 38525

SEQ ID NO: 152050 - DNA, 601 bp, Human
agtgagccaagatcacaccactgcactccagcctaagcaacaaagtgagactctgtctcataaataaataaataggcatcccaaaacactgaaattacaggtgtgaaccaccttgccagccaagaaggagactttttttcttttgagacagggtctcgctctgtctcccaggctggatggaatacagtggtataattacagctcatggcagcctcgacctcctggactcaagtgaccctcctgcctcagcctctggagtagctgggaccacagctcagccaatttttgtatttttttttttgtatagatgggatttcaccatgttgcccaggctggtctccaactcctgggctcaagcaatctccccactcggcctcccaaagtactgggattacaggtgtgaaccaccacgcctggccatgacgcagaaaattttaacaagaaaataaatttgggcattgtagctcacacctataatccagctattcaggaggctgaggcaggaggatccacttgagcccaggaggttgatgctgcagtgaaccataatctcacactaccgtactccagcctaggcaatagagaccccgtgaaacaaacg

SEQ ID NO: 152051 - DNA, 601 bp, Human
ccagctactcgggaggctgaggcaggagaatcgcttgaacccaggagccagaggttgcagtgagccaagatcacaccactgcactccagcctaagcaacaaagtgagactctgtctcataaataaataaataggcatcccaaaacactgaaattacaggtgtgaaccaccttgccagccaagaaggagactttttttcttttgagacagggtctcgctctgtctcccaggctggatggaatacagtggtataattacagctcatggcagcctcgacctcctggactcaagtgaccctcctgcctcagcctctggagtagctgggaccacagctcagccaatttttgtatttttttttttgtatagatgggatttcaccatgttgcccaggctggtctccaactcctgggctcaagcaatctccccactcggcctcccaaagtactgggattacaggtgtgaaccaccacgcctggccatgacgcagaaaattttaacaagaaaataaatttgggcattgtagctcacacctataatccagctattcaggaggctgaggcaggaggatccacttgagcccaggaggttgatgctgcagtgaa

SEQ ID NO: 152052 - DNA, 601 bp, Human
ggtggctcacgcctgtaatcccaacactttgggaggccgaggcaggcggatcacgaggtcagaagatcaaaaccatcctggctaacaaggtgaaaccccatctctactaaaaataccaaaaaaattagccgggcatggtggcgggcgcctgtagtcccagctactcaggagactgaggcaggagaatggcgtgaacccgggaggcagagcttgcagtgagccgagaccatgccactgcactccagcctgggcgacagagcgagactccgtctcaaaaaaaaaaaaaacagatttataaagyaaaggaaatgagaagacaaaggaggaaactgaaaggaaacaggcacaaggaaggggatgaaaagactttgttataaggtaactctggtatagaaatacccacatactaggctggatgtggtggctcacgcctataatcccagcactttaggaggccaaggtaggcggatcacgaggtcaagagattgaaaccatcctggccaacatggtgaaaccccatctctactaaaaatacaaaaattagctgggcatggtggcgtgtgcctatagtcccagctactcaggaggctgaggcaggaga

SEQ ID NO: 152053 - DNA, 601 bp, Human
tagtgagacttcatctccacaaagaattaaaaaaaaaaaaaactagctgggcgtggtggcatgcacctgaggtcccagctactcaggaggccaaggtgggaggattgcttaagcctgggaggtcgaggctgcagtgagacatgatcacaccactcactccagcctaggcggcaaagaaagactctaaaaaaactaaaacccaaatattccaaaaagcaacacatattttctttgacccattggcaaggatgaaaaaagaagcaacttcaaaaatctataatcttgtctaagtatagtttttgtttaagacaacctcatcagtttgaaaacatgtattttgaattacagcaccactttcaagagtataaaaaatagagaacattccaggtgggttataaatgcacaagcagtatggacaatatttaccttacagtgagctggaccttgctcacacaaaagcctatactcaagctggatcttgctgaaacaaactaactcattcacaagacacaactgggatttttctctatggggttcgccacatgagaaggaagtgaaaacgttaagagcactgaagtcaactagcagtatataagactac

SEQ ID NO: 152054 - DNA, 601 bp, Human
cgcagtacaatccctgggtcatcttggtgattgtctcatggataaatgctgaaggggaaaaagctaaaaaaaaaaaaacacacaaagttattctcgtgaaccgtcttgcctttctctaggactttccccatccggtgctacctgccactctgctgcattctgttggtgtagcaaggctagaatcttggttttgatagaaccaaaagcataccacatctcttgatttttcaaataatctaaatcacccaagagagaacaacttctcctctttgaacaacttgtgggtaaaaagaatatatgyggttagagatgaacacacagccaaactacctaaattattaaaagttcaagtgagaaagtgcattagccaaaatataataaaaagttaataaagggaatcccgaagttaaggtctgcaaaaaaatcctggagaggaaatacaacagttatagaaaaatgactgacttctatttttattttaattaattattttttgataaagggtctcactctgtcacccaggctggaatgcagtggtgccatctcagctcatcacagcccccacctcccaggttcaggtgattctcctgcctcagcctcc

SEQ ID NO: 152055 - DNA, 601 bp, Human
ctgcaacgcagtacaatccctgggtcatcttggtgattgtctcatggataaatgctgaaggggaaaaagctaaaaaaaaaaaaacacacaaagttattctcgtgaaccgtcttgcctttctctaggactttccccatccggtgctacctgccactctgctgcattctgttggtgtagcaaggctagaatcttggttttgatagaaccaaaagcataccacatctcttgatttttcaaataatctaaatcacccaagagagaacaacttctcctctttgaacaacttgtgggtaaaaagaawatatgtggttagagatgaacacacagccaaactacctaaattattaaaagttcaagtgagaaagtgcattagccaaaatataataaaaagttaataaagggaatcccgaagttaaggtctgcaaaaaaatcctggagaggaaatacaacagttatagaaaaatgactgacttctatttttattttaattaattattttttgataaagggtctcactctgtcacccaggctggaatgcagtggtgccatctcagctcatcacagcccccacctcccaggttcaggtgattctcctgcctca

SEQ ID NO: 152056 - DNA, 601 bp, Human
ttctgcagtccatcaggctactcatttaagtacaaacaacagcatgaactcaaaaccctggcaggcaggaaggtcaaatggcagaagcctgcaacgcagtacaatccctgggtcatcttggtgattgtctcatggataaatgctgaaggggaaaaagctaaaaaaaaaaaaacacacaaagttattctcgtgaaccgtcttgcctttctctaggactttccccatccggtgctacctgccactctgctgcattctgttggtgtagcaaggctagaatcttggttttgatagaaccaaaagyataccacatctcttgatttttcaaataatctaaatcacccaagagagaacaacttctcctctttgaacaacttgtgggtaaaaagaatatatgtggttagagatgaacacacagccaaactacctaaattattaaaagttcaagtgagaaagtgcattagccaaaatataataaaaagttaataaagggaatcccgaagttaaggtctgcaaaaaaatcctggagaggaaatacaacagttatagaaaaatgactgacttctatttttattttaattaattattttttgataaagggtct

SEQ ID NO: 152057 - DNA, 601 bp, Human
atgcaccccaaagatttgagattcactactttggaatttaacaaatcaattgaagcggccgggtgtggtggctcacaactgtaatcccagcactttgggaggcagaggcgggcagatcacctgaggtcaggagttcaagacccgcctggccaacatggtgagaccctgcctctactaaaaatacaaaaattagccacgtgtggtagtacgtgtctgtaatcccagctactcaggaggctgaggcaagagaatcacttgaacccgggaggttgcggttgcagtgagccgagaacacgctatkgcactccagcctgggtgatgacagagtaaaactccgtctcaaaaaaagaaaaaattaattgaagcttttattcttctgatgtaatcactgaatatcactttatctcacttacaaataatttacaagggaaacctggatttcagtatgtctaggtcatttaaatttggtgccttaaggggtgaggcaacttgccttcatagctgatttttcttgtaggtcttacttttaggattccctcagtgcacggcttccactaaaggaaaaaaacaaagaatcctttattggccaggtgcagtggct

SEQ ID NO: 152058 - DNA, 601 bp, Human
gctgtgtgtttgacctttttaataccagttcactcagctccccattgctgatttccaagtgtcagcagtactgtaaattcctagaaatgaaaagtgtgagctctcaaattcatgaaacctgacattgactgtaatatgtcacttgaaccttgaacactttctatggtcatggtttaagaggcctggtcttatcttgataattcatcctgtcatccccttcttatccttttttgttgttttttataaacaacaacaaaaaaaagagattgtgtgtgtatgcactgaaattttttttttttttaagagacacagtctcactctgtccccaggttagagtgcagtggtgtgatcttggctcaatgcaacctccacctcctgggttcaagaaattctcctgcctcagtctcccgagtagctgggattacaggcacctgccaccatgcccggctaatttctgtacttttagtagagacagggtttcaccatgttggccaggctggtctcgaactcctgacctcaagtgatccacctgcctcagtctcccaaagtgctgggattacaggcatgacccaccacgtccagcctcaaaattctcttccaa

SEQ ID NO: 152059 - DNA, 601 bp, Human
agtctgaatcattttaagagcagctctgatccacagaatttgtctgcaatagagaataaacatgaagaaagtatactgcaaagaaatcaaaagtaacaagaaagatgtgactggtaacttcccagattccttcctacatacgaagacctgggatgacttcatgcatgtgagggggtctctgctaaaacagccattaatgacacagcctccaggtcactgatccccaacccttcaccagccatgccttcttgattagtatgctccctgaatgggctccttgtctgaggagatactacctgcyggcttgtatttaagtaatatttacatttttctcattctttttaataactaagagacatacaactggcaataagcacttctgaccaacaaaattacaatcaatattaccacactgacttgatgtgactctaaattaaacttatattcttgctaatctatacactcttatcaaaaatatattttcattaaacttcggaaatctttgaaattatctggtcacccgccatccttcctatgaccgcctttccagattgtcaggcgttaaggcatcatagattggaaaccactgctttacaatgag

SEQ ID NO: 152060 - DNA, 601 bp, Human
taaaaaccatttaaaaagaaaaccagcctggaaagattagtgtcagtgcacaatatttaaaaacaacactttcatatcaaaaacagaacactagaaatggcaaaatctaaatgcacataaaaatccactttaaaatgcctctttaggatgtatatagagagaaataaaaaagacctgattctgtactataactggttcaactaaatttaatgcatgaatcaaatctataagaatatctttggggtttgcacagagggccacatgaattacagatctctctcttccttgcattagaattatwttttttacaaaattcatataattgcattttaagtacagtctgaatcattttaagagcagctctgatccacagaatttgtctgcaatagagaataaacatgaagaaagtatactgcaaagaaatcaaaagtaacaagaaagatgtgactggtaacttcccagattccttcctacatacgaagacctgggatgacttcatgcatgtgagggggtctctgctaaaacagccattaatgacacagcctccaggtcactgatccccaacccttcaccagccatgccttcttgattagtatgctcc

SEQ ID NO: 152061 - DNA, 601 bp, Human
acacggtgaaaccccgtttctactaaaaatacaaaaaattagccaggcatggtggcgcatgcctgtaatcccatctactcaggaggctgaggcaggagaatcgcctgaacccaggaagcagaggttgcagtgagtcgagattgcgtcactgtactccagatgaggaaacaagagcaaaactctgtcttaaaaaaaaaaagaaacacaattcctgccccagaggagttcaaaaaacacaaagcacactcaaagagttacaatacaacatgatgtgcaacttaaaggtgaaaaatcagtgagraggtggcaacccaattctcttcacagaagtcacacaaggcccacaaaatattcaggtatttccattcttgacatttctaatgaatttgacctgtggtcatacttgctacgaaaatgagttccattttcatacacaacaagttatctcaaaattatcaacttcagaaaatacatgctattcattttccaatttttttttctttcagttcatccaatccataaacctttaaaaaccatttaaaaagaaaaccagcctggaaagattagtgtcagtgcacaatatttaaaaacaacactttca

SEQ ID NO: 152062 - DNA, 601 bp, Human
cttaatcaatataaccttggttgtactgatttacaggattattggcttgcactcagaagtatgtccgtacacagtattgaacgatgcatttattacattactaactggatgcaaagcactgtgctaagcttaagaaacacaattcctggccaggcgtggtggctcacgcctgtaatcccagcactttgggaggccaaggcaggaggatcacaaggtcagggtatcgagaccatcttggctaacatggtgaaaccctatctctactaaaaaatacaaaaaattagccaggcatggtggcggrtgcctgcagtcccagctactcaggaggctgaggcagaagaatggtgtgaacctgggaggcggaccttgcagtgagggtggctcacacctgtaatcccagcactttggaaggccgaggcgggtggatcacctgaggtcaggagttcgagaccagcctggctaacacggtgaaaccccgtttctactaaaaatacaaaaaattagccaggcatggtggcgcatgcctgtaatcccatctactcaggaggctgaggcaggagaatcgcctgaacccaggaagcagaggttgcagtgagtcgag

SEQ ID NO: 152063 - DNA, 601 bp, Human
tatctgtgataagattctgcctggccaaagatattcactaatgctttgacccctcaatggcatggagttactgattccctaagaattatattgctatttagtcacaaaaatgttaaaatccttttcctatcatggtggttttaaaacatggcccctaattctttgacaatcctttcatcatctggaaatgggattctccatattgtgaacgtactaaaatccactgaattgtacacttacaatagtcaatttaggttatataatttttacctccatttttttttttttgagacagagtctygctctgtccctgaggctggagtgcagtggcacaatctcggctcaccgcaagctccgcctcccgggttcatgccattctcctgcctcagcctctcgaatagctgggactacaggcgcccaccaccacgcccggcgaattttttgtatttttagtagagatggggtttcaccatcttagccaggatggtctcaatctcctgacctcatgatccacccgccttggcctcccaaagtgctgggattacaggcgtgagccactgcgcccagccacctcaattttttttttctaagtgacattcta

SEQ ID NO: 152064 - DNA, 601 bp, Human
aacaaaagcaaaagccagattcctgggtctcaccctacacctattgcattagaatcccggggttgggcctagaatttatttttttaacttctcaagtgattgtgatgcagaaaagccatatagcagtgtccagcaattgttcatcaactattggctggaaggactagaaatacctactccatctgactccaattagattagcaacagtcaagtaaaaagctgaaaagcctccaaaataactcaaattacactacctttttggtgttttaacaaatctcaccactgaaaagctcattctttyaacttcactaaatcctcctcttttagttacagcctcattttctttgatttggtccttagtgagccctggaaacagatcatctgttagaataggtgattatagcggaaaatggaaatgcagcgtaacaaaagaaaaacaaatcgctcctgtgcggccagccatgaagcccaagttgggtcaccctgggtggcagctggatacaacagactcagcaggcaccctgcccaaggtccactcgggtctacacctctcatcacatagcccactgttctgtgcaggatcctcctgttctttgtgaac

SEQ ID NO: 152065 - DNA, 601 bp, Human
cacaaatatgccacagctaaactgacaatttgtttaaaatgatcatttccaatgctggcaggctgtggacagacgggctgcttatggcctgtcagcaggttgtaaaatggcaccctctttctgtggagaacttggccatatgtaccaccatgcatacccgctggttcagcaattccacttctaggaccgtggacaaagactttaactgcaacgatgttcttcccgacccattttataagagggaaaatgcaaacaacctaaataatcaagtccctgttggaaaataaagcagtgcattcayatagtggaacattttgtagccattagaaagtgcttaggtgtgtgctgaatttgggtcctccaaggaattttaagtaaatgacgtaacatattcaagatatacacatcagtgaaaaaaggtggttactgtacactgtcatgccatttttatgaaatagataggcatctgtatttacttgtatatgtgcttgtcagtgaatatacaccaaatggttacagtgattatccgcaagtggtaaatttataaatcattcattgttccttgtttttgaatttaaaattttttatagtccatatgcac

SEQ ID NO: 152066 - DNA, 601 bp, Human
aaagaaagaaacaaaaatacatacacactgaaacaccaacaggatcacactgtatgcacagtaacagctctgcatcttcatcccttttcatgcctgcctatacgagatatctcactctggtactcaggggataaacgtagccaagtttttaaccactttcctagtaacagacatttaagctagcccccgtttttctctattacagatactgcagctatgaccatactgctcctaatagctcagacactgagtaaaactcatacttcattagcacaaaccttagattaaataaacaaataamccatgcactttcttaacttggggcctttgcaactgccactccctctctgggcatacactgtccctgccctttgctgatctttagtatcagccgaaatgtctcttcctctgaaaagactgctctgaactcaccaccattattccaacctaaatgagatactttacgttcttctaatccttgtcatttttccatccttgcactaaatgcactttttgctgatattaatgttaatgtctggcagctccatttgactaagttcacaggaaaagggatggcgctgactgtttcaactcagggtct

SEQ ID NO: 152067 - DNA, 601 bp, Human
actgcactccagcctgggcaacaatagtgagacctgtctctgttagaaaaaaataaaaaagaaaaagaaaactaggtccaatgaacactgaggaaacaagaagggttaaagtctccaatttcaggccaggcgctatggctcatgccagtaatcccagcattttgggaggccgaggcaggtggtggtcacttgagctcaggagttcgacaccagcctgggaaacatggtgaaacctcgtctctaccaaagatacaaaaattaggtgtggtggcatgcacctgtggtcctagctacttgggargctgaggtggaaggactgcttgagtccaggaggcggaggttgcagtgagccaaaatcacaccactacactccagcctgagtgacagagtgagacaccatctcaagaaaataaataaataaacaaatgggtctctaattttaactttactcctaattaagtatgcacctatcccaagtgaagataaagactcaaaaccagaaagagctgcatttattcatttttacaaaagtataaaaaagtattttaaaaacttcaggatgtttacggtggctcatgcctgtaatcccaggattctggga

SEQ ID NO: 152068 - DNA, 601 bp, Human
ccgtctctactaaaaatacaaaattagctgggtgtggtggcacatgcctgtaatcccagctactcgggaggctatggcaggagaatagcttgaatcagggagtcggaggttgcagtgagccgagatcgcaccactgcactgcagcctggcaacagagcgagactccgtcttaaaaaaaaaaaagaaaagaaaacctgagccaggcacaagcatgcctgcagtcccagataatcaagaggcaaaaggatcacttgaatccaggacttcaaggccacagggtactatgatcatgtctgtgtayagccactgcactccagcctgggcaacaatagtgagacctgtctctgttagaaaaaaataaaaaagaaaaagaaaactaggtccaatgaacactgaggaaacaagaagggttaaagtctccaatttcaggccaggcgctatggctcatgccagtaatcccagcattttgggaggccgaggcaggtggtggtcacttgagctcaggagttcgacaccagcctgggaaacatggtgaaacctcgtctctaccaaagatacaaaaattaggtgtggtggcatgcacctgtggtcctagctactt

SEQ ID NO: 152069 - DNA, 601 bp, Human
gggcgtggtggctcacgcctgtaatcccagcactttgggaggctgaggcgggtggatcacgaggtcaggagttcgagatgagcctggccaacatggtgaaaccccatctctactaaaaatacaaaaattagccggcggtagtggcacgcacctgtagtcccagctacttgggaggctgaggcagaagaattgcttgaagctgggaggcggaggttgcagtgagccgagattacaccactgcactccagcctgggcaacaaagcgagactccgtctcaaaaaaaaaaaaaaaaaaaaaaaargaccaagcgtggtggctcacgtctgtaatcccagcactttgggaggccgaggcaggtggatcacaaggtcaggagattgagaccatcctggccaacatggtgaaaccccgtctctactaaaaatacaaaattagctgggtgtggtggcacatgcctgtaatcccagctactcgggaggctatggcaggagaatagcttgaatcagggagtcggaggttgcagtgagccgagatcgcaccactgcactgcagcctggcaacagagcgagactccgtcttaaaaaaaaaaaagaaaagaaaa

SEQ ID NO: 152070 - DNA, 601 bp, Human
gtactggcactgtcaaacacactacttttgaaacagactcataattctgttgaagagaaagcagccatttccttgctccattaagtgcaaaatgctttcatttttggattataaacaccaacagaaggatcaatccagttatttttgtcatttttatatctattttcttccaatcacctttggacacacacctccttgtgcatttgtccagttattttgttgacaataagtggtaagaaataaatgttggcggccaaacataaaagataaaagaatgttgtcacacgtactttttttttttaaatgcaaacaggatgggagaggttcttgtcgaaaaatgttgcatgatgaagtcctttctgttgaatgactagatgagaatataccacatttcctttccatacatcagataaataatcactagctgattcttgagtttggggaaattcatctatgctagcatctgaagactcacagtctgcgattttgcttagacaatctcaccatcatcattacagtctggagtgctgccatctatctgtctttttgtgttcatcttctgatttgttaatcatcagaaatgtcttcctctgtcaattct

SEQ ID NO: 152071 - DNA, 601 bp, Human
tcaaaactaatctacaaaaaccattcccagtaaaatgaggaaggtttagtgggcacttagtcttatcttcacaatgtaggaattactgttaacactgattccatagtgtatagttcagcaataaaatctaggcaacattaagaaagaggccaggtgtgatagctcatccctataatctctgcactttgagaggccacggtgggcggatcacttgagcccaggagttcaaaaccagcctgggcaacatggcaaaacccgcatctctacaaaaaatacaaaaactagccaggtgtggtggcayacacctgtagtcccagctacgagggagactgagatgggaagatcacttgaggccaagaggtcaaggctgtagtaagccacaatcgtgccactgcactccagctagggcgacagaggaagaccctatttcaaaacaaaacaaaacaacagaaaagaaagaaatgctctgaaccacacttaaccctcacagtatgctaggaaaattagccatcaccatttattatctggctccaacagactcttctgtttttctatatctaaagtcattttacaaataatttaccaaataaaaggatgacaa

SEQ ID NO: 152072 - DNA, 601 bp, Human
aatgttttgttcattgtatcagcccaattaggtttaacttttatttttatttacaacctatttcaaacatacagaaaagtacagataataacataacaggcaatttcctggatttatccaatgtcaatagttaagtactactgacgtcggactgtttttttctgttttaagaaaaacaatgagccacgcatggtggctcacgcctgtagtcccaacacttctggaggctgagatggatggtttgtttgaagtcaggagttcaagatcagtctaggcaacaaagtgagaccttaatctctayaaaaaaattttaagattacccaggtgcagtggagtgtgcctatagtcccagctactggggtggctgaagcaaaaagatcacttgattgattgcccaggagtttaaggctgcagtgagctatgatcgtgccactgcactccagcctgggtggcagagcaagactccatctcaaaacacaaggcaacgggccaggcgaggtggctcatgcctgtaatcccagcactctggaaggccaaggcaggcggatcacttgaggtcaggagttcgagaccagcctggccaacatgacgaaaccccatc

SEQ ID NO: 152073 - DNA, 601 bp, Human
gaaaggttctgaaaattagtagtgacagttgtgcaaaaccaagaatgtattttaatgccactggtgcacttaaaaatgtttaataattttagatgtatattttgcctgaattttttaaaaagcagcaacaaaaatgtttcacaccaaatattaagataccagaaatcatcaacacagtaacttgtgctaaccccagattaactcatttttgtgcacaacagaataaagcttgacagctgtttccctgaagagcatccagagttttttttaatagatgatctgtttaaaaaaaaaaaaaaaaggtccacatgctaagaactgtgccaatgagaatgctctttatgagcagccagaacacaacttggaaataaactaggtgctcagactgtcgtaagactttgaatgccacgtacatgccccaattttcaatgttttgttcattgtatcagcccaattaggtttaacttttatttttatttacaacctatttcaaacatacagaaaagtacagataataacataacaggcaatttcctggatttatccaatgtcaatagttaagtactactgacgtcggactgtttttttctgttttaagaaa

SEQ ID NO: 152074 - DNA, 601 bp, Human
tcccagctacttgggaggctgaggcaggagaatcacttgaacccaggaggcagagattgcagtgagctgagattatgccactgcactccagcttgggcaacaagagcgaaactctgtttcaaaaaaaaaaaaatccacagtaagataccactcacacccataaggatggctgctatcaaaagaaatggaaataacaagtttttggatatggagaaatgagaagcttccagtcacttatgaaaatgtaaaatggttgtaccagatttggattttattaaaaataaaatagaaaatgggcagkgcgtgcggtggctcacacctgtaatcccagcactttgggaggccgaggcaggcggatcacctgaggtcaggagttcgagaccagcctggccaacatggtgaaacaccatctctactaaaaatacaaaaattagctgagcgtggtgacgcgcacctgtagtcccagctactcgggaggctgaggcaggagaatcgcttgaacccaggaggcggaggttgcagtgagccgagatcacgccactgcattccagtccagtgagactccgtctcaaaaaaaaaaaaagtaagttaattaatttaa

SEQ ID NO: 152075 - DNA, 601 bp, Human
gttctacagaggtttggcttgaaatttacaggttggtgcaaaagtaattaccaatctaatagttaaatagatattaaacttaaaaaaaaaatactgtaagcttgttcaacaaatggtgctaggaaaactagatatccacatgcaaaataataaggcaggacccttaccccacaccactaaaaactcaaaatggatcaaatacttaaacataagagctaaaacagtaaagttcctagatgaaaacataggggaaaagtgttatgacaccatctggtgatttcttacatatgacatgaaaacygcagacaacaaaagaaacattaatattagacttcatcaaaatttaaaacattcatgcatcaaaggacactatcaagagagtgaagaaaacccacagaatgggatttgcaaatcatttatctcataagggattaatatccagaatatataaagaactacaactcaacaataaaacaacccaattagaaaatgggcaaagcacttacacaggcatttctctaaagaaatacaaatagtcggctgggcacagtggctcatgcccgtaatcccagcactttgggaggccgaagcaggtgggtca

SEQ ID NO: 152076 - DNA, 601 bp, Human
ttaaaaaaatatatatataaccaagggtataatcctggacaaataaatttattccagatgctctttgtaattccttctatccttccataatcttttctttccaatctggtttcagtgtatctcacctgagtcaaaactactttcatagcacttgtggtggtttattaacctacacatacttttttttgttttttggagacagtgtctcacactgttgcccagtctgaaggacagtggtacaaacatagctcactgcagcttcaaactcctgacctcaagcaatattcccatctcaccctcytgagtagctgggactactggcataggcaccactcccagctattttttttaatgttttgtagagatggggtctcactatgttgtccaggctggtcttgaactgggctcaagcaaccctcccacctcaacctcccaaagtgttgggatttataggtgtgagccaccatacccagcccacacttgtatttttgtttaaatcctaagcagaaaaagggtctacttttttatgagtgaatccttaaaactggcaatttgcaagcaaggtaccttaaaggctggagttctacagaggtttggcttg

SEQ ID NO: 152077 - DNA, 601 bp, Human
cgccactgcattctagcctcagtgacagtgtgagaccgtgtcacacccaccaaaaaaagctataattaaaataaaacaaactctaggttaaaaaaatatatatataaccaagggtataatcctggacaaataaatttattccagatgctctttgtaattccttctatccttccataatcttttctttccaatctggtttcagtgtatctcacctgagtcaaaactactttcatagcacttgtggtggtttattaacctacacatacttttttttgttttttggagacagtgtctcacactrttgcccagtctgaaggacagtggtacaaacatagctcactgcagcttcaaactcctgacctcaagcaatattcccatctcaccctcctgagtagctgggactactggcataggcaccactcccagctattttttttaatgttttgtagagatggggtctcactatgttgtccaggctggtcttgaactgggctcaagcaaccctcccacctcaacctcccaaagtgttgggatttataggtgtgagccaccatacccagcccacacttgtatttttgtttaaatcctaagcagaaaaagg

SEQ ID NO: 152078 - DNA, 601 bp, Human
ttaaaagctgtaattggctgggcatggtggctagcgcctgtgatcccaaaactttttaaggacaaggtgggtggattgcttatgcccagtttgagaccagcgtgggcaacatggcaaaaccccatctttataaaaaaaatacaaatattagcaggtgcggtgtcgcacatctgtggtcccagctacttgggaggctgaggggagaggatcacctgagcctagggtgttgaggctgaggtggctatgatcacgccactgcattctagcctcagtgacagtgtgagaccgtgtcacacccacyaaaaaaagctataattaaaataaaacaaactctaggttaaaaaaatatatatataaccaagggtataatcctggacaaataaatttattccagatgctctttgtaattccttctatccttccataatcttttctttccaatctggtttcagtgtatctcacctgagtcaaaactactttcatagcacttgtggtggtttattaacctacacatacttttttttgttttttggagacagtgtctcacactgttgcccagtctgaaggacagtggtacaaacatagctcactgcagcttcaa

SEQ ID NO: 152079 - DNA, 601 bp, Human
ttttttttttttgagatggagttttgctcgtgtcgcccaggctggagtccaatggcatgaccttggatcactgcaacgtctgcctcctgggttcaagcgattctcctgcctcagcctcccaagtaggtgggattacaggcacccaccaccacacccggctaatttttttttttttttttttgtatctttagcacagatggggtttcaccatcttggccaggctattctcgaactcctgacttcaggtgatccgcccaccttggcctcctgaagtgctgggattacagacatgagccaccgygtctggccactgaatattaaaagctgtaattggctgggcatggtggctagcgcctgtgatcccaaaactttttaaggacaaggtgggtggattgcttatgcccagtttgagaccagcgtgggcaacatggcaaaaccccatctttataaaaaaaatacaaatattagcaggtgcggtgtcgcacatctgtggtcccagctacttgggaggctgaggggagaggatcacctgagcctagggtgttgaggctgaggtggctatgatcacgccactgcattctagcctcagtgacagtgtgag

SEQ ID NO: 152080 - DNA, 601 bp, Human
atgtcctgtcaagtttgagtcaaattgtacctcataagttcaccaaaaacaatccgcacataatagacctttggatatgtgtcagcctgactgtggttcagcaagatgtcactgctgctcggaacagtgacttccaaaagtccttctcaagtagtgggaagccacattttggaaaagtcaaaatacagacagatatatgtgggacgtggcaaattcagattaagtctgtccacatgagtatgcaggcttatttgaacataaattccctggaaaccactttttttttttgagatggagtctygctctgttgcccaggatggagtgcagtggcgcgattttggctcactgctacctccacctcccaggttcaagcgattctcctgcctcagcctcctgagtagctgggattgcaggcatgcgccaccacacccagctaatttttgtatttttagtagatacggggtttcaccatgttggtcaggctggtctcgaactcctgacctcatgatccacccacctcggctcccaaagtgctgggattaaggcgtgagccaccacgcccggcgggaaaccactttaagagaatgcagccatgcgcatg

SEQ ID NO: 152081 - DNA, 601 bp, Human
ttccaactacttggagggctgaggcaggagcattgcttgagcccaggagatcgaggctgcagtaagccatgatcatgcgccactgcactccagcctgggtgacacagcgagacgctgtcccccacaaaaaaacacccatcaacatcctagctgcaatggtaaaccttaaaagcactgagctttggctttatgaatttaaccacacacataccaagtgtcactgaatttaagaggttaaaaagatacatgtcctgtcaagtttgagtcaaattgtacctcataagttcaccaaaaacaatcygcacataatagacctttggatatgtgtcagcctgactgtggttcagcaagatgtcactgctgctcggaacagtgacttccaaaagtccttctcaagtagtgggaagccacattttggaaaagtcaaaatacagacagatatatgtgggacgtggcaaattcagattaagtctgtccacatgagtatgcaggcttatttgaacataaattccctggaaaccactttttttttttgagatggagtctcgctctgttgcccaggatggagtgcagtggcgcgattttggctcactgctacctc

SEQ ID NO: 152082 - DNA, 601 bp, Human; identical to SEQ ID NO: 119373

SEQ ID NO: 152083 - DNA, 601 bp, Human
aaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcaggraaaaaaaaaaaaaagctctgggttgaaacccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgca

SEQ ID NO: 152084 - DNA, 601 bp, Human
aaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcagrgaaaaaaaaaaaaaagctctgggttgaaacccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgc

SEQ ID NO: 152085 - DNA, 601 bp, Human
ggaggggcaggaatgagtgtcagaggaatggagaggaacaaacaagccctcgtacccaggtgggccacagtagggagccctggcaactacaatcccacctctggcccatggcaggcagagaggcatcagcagggtgaggtgagaaatcatcatcactcggccaaaggatggagcactgaagctgggttaagtttagggtgctagcacataggaggagaaggtatacatcacctgtaactgtaaagaatacttcaaagatattttacaggaatataagcttcagataggctttttaagaaayaagccataatcaagcacgtaaatcaaaagaatctgcaaagaatctgctgtgggtcagaccttatttctaaggtaaacattaaaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttga

SEQ ID NO: 152086 - DNA, 601 bp, Human
catctttttcccactcaactgtgagcccaaacagccattctgaatgtcccctgtctcattccctccccaagtgcatcccagcctccactgatggagggagaaaggccagggagggaatgtagggccaggtgagaagattccagccctagatccatgtcggtgctctggactccaagagaacagtgtaaacctgctcttacccactgagggtggaggggcaggaatgagtgtcagaggaatggagaggaacaaacaagccctcgtacccaggtgggccacagtagggagccctggcaactamaatcccacctctggcccatggcaggcagagaggcatcagcagggtgaggtgagaaatcatcatcactcggccaaaggatggagcactgaagctgggttaagtttagggtgctagcacataggaggagaaggtatacatcacctgtaactgtaaagaatacttcaaagatattttacaggaatataagcttcagataggctttttaagaaataagccataatcaagcacgtaaatcaaaagaatctgcaaagaatctgctgtgggtcagaccttatttctaaggtaaacattaaaaattct

SEQ ID NO: 152087 - DNA, 601 bp, Human
tatttatggaaaaagaaaaagcaggctgggtgcagtggctcacacctgtaatcccagcactttgggaggccaaggcaggcagatcgcttgaggtcaggagttcaagaccagcctggccaacatggtgaaatcccatctctactaaaaatacaaaaattagccgagtgtggtggcgtgcacctgtaatcccagctactcaggaggctgaggcaggagaattgcttgaatccaggaggcagaggttgcagtgagccgagatcatgccactgttctctagcctgggcaacagagttaggctccrtcacaaaaaaaaaaaaaacaaaaggaaggaaggagcaagcaaatatggtaaaatgttaaccactggttaatctaagtgaaagttatattcattgtcctattcttgtaacttttagatagatttgaaatttttgaagtaaaaaattgaaaaaatgtctaggtaagaaaagtgagcctccaaaatggatgcactctttttttttttggtgtaggggaaggaggtagcggagaatggggggtaggaattcagcacagtggccaggagcagaggtgtgggaaggacctggcctgcttaggcacc

SEQ ID NO: 152088 - DNA, 601 bp, Human
aaaaaggaacaaactactgaaacacacaacagcatgaataatgactccaagctaagttaaagaagtcagacaaaaggcaatatactctattttccatttatgtaatattcttaaaaaggcaacactatagggacagaatgagatcaatgcttgccagagcctgaggacagaggggagagactgactgcaaagggacacagggaactttactgggtgggagatgttctgttttgactatggtgctggttacagaaccatatacacttatcaaaacacatcgaactgtgcacttacacagggygactttcactgtaaattatacctcaagaagcctgaccaccccttcatccaaaaaataactgatgggggcatgttaaagggcacaagggccaatttaaaggacaatttggacatcaaaatgggtgacgataacaatggagtaatactttgggtttaaaaaaaagcagcaatgcatctataccgatataattactataagaggggaggaaggaaactttttctttactgtagaatgccagcttggaaatgccaaaaatcataattttgacatctaccacagtgataatcaatgccagcaaga

SEQ ID NO: 152089 - DNA, 601 bp, Human
tttgtatttttagtagagacgaggtttcaccatgttggccaggctggtctctaactcctgacctcaagtgatccgcccaccttggtttcctgaagtgttgggattacaggcatgagcccatgagcccagccaacttcttataaagttatttatttatcatgcaactcagcaaatccactcaagtatttattcaagaaaaatgaaaacatgtctccacagatgtatataaatgtttacagtagatttattaataatcaccaaaaactcacaacaatacaaatcttcaactggtaaatagatgcactgtagtgtgtacacactatgtaacactcttggtgataaaaaggaacaaactactgaaacacacaacagcatgaataatgactccaagctaagttaaagaagtcagacaaaaggcaatatactctattttccatttatgtaatattcttaaaaaggcaacactatagggacagaatgagatcaatgcttgccagagcctgaggacagaggggagagactgactgcaaagggacacagggaactttactgggtgggagatgttctgttttgactatggtgctggttacagaaccatata

SEQ ID NO: 152090 - DNA, 601 bp, Human
gatcttcttggaggaatggccaagaccatttctattagaaatttatgtttccactggggctaaagctagagcaggggaagttcaaagtgaggctaaaacattttgttgtatcagaaagcatggaagttctcaaaatgtgaagaggggaggtgcaaaggttatttaataaaggactgtctcagccaggcatggtggctcaagcctgtaatcccagcctgggcgacaagagcaaaactctgtctcaaaaaataaaggactgtctcttcaacaaacagtgcaggcacaattagacatccaaatmcaaaaaaaaaaaaaaaaaaaagacaaaaacatcccttatgtcacagtatatatgaaaactaactcgaaatgaattataaacctaaatgtaagagctaaaactaaaatttctaaggaaaatgactttaggttagccaaatgtatctcagcatacacaaaaattattaactataaaaaatttaacaaactacacctcaccaaaattcaatacttctgctttttgaaagtcacttaaaatcaaacgacaagccacagacttaagagaaaatatctgcaaaatacttatctgagaaaaaacttg

SEQ ID NO: 152091 - DNA, 601 bp, Human
gctcaggaggtcgaggttgcagtgaggtgagatcatgccactgcactacagcccgggtaccaagtgagttcttttctctaaaatcaaataaaataaacttgttatttcaaaatatacatatttcctagctctatctcctaaccgagagccatggctctccagcaggaacaagcatgctagcaccctgtcctgtctctacacaccactcccaattagaaggaaccggatcttcttggaggaatggccaagaccatttctattagaaatttatgtttccactggggctaaagctagagcaggsgaagttcaaagtgaggctaaaacattttgttgtatcagaaagcatggaagttctcaaaatgtgaagaggggaggtgcaaaggttatttaataaaggactgtctcagccaggcatggtggctcaagcctgtaatcccagcctgggcgacaagagcaaaactctgtctcaaaaaataaaggactgtctcttcaacaaacagtgcaggcacaattagacatccaaatccaaaaaaaaaaaaaaaaaaaagacaaaaacatcccttatgtcacagtatatatgaaaactaactcgaaatgaatt

SEQ ID NO: 152092 - DNA, 601 bp, Human
ttggctgggctcggtggctcacgcctgtaatcccagcactttgggaggccgaggcaggcggatcacctgaggccaggagtttgagaccagcctgaccaacatggagaaaccccatctctactaaaaatacaaaattacctgggcgtggtagcgcatgcccataatcccagctactcgggaggctgaggcaggagaatcgcttgaacccaggaggcagaggttgcggtaagctgagatcacgccattgcactccagcctgggcaacaagagcgaaactctgtctcagaggaaaaaaaaaaaatacaaaaattagcccagtgtgtggtggcgtgtgcctgtagccccagctacttgggaggctgagacagcaggatcacttgagctcaggaggtcgaggttgcagtgaggtgagatcatgccactgcactacagcccgggtaccaagtgagttcttttctctaaaatcaaataaaataaacttgttatttcaaaatatacatatttcctagctctatctcctaaccgagagccatggctctccagcaggaacaagcatgctagcaccctgtcctgtctctacacaccactcccaattagaagg

SEQ ID NO: 152093 - DNA, 601 bp, Human
ccagcctggccaatacagcaagaccttgactctacaaaaataaaaacaaaattagccaggtgtggtagtgtgcccctgtatgtagtcctagctatgtgggaggctaaaacaggaggatcacttaagcccaggagatcaaggctacagggagctatgatcacacaactgcaccccagcctgggcaacagagcaaaacctcgtctcaaaaagcaaaaaaaaaaaaaacaaaaaaaacaaaaaaaaaaaaaaaaaaacaaaaaaacttaaaaatctaaccgatattagccaagacactcaaaaagaaaaatagaagacttacactaccagattttaaaacttcctataaagtcacaacaactaggatatggttttgtgtaaggataaatagatcaacagaacagcacgaaaaagacctgcacatataaggtcactcgatttttggcaaacacaccaaaacaaattaaaaatctcttaaaaaaatagtaccagagcaactaactaggtatctgcatggagcggggtggggggaagaaaaaaaaatcaaaccatgatctctaactcataccacaacaaaaattagacctaggatcacttaaatgtg

SEQ ID NO: 152094 - DNA, 601 bp, Human; identical to SEQ ID NO: 30766

SEQ ID NO: 152095 - DNA, 601 bp, Human; identical to SEQ ID NO: 30767

SEQ ID NO: 152096 - DNA, 601 bp, Human; identical to SEQ ID NO: 30768

SEQ ID NO: 152097 - DNA, 601 bp, Human; identical to SEQ ID NO: 30769

SEQ ID NO: 152098 - DNA, 601 bp, Human; identical to SEQ ID NO: 30770

SEQ ID NO: 152099 - DNA, 601 bp, Human; identical to SEQ ID NO: 30771

SEQ ID NO: 152100 - DNA, 601 bp, Human; identical to SEQ ID NO: 30772

SEQ ID NO: 152101 - DNA, 601 bp, Human; identical to SEQ ID NO: 30773

SEQ ID NO: 152102 - DNA, 601 bp, Human; identical to SEQ ID NO: 30774

SEQ ID NO: 152103 - DNA, 601 bp, Human; identical to SEQ ID NO: 152030

SEQ ID NO: 152104 - DNA, 601 bp, Human; identical to SEQ ID NO: 152031

SEQ ID NO: 152105 - DNA, 601 bp, Human; identical to SEQ ID NO: 152032
